United States Patent
Embree et al.

(10) Patent No.: US 11,044,924 B2
(45) Date of Patent: Jun. 29, 2021

(54) METHODS FOR SUPPORTING GRAIN INTENSIVE AND OR ENERGY INTENSIVE DIETS IN RUMINANTS BY ADMINISTRATION OF A SYNTHETIC BIOENSEMBLE OF MICROBES OR PURIFIED STRAINS THEREFOR

(71) Applicant: Native Microbials, Inc., San Diego, CA (US)

(72) Inventors: Mallory Embree, San Diego, CA (US); Cameron Martino, San Diego, CA (US); Norman Pitt, San Diego, CA (US); Jordan Embree, San Diego, CA (US); Corey Dodge, Encinitas, CA (US)

(73) Assignee: Native Microbials, Inc., San Diego, CA (US)

( * ) Notice: Subject to any disclaimer, the term of this patent is extended or adjusted under 35 U.S.C. 154(b) by 0 days.

(21) Appl. No.: 15/965,661

(22) Filed: Apr. 27, 2018

(65) Prior Publication Data

US 2018/0310592 A1 Nov. 1, 2018

Related U.S. Application Data

(60) Provisional application No. 62/491,845, filed on Apr. 28, 2017, provisional application No. 62/578,188, filed on Oct. 27, 2017.

(51) Int. Cl.
| | |
|---|---|
| *A23K 10/18* | (2016.01) |
| *A61K 35/74* | (2015.01) |
| *A23K 50/10* | (2016.01) |
| *A61P 1/04* | (2006.01) |

(52) U.S. Cl.
CPC .............. *A23K 10/18* (2016.05); *A23K 50/10* (2016.05); *A61K 35/74* (2013.01); *A61P 1/04* (2018.01)

(58) Field of Classification Search
CPC ......... A23K 10/18; A23K 50/10; A61K 35/74
See application file for complete search history.

(56) References Cited

U.S. PATENT DOCUMENTS

| | | | |
|---|---|---|---|
| 3,484,243 A | 12/1969 | Anderson et al. | |
| 4,559,298 A | 12/1985 | Fahy | |
| 4,647,536 A | 3/1987 | Mosbach et al. | |
| 5,104,662 A | 4/1992 | Kalsta et al. | |
| 5,290,765 A | 3/1994 | Wettlaufer et al. | |
| 5,534,271 A | 7/1996 | Ware et al. | |
| 5,605,793 A | 2/1997 | Stemmer | |
| 5,733,568 A | 3/1998 | Ford | |
| 5,741,508 A | 4/1998 | Katsumi et al. | |
| 5,837,458 A | 11/1998 | Minshull et al. | |
| 6,090,416 A | 7/2000 | Iritani et al. | |
| 6,210,891 B1 | 4/2001 | Nyren et al. | |
| 6,214,337 B1 | 4/2001 | Hayen et al. | |
| 6,258,568 B1 | 7/2001 | Nyren | |
| 6,274,320 B1 | 8/2001 | Rothberg et al. | |
| 6,841,168 B1 | 11/2005 | Worrall | |
| 7,427,408 B2 | 9/2008 | Merritt et al. | |
| 7,488,503 B1 | 2/2009 | Porzio et al. | |
| 7,998,502 B2 | 8/2011 | Harel | |
| 8,071,295 B2 | 12/2011 | Ashby | |
| 8,097,245 B2 | 1/2012 | Harel et al. | |
| 8,114,396 B2 | 2/2012 | Horn et al. | |
| 8,345,010 B2 | 1/2013 | Fitzgibbon et al. | |
| 8,349,252 B2 | 1/2013 | Elliot et al. | |
| 8,460,726 B2 | 6/2013 | Harel et al. | |
| 8,906,668 B2 | 12/2014 | Henn et al. | |
| 9,011,834 B1 | 4/2015 | Mckenzie et al. | |
| 9,028,841 B2 | 5/2015 | Henn et al. | |
| 9,050,358 B2 * | 6/2015 | Borody | A61K 35/37 |
| 9,113,636 B2 | 8/2015 | Von Maltzahn et al. | |
| 9,179,694 B2 | 11/2015 | Porter et al. | |
| 9,180,147 B2 | 11/2015 | Mckenzie et al. | |
| 9,206,680 B2 | 12/2015 | Ashby et al. | |
| 9,288,995 B2 | 3/2016 | Von Maltzahn et al. | |
| 9,295,263 B2 | 3/2016 | Von Maltzahn et al. | |
| 9,404,162 B2 | 8/2016 | Boileau et al. | |
| 9,446,080 B2 | 9/2016 | Mckenzie et al. | |
| 9,469,835 B2 | 10/2016 | Bronshtein | |
| 9,532,572 B2 | 1/2017 | Mckenzie et al. | |
| 9,532,573 B2 | 1/2017 | Von Maltzahn et al. | |

(Continued)

FOREIGN PATENT DOCUMENTS

| | | |
|---|---|---|
| AU | 76290/98 A | 1/1999 |
| AU | 753327 B2 | 10/2002 |

(Continued)

OTHER PUBLICATIONS

U.S. Appl. No. 16/355,674 and U.S. Appl. No. 16/655,776 (Year: 2019).*
Rossi-Tamisier et al., International J of Systemic and Evolutionary Microbiology, 2015, 65, 1929-1934 (Year: 2015).*
Beye et al., New Microbe and New Infect 2018; 22: 24-29 (Year: 2018).*
Edgar et al., Bioinformatics 34(14) 2018, 2371-2375 (Year: 2018).*
https://microbewiki.kenyon.edu/index.php/Ruminobacter, 2020 (Year: 2020).*

(Continued)

*Primary Examiner* — Ruth A Davis
(74) *Attorney, Agent, or Firm* — Cooley LLP

(57) ABSTRACT

The disclosure relates to isolated microorganisms—including novel strains of the microorganisms—microbial ensembles, and compositions comprising the same. Furthermore, the disclosure teaches methods of utilizing the described microorganisms, microbial compositions, and compositions comprising the same, in methods for modulating the agricultural production of ruminants. In particular aspects, the disclosure provides methods of increasing feed efficiency, and methods of decreasing acidosis.

11 Claims, 36 Drawing Sheets

Specification includes a Sequence Listing.

(56) References Cited

U.S. PATENT DOCUMENTS

| | | | |
|---|---|---|---|
| 9,533,014 B2 | 1/2017 | Henn et al. | |
| 9,540,676 B1 | 1/2017 | Zengler et al. | |
| 9,562,271 B2 | 2/2017 | Neely | |
| 9,622,485 B2 | 4/2017 | Von Maltzahn et al. | |
| 9,642,881 B2 | 5/2017 | Honda et al. | |
| 9,649,345 B2 | 5/2017 | Honda et al. | |
| 9,700,586 B2 | 7/2017 | Bicalho et al. | |
| 9,901,605 B2 | 2/2018 | Garner et al. | |
| 9,903,002 B2 | 2/2018 | Zeng et al. | |
| 9,909,180 B2 | 3/2018 | Quake et al. | |
| 9,938,558 B2 | 4/2018 | Embree et al. | |
| 9,993,507 B2 | 6/2018 | Embree et al. | |
| 10,293,006 B2 | 5/2019 | Embree et al. | |
| 10,398,154 B2 | 9/2019 | Embree et al. | |
| 10,448,657 B2 | 10/2019 | Embree et al. | |
| 10,448,658 B2 | 10/2019 | Embree et al. | |
| 10,645,952 B2 | 5/2020 | Embree et al. | |
| 10,701,955 B2 | 7/2020 | Embree et al. | |
| 2005/0079244 A1 | 4/2005 | Giffard et al. | |
| 2005/0106554 A1 | 5/2005 | Palecek et al. | |
| 2005/0158699 A1 | 7/2005 | Kadkake et al. | |
| 2005/0239706 A1 | 10/2005 | Backhed et al. | |
| 2006/0127530 A1 | 6/2006 | Axelrod | |
| 2008/0299098 A1 | 12/2008 | Se et al. | |
| 2009/0280098 A1 | 11/2009 | Tabata et al. | |
| 2011/0280840 A1 | 11/2011 | Blaser et al. | |
| 2012/0149584 A1 | 6/2012 | Olle et al. | |
| 2012/0282675 A1 | 11/2012 | Kim et al. | |
| 2013/0330307 A1 | 12/2013 | Millan | |
| 2014/0171339 A1 | 6/2014 | Keku et al. | |
| 2015/0093360 A1 | 4/2015 | Mckenzie et al. | |
| 2015/0213193 A1 | 7/2015 | Apte et al. | |
| 2015/0216817 A1 | 8/2015 | Luhman | |
| 2015/0218614 A1 | 8/2015 | Henderson et al. | |
| 2015/0267163 A1 | 9/2015 | Liao et al. | |
| 2015/0376609 A1 | 12/2015 | Hindson et al. | |
| 2016/0040119 A1 | 2/2016 | Hashman | |
| 2016/0113974 A1 | 4/2016 | Jones et al. | |
| 2016/0143961 A1* | 5/2016 | Berry | A61K 35/741 424/93.3 |
| 2016/0376627 A1 | 12/2016 | Zengler et al. | |
| 2017/0107557 A1 | 4/2017 | Embree et al. | |
| 2017/0196921 A1 | 7/2017 | Embree et al. | |
| 2017/0196922 A1 | 7/2017 | Embree et al. | |
| 2017/0260584 A1 | 9/2017 | Zheng et al. | |
| 2017/0342457 A1 | 11/2017 | Embree et al. | |
| 2018/0030516 A1 | 2/2018 | Nawana et al. | |
| 2018/0044712 A1 | 2/2018 | Embree et al. | |
| 2018/0051310 A1 | 2/2018 | Hallock et al. | |
| 2018/0051327 A1 | 2/2018 | Blainey et al. | |
| 2018/0070825 A1 | 3/2018 | Apte et al. | |
| 2018/0080065 A1 | 3/2018 | Jain | |
| 2018/0223325 A1 | 8/2018 | Embree et al. | |
| 2018/0325966 A1 | 11/2018 | Embree et al. | |
| 2019/0200642 A1 | 7/2019 | Embree et al. | |
| 2019/0281861 A1 | 9/2019 | Embree et al. | |
| 2019/0357571 A1 | 11/2019 | Embree et al. | |
| 2020/0037633 A1 | 2/2020 | Embree et al. | |
| 2020/0305462 A1 | 10/2020 | Embree et al. | |

FOREIGN PATENT DOCUMENTS

| | | |
|---|---|---|
| CN | 101519638 A | 9/2009 |
| CN | 103053860 B | 3/2014 |
| CN | 104814278 A | 8/2015 |
| EP | 0553444 B1 | 3/1998 |
| EP | 0664671 B1 | 9/2002 |
| KR | 1020130127784 B1 | 11/2013 |
| RU | 2 458 527 C1 | 8/2012 |
| WO | WO 1993/025232 A1 | 12/1993 |
| WO | WO 2001/012779 A1 | 2/2001 |
| WO | WO 2006/117019 A1 | 11/2006 |
| WO | WO 2008/076975 A1 | 6/2008 |
| WO | WO 2010/015580 A1 | 2/2010 |
| WO | WO 2010/062909 A1 | 6/2010 |
| WO | WO 2010/111347 A2 | 9/2010 |
| WO | WO 2010/111565 A2 | 9/2010 |
| WO | WO 2010/138522 A2 | 12/2010 |
| WO | WO 2011/075138 A1 | 6/2011 |
| WO | WO 2011/094469 A2 | 8/2011 |
| WO | WO 2012/077038 A1 | 6/2012 |
| WO | WO 2012/122522 A2 | 9/2012 |
| WO | WO 2014/141274 A1 | 9/2014 |
| WO | WO 2015/023461 A2 | 2/2015 |
| WO | WO 2015/068054 A1 | 5/2015 |
| WO | WO 2016/007544 A1 | 1/2016 |
| WO | WO 2016/127956 A1 | 8/2016 |
| WO | WO 2016/153247 A1 | 9/2016 |
| WO | WO 2016/210251 A1 | 12/2016 |
| WO | WO 2017/120495 A1 | 7/2017 |
| WO | WO 2017/131821 A1 | 8/2017 |
| WO | WO 2017/181203 A1 | 10/2017 |
| WO | WO 2018/126026 A1 | 7/2018 |
| WO | WO 2018/126033 A1 | 7/2018 |
| WO | WO 2018/126036 A1 | 7/2018 |
| WO | WO 2018/201049 A1 | 11/2018 |

OTHER PUBLICATIONS

Gbassi et al. "Probiotic Encapsulation Technology: From Microencapsulation to Release into the Gut"; Pharmaceutics 2012, 4, 149-163; doi:10.3390/pharmaceutics4010149 (Year: 2012).*

Abu-Tarboush, et al. "Evaluation of diet containing lactobacilli on performance, fecal coliform, and lactobacilli of young dairy calves." Animal Feed Science and Technology (1996); 57;1-2: 39-49.

Adams, Rachel: Incorporating quantity into microbiome analysis; (https://www.microbe.net/2017 /11/20/incmporaiing-quantiiy-into-microbiome-analysisf/); printed Dec. 13, 2017, 6 pages.

Aikman, P.C., et al. "Rumen pH and fermentation characteristics in dairy cows supplemented with Megasphaera elsdenii NCIMB 41125 in early lactation." Journal of Dairy Science (2011); 94.6: 2840-2849.

Almeida, Elionor RP, et al. "Transgenic expression of two marker genes under the control of an *Arabidopsis* rbcS promoter: Sequences encoding the Rubisco transit peptide increase expression levels." Molecular and General Genetics MGG (1989); 218.1: 78-86.

Anderson, et al., "Rumen bacterial communities can be acclimated faster to high concentrate diets than currently implemented feedlot programs." Journal of Applied Microbiology (2016); 120 (3): 588-599.

Bauman et al., "Nutrigenomics, Rumen-Derived Bioactive Fatty Acids, and the Regulation of Milk Fat Synthesis," Annual Review of Nutrition (2011); 31: 299-319.

Belk, et al., "Tissue-specific activity of pentose cycle oxidative enzymes during feeder lamb development" Journal of Animal Science (1993); 71: 1796-1804.

Bennett et al., "Toward the $1,000 human genome," Pharmacogenomics (2005); 6(4):373-382.

Bentley et al., "Accurate whole genome sequencing using reversible terminator chemistry," Nature (2008); 456: 53-59.

Blondel et al., "Fast unfolding of communities in large networks," Journal of Statistical Mechanics: Theory and Experiment, (2008); P10008.

Borling, "Feed improvement by energy efficient storage using Pichia anomala inoculated ensiled cereal grain," Master thesis 2010:1, Uppsala BioCenter Department of Microbiology Faculty of Natural Resources and Agriculture Sciences Swedish University of Agricultural Sciences, ISSN 1101-8151, 25 pages.

Boyd, J., "Effects of the addition of direct-fed microbials and glycerol to the diet of lactating dairy cows on milk yield and apparent efficiency of yield." Journal of Dairy Science (2011); 94.9: 4616-4622.

Breiman, L., "Random Forests." Machine Learning (2001); 45 (1): 5-32.

Bretonnière, Cedric, et al. "MIC score, a new tool to compare bacterial susceptibility to antibiotics application to the comparison

(56) References Cited

OTHER PUBLICATIONS of susceptibility to different penems of clinical strains of Pseudomonas aeruginosa." The Journal of Antibiotics 6911 (2016): 806-810. Published online Mar. 30, 2016.

Brown, et al., "Adaptation of beef cattle to high-concentrate diets: Performance and ruminal metabolism." Journal of Animal Science (2006); 84 (E. Suppl): E25-E33.

Burgain, et al, "Encapsulation of probiotic living cells: From laboratory scale to industrial applications." Journal of Food Engineering (2011); 104 (4): 467-483.

Cacite, F., and Weimer, P. J. "Ruminal dosing with Megasphaera elsdenii and strain persistence are associated with milk fat depression in Holstein cows." J. Anim. Sci., 1611 (2016); 94, E-Suppl. 5/J. Dairy Sci. vol. 99, E-Suppl. 1, p. 784.

Caporaso et al., "Ultra-high-throughput microbial community analysis on the Illumina HiSeq and MiSeq platforms," The ISME Journal (2012); 6: 1621-1624.

Chambers, et al., "A cross-platform toolkit for mass spectrometry and proteomics." Nat Biotechnol. (2012); 30 (10): 918-920.

Chi et al., "Increase in antioxidant enzyme activity, stress tolerance and biocontrol efficacy of Pichia kudriavzevii with the transition from a yeast-like to biofilm morphology." Biological Control, 90: 113-119 (2015).

Chiquette, J., et al. "Prevotella bryantii 25A used as a probiotic in early-lactation dairy cows: effect on ruminal fermentation characteristics, milk production, and milk composition." Journal of Dairy Science (2008); 91.9: 3536-3543.

Chiquette, J. et al. "Use of Prevotella bryantii 25A and a commercial probiotic during subacute acidosis challenge in midlactation dairy cows." Journal of Dairy Science (2012); 95.10: 5985-5995.

Clarke, K.R., "Non-parametric multivariate analyses of changes in community structure." Australian Journal of Ecology (1993); 18 (1): 117-143.

Clasquin, et al., "LC-MS Data Processing with MAVEN: A Metabolomic Analysis and Visualization Engine." Curr. Protoc. Bioinform. (2012); 37 (1): 14.11.1-14.11.23.

Colby, S. R. "Calculating synergistic and antagonistic responses of herbicide combinations." Weeds (1967); 15(1): 20-22.

Cole et al., "Ribosomal Database Project: data and tools for high throughput rRNA analysis." Nucleic Acids Research (2014); 42 (D1): D633-D642.

Cori, et al., "The role of glucose-1-phosphate in the formation of blood sugar and synthesis of glycogen in the liver." Journal of Biological Chemistry (1939); 129: 629-639.

Coulon, Jean-Baptiste, et al. "Effect of mastitis and related-germ on milk yield and composition during naturally-occurring udder infections in dairy cows." Animal Research (2002); 51.05: 383-393.

Count your blessings: Quantitative microbiome profiling; VIB (The Flanders Institute for Biotechnology); Public Release: Nov. 15, 2017 https://www.eurekalert.org/pub_releases/2017-11/vfi-cyb11417.php); printed Dec. 13, 2017, 1 page.

Crameri, Andreas, et al. "DNA shuffling of a family of genes from diverse species accelerates directed evolution." Nature (1998); 391.6664: 288-291.

Crameri, Andreas, et al. "Molecular evolution of an arsenate detoxification pathway by DNA shuffling." Nature Biotechnology (1997); 15.5: 436-438.

Dannemilier, K.C., et al., "Combining real-lime PCR and next-generation DNA sequencing to provide quantitative comparisons of fungal aerosol populations." Atmospheric Environment (2014); 84: 113-121.

De Menezes, Alexandre B., et al. "Microbiome analysis of dairy cows fed pasture or total mixed ration diets." FEMS Microbiology Ecology (2011); 78.2: 256-265.

Dosogne, Hilde, et al. "Differential leukocyte count method for bovine low somatic cell count milk." Journal of Dairy Science (2003); 86.3: 828-834.

Edgar and Flyvberg, "Error filtering, pair assembly and error correction for next-generation sequencing reads." Bioinformatics (2015); 31 (21): 3476-3482.

Edgar, "SINTAX: a simple non-Bayesian taxonomy classifier for 16S and ITS sequences." BioRxiv (2016); 074161, 20 pages.

Embree, Mallory, et al. "Networks of energetic and metabolic interactions define dynamics in microbial communities." Proceedings of the National Academy of Sciences (2015); 112.50: 15450-15455.

Fadrosh et al., "An improved dual-indexing approach for multiplexed 16S rRNA gene sequencing on the Illumina MiSeq platform," Microbiome (2014); 2:6, 7 pages.

Falkowski et al., "Primary production of the biosphere: integrating terrestrial and oceanic components," Science (1998); 281(5374): 237-240.

Fernando, et al., "Rumen Microbial Population Dynamics during Adaptation to a High-Grain Diet." Applied and Environmental Microbiology (2010); 76 (22): 7482-7490.

Final Office Action in U.S. Appl. No. 15/400,436, dated Dec. 13, 2017.

Final Office Action in U.S. Appl. No. 15/400,484, dated Dec. 13, 2017.

Flores, et al., "Temporal variability is a personalized feature of the human microbiome." Genome Biology (2014); 15: 531, 13 pages.

GenBank Accession No. JF629154 Uncultured bacterium clone GDIC21K01DL4MU 16S ribosomal RNA gene, partial sequence, Aug. 3, 2011 [online]. (Retrieved online Aug. 14, 2018].

Gray, Nathan; A revolution in microbiome analysis? Novel method offers 'true' quantitative analysis of gut bacteria; Nov. 17, 2017; New methods to measure and accurately quantify the levels of gut bacteria in stool samples could be a revolution for researchers and companies looking to link our gut bacteria make up to specific issues of health and disease. (https://www.nutraingredients.com/Article/2017/11/17/A-revolution-inmicrobiome-analysis-Novel-method-offers-true-quantitative-analysis-of-gut-bacteria); printed Dec. 13, 2017.

Gröhn, Y. T., et al. "Effect of Pathogen-Specific Clinical Mastitis on Milk Yield in Dairy Cows." Journal of Dairy Science (2004); 87.10: 3358-3374.

Hammer, et al., "Past: Paleontological Statistics Software Package for Education and Data Analysis." Palaeontologia Electronica (2001); 4 (1): 1-9.

Higginbotham, G. E., and Bath, D. L. "Evaluation of Lactobacillus Fermentation Cultures in Calf Feeding Systems." Journal of Dairy Science (1993); 76.2: 615-620.

Huhtanen, Pekka, et al. "Effect of increasing ruminal butyrate on milk yield and blood constituents in dairy cows fed a grass silage-based diet." Journal of Dairy Science (1993); 76.4: 1114-1124.

Human Microbiome Project Consortium. "Structure, function and diversity of the healthy human microbiome." Nature (2012); 486(7402): 207-214.

Hungate, "The Rumen Microbial Ecosystem." Annual Review of Ecology and Systematics (1975); 6: 39-66.

Ingolia et al., "Genome-wide analysis in vivo of translation with nucleotide resolution using ribosome profiling," Science (2009); 324(5924): 218-223.

Ingolia, N.T., "Ribosome profiling: new views of translation, from single codons to genome scale," Nat Rev Genet. (2014); 15(3): 205-213.

International Patent Application No. PCT/US2016/039221, International Preliminary Report on Patentability dated Dec. 26, 2017, 11 pages.

International Patent Application No. PCT/US2016/039221, International Search Report and Written Opinion dated Sep. 23, 2016, 14 pages.

International Search Report and Written Opinion, dated Jun. 7, 2017, for PCT International Application No. PCT/US2017/012573, 18 pages.

International Search Report and Written Opinion, dated Sep. 6, 2018, for PCT International Application No. PCT/US2018/029953, 17 pages.

International Search Report for PCT/US2017/028015, dated Sep. 5, 2017.

(56) References Cited

OTHER PUBLICATIONS

Jewell et al., "Ruminal Bacterial Community Composition in Dairy Cows is Dynamic over the Course of Two Lactations and Correlates with Feed Efficiency," Applied and Environmental Microbiology (2015); 81(14): 4697-4710.

Jones, Jonathan D.G., et al. "High level expression of introduced chimaeric genes in regenerated transformed plants." The EMBO Journal (1985); 4.10 : 2411-2418.

Kamphorst, et al., "Liquid Chromatography—High Resolution Mass Spectrometry Analysis of Fatty Acid Metabolism." Anal. Chem. (2011); 83 (23): 9114-9122.

Kim, Y. J., et al. "The enrichment of a ruminal bacterium (*Megasphaera elsdenii* YJ-4) that produces the trans-10, cis-12 isomer of conjugated linoleic acid." Journal of Applied Microbiology (2002); 92.5: 976-982.

Koch, et al., "Efficiency of Feed Use in Beef Cattle." Journal of Animal Science (1963); 22: 486-494.

Kõljalg, Urmas, et al. "UNITE: a database providing web-based methods for the molecular identification of ectomycorrhizal fungi." New Phytologist (2005); 166.3: 1063-1068.

Krysl and Hess, "Influence of supplementation on behavior of grazing cattle." Journal of Animal Science (1993); 71 (9): 2546-2555.

Laliotis, et al., "Cloning, characterization and computational analysis of the 5' regulatory region of ovine glucose 6-phosphate dehydrogenase gene." Comparative Biochemistry and Physiology, Part B (2007); 147 (4): 627-634.

Lan, Yemin, et al. "Using the RDP classifier to predict taxonomic novelty and reduce the search space for finding novel organisms." PLoS One (2012); 7.3: e32491, 15 pages.

Lane, et al., "16S/23S rRNA Sequencing," Nucleic Acid Techniques in Bacterial Systematics, Chapter 6, pp. 115-175, 1991.

Lange et al., "Cost-efficient high-throughput HLA typing by MiSeq amplicon sequencing," BMC Genomics (2014); 15:63, 11 pages.

Laporte-Uribe J.A. "The role of dissolved carbon dioxide in both the decline in rumen pH and nutritional diseases in ruminants." Animal Feed Science and Technology (2016); 219: 268-279.

Lee et al., "Nonradioactive Method to Study Genetic Profiles of Natural Bacterial Communities by PCR-Single-Strand-Conformation Polymorphism," Applied and Environmental Microbiology (1996); 62 (9): 3112-3120.

Lee, K., et al. "Antiobesity effect of trans-10, cis-12-conjugated linoleic acid-producing Lactobacillus plantarum PL62 on diet-induced obese mice." Journal of Applied Microbiology (2007); 103.4: 1140-1146.

Li et al., "Quantifying absolute protein synthesis rates reveals principles underlying allocation of cellular resources," Cell (2014);157 (3): 624-635.

Li, M., et al. Uncultured Bacterium Clone SJTU_A3_11_21 16S Ribosomal RNA Gene, Partial Sequence. GenBank Accession No. EF403757.1. Submitted Jan. 26, 2007; downloaded from internet <https://www.ncbi.nlm.nih.gov/nucleotide/126114074?report=genbank&log$=nuclalign&blast_rank=1&RID=G57ADV19015> on Apr. 27, 2017, 1 page.

Lowe, Susan E., et al. "Growth of anaerobic rumen fungi on defined and semi-defined media lacking rumen fluid." Journal of General Microbiology (1985); 131.9: 2225-2229.

Lu, et al., "Metabolomic Analysis via Reversed-Phase Ion-Pairing Liquid Chromatography Coupled to a Stand Alone Orbitrap Mass Spectrometer." Analytical Chemistry (2010); 82 (8): 3212-3221.

Mardis, Elaine R., "Next Generation DNA Sequencing Methods," Annu. Rev. Genomics Hum. Genet. (2008); 9: 387-402.

Margulies et al., "Genome sequencing in microfabricated high-density picolitre reactors," Nature (2005); 437: 376-380.

Massol-Deya, A.A. et al., "Bacterial community fingerprinting of amplified 16S and 16-23S ribosomal DNA gene sequences and restriction endonuclease analysis (ARDRA)." Molecular Microbial Ecology Manual, vol. 3.3.2. Kluwer Academic Publishers, Dordrecht, pp. 1-8.

McGilliard, M. L., and Stallings, C.C. "Increase in milk yield of commercial dairy herds fed a microbial and enzyme supplement." Journal of Dairy Science (1998); 81.5: 1353-1357.

Mitra et al., "Analysis of the intestinal microbiota using SOLiD 16S rRNA gene sequencing and SOLiD shotgun sequencing," BMC Genomics (2013); 14(Suppl 5):S16, 11 pages.

Mohammed, R., et al. "Changes in ruminal bacterial community composition following feeding of alfalfa ensiled with a lactic acid bacterial inoculant." Journal of Dairy Science (2012); 95.1: 328-339.

Moore, Jeffrey C., et al. "Strategies for the in vitro evolution of protein function: enzyme evolution by random recombination of improved sequences." Journal of Molecular Biology (1997); 272.3: 336-347.

Morgante, et al., "Blood gas analyses, ruminal and blood pH, urine and faecal pH in dairy cows during subacute ruminal acidosis." Comparative Clinical Pathology (2009); 18 (3): 229-232.

Musselman, et al., "CoA protects against the deleterious effects of caloric overload in *Drosophila*." Journal of Lipid Research (2016); 57: 380-387.

Muyzer, et al., "Profiling of complex microbial populations by denaturing gradient gel electrophoresis analysis of polymerase chain reaction-amplified genes coding for 16S rRNA." Applied and Environmental Microbiology (1993); 59 (3): 695-700.

Myer, et al., "Rumen Microbiome from Steers Differing in Feed Efficiency." PLOS ONE (2015); 10 (6): e0129174, 17 pages.

Non-Final Office Action in U.S. Appl. No. 15/349,829 dated May 4, 2018.

Non-Final Office Action in U.S. Appl. No. 15/392,913 dated Oct. 16, 2018.

Non-Final Office Action in U.S. Appl. No. 15/948,965 dated Jun. 26, 2018.

Non-Final Office Action in U.S. Appl. No. 15/217,575, dated Oct. 12, 2016.

Non-Final Office Action in U.S. Appl. No. 15/400,436, dated Aug. 31, 2018.

Non-Final Office Action in U.S. Appl. No. 15/400,436, dated Mar. 30, 2017.

Non-Final Office Action in U.S. Appl. No. 15/400,436, dated May 18, 2017.

Non-Final Office Action in U.S. Appl. No. 15/400,484, dated Apr. 4, 2017.

Non-Final Office Action in U.S. Appl. No. 15/400,484, dated May 30, 2017.

Notice of Allowance in U.S. Appl. No. 15/392,913 dated Apr. 19, 2018.

Notice of Allowance in U.S. Appl. No. 15/400,484, dated Apr. 27, 2018.

Notice of Allowance in U.S. Appl. No. 15/400,484, dated Apr. 2, 2018.

Notice of Allowance in U.S. Appl. No. 15/400,484, dated Feb. 13, 2018.

Notice of Allowance in U.S. Appl. No. 15/400,484, dated Jan. 16, 2018.

Notice of Allowance in U.S. Appl. No. 15/400,484, dated Jan. 25, 2018.

Notice of Allowance in U.S. Appl. No. 15/217,575, dated Nov. 8, 2016.

Okine and Mathison, "Effects of feed intake on particle distribution, passage of digesta, and extent of digestion in the gastrointestinal tract of cattle." Journal of Animal Science (1991); 69 (8): 3435-3445.

Palmonari et al., "pH dynamics and bacterial community composition in the rumen of lactating dairy cows," J. Dairy Sci. (2010); 93(1): 279-287.

Peckham et al., "SOLiD™ Sequencing and 2-Base Encoding," San Diego, CA: American Society of Human Genetics, Poster No. 2624 (2007), 1 page.

Petri, Renee M., et al. "Characterization of the core rumen microbiome in cattle during transition from forage to concentrate as well as during and after an acidotic challenge." PLoS One (2013); 8.12: e83424, 15 pages.

(56) References Cited

OTHER PUBLICATIONS

Pool-Zobel et al., "Overview of Experimental Data on Reduction of Colorectal Cancer Risk by Inulin-Type Fructans," J. Nutr. (2007); 137: 2580S-2584S.
Qiu, Yu, et al. "Characterizing the interplay between multiple levels of organization within bacterial sigma factor regulatory networks." Nature Communications (2013); 4: 1755 (pp. 1-10).
Raeth-Knight, M. L., et al. "Effect of direct-fed microbials on performance, diet digestibility, and rumen characteristics of Holstein dairy cows." Journal of Dairy Science (2007); 90.4: 1802-1809.
Ragaller, et al., "Pantothenic acid in ruminant nutrition: a review." Journal of Animal Physiology and Animal Nutrition (2011); 95 (1): 6-16.
Ramirez-Farias et al., "Effect of inulin on the human gut microbiota: stimulation of *Bifidobacterium adolescentis* and *Faecalibacterium prausnitzii*," Br J Nutr (2009); 101(4): 541-550.
Ranjard et al., "Sampling strategy in molecular microbial ecology: influence of soil sample size on DNA fingerprinting analysis of fungal and bacterial communities," Environmental Microbiology 5(11); 1111-1120 (2003).
Restriction / Election Requirement in U.S. Appl. No. 16/029,398 dated Sep. 18, 2018.
Rigobelo et al., "Protective Effect of Probiotics Strains in Ruminants," Submitted: Jan. 26, 2012 Reviewed: May 22, 2012 Published: Oct. 3, 2012, published by INTEC Open source, downloaded from: https://www.intechopen.com/books/ probiotic-in-animals/ protective-effect-of-probiotics-strains-in-ruminants.
Rook, J. A. F., and Balch, C.C. "The effects of intraruminal infusions of acetic, propionic and butyric acids on the yield and composition of the milk of the cow." British Journal of Nutrition (1961); 15.03: 361-369.
Ross, et al., "High throughput whole rumen metagenome profiling using untargeted massively parallel sequencing." BMC Genetics (2012); 13:53, 14 pages.
San Miguel et al., "Effects of organochlorines on microbial diversity and community structure in *Phragmites australis* rhizosphere," Appl Microbiol Biotechnol (2014); 98(9): 4257-4266.
Sandri et al., "Microbial biodiversity of the liquid fraction of rumen content from lactating cows," Animal (2014); 8(4): 572-579.
Sanger et al., "DNA sequencing with chain-terminating inhibitors," Proc Natl. Acad. Sci. USA (1977); 74(12): 5463-5467.
Scheinert et al., "Molecular differentiation of bacteria by PCR amplification of the 16-23S rRNA spacer," J Microbiol Meth (1996); 26: 103-117.
Schloss, Patrick D., et al. "Assessing and improving methods used in operational taxonomic unit-based approaches for 16S rRNA gene sequence analysis." Applied and Environmental Microbiology (2011); 77.10: 3219-3226.
Schogor, Ana L.B., et al. "*Ruminal Prevotella* spp. may play an important role in the conversion of plant lignans into human health beneficial antioxidants." PLoS One (2014); 9.4: e87949. 10 pages.
Schwieger et al., "A New Approach to Utilize PCR-Single-Strand-Conformation Polymorphism for the 16S rRNA Gene-Based Microbial Community Analysis," Applied and Environmental Microbiology (1998); 64(12): 4870-4876.
Segata et al., "Computational meta'omics for microbial community studies," Molecular Systems Biology 9:666 (2013), 15 pages.
Segata, Nicola, et al. "Metagenomic biomarker discovery and explanation." Genome Biology (2011); 12:R60, 18 pages.
Seymour, et al., "Relationships between rumen volatile fatty acid concentrations and milk production in dairy cows: a literature study." Animal Feed Science and Technology (2005); 119 (Issues 1-2): 155-169.
Shabat, et al., "Specific microbiome-dependent mechanisms underlie the energy harvest efficiency of ruminants." The ISME Journal (2016); 10 (12): 2958-2972.
Shanks, Orin C., et al. "Community structures of fecal bacteria in cattle from different animal feeding operations." Applied and Environmental Microbiology (2011); 77.9; 2992-3001.
Shi et al., "Regression analysis for microbiome compositional data." The Annals of Applied Statistics (2016); 10 (2): 1019-1040.
Shi, et al., Integrated metatranscriptomic and metagenomics analyses of stratified microbial assemblages in the open ocean, The ISME Journal (2011) 5, 999-1013.
Sirisan, V., et al. "Isolation, identification and growth determination of lactic acid-utilizing yeasts from the ruminal fluid of dairy cattle." Letters in Applied Microbiology (2013); 57.2: 102-107.
Smith, et al., "The effect of pantothenate deficiency in mice on their metabolic response to fast and exercise." Metabolism (1987); 36 (2): 115-121.
Song, et al., "Comparison of co-expression measures: mutual information, correlation, and model based indices." BMC Bioinformatics (2012); 13: 328, pp. 1-21.
Stemmer, Willem P. "DNA shuffling by random fragmentation and reassembly: in vitro recombination for molecular evolution." Proceedings of the National Academy of Sciences (1994); 91.22: 10747-10751.
Stemmer, Willem PC. "Rapid evolution of a protein in vitro by DNA shuffling." Nature (1994); 370.6488: 389-391.
Tajima, et al., "Diet-Dependent Shifts in the Bacterial Population of the Rumen Revealed with Real-Time PCR." Appl. Environ. Microbiol. (2001); 67 (6): 2766-2774.
Tao, N., et al. "Variations in bovine milk oligosaccharides during early and middle lactation stages analyzed by high-performance liquid chromatography-chip/mass spectrometry." Journal of Dairy Science (2009); 92.7: 2991-3001.
Tashiro, Yukihiro, et al. "High butanol production by Clostridium saccharoperbutylacetonicum N1-4 in fed-batch culture with pH-stat continuous butyric acid and glucose feeding method." Journal of Bioscience and Bioengineering (2004); 98.4: 263-268.
Van Houtert, M. F. J. "The production and metabolism of volatile fatty acids by ruminants fed roughages: A review." Animal Feed Science and Technology (1993); 43(3): 189-225.
Vandamme, Peter, et al. "Polyphasic taxonomy, a consensus approach to bacterial systematics." Microbiological Reviews (1996); 60.2: 407-438.
Vandeputte, D, et al., "Quantitative microbiome profiling links gut community variation to microbial load." Nature (2017); 551 (7681): 507.
Vineetha, P. G., et al. "Screening of Lactobacillus isolates from gastrointestinal tract of guinea fowl for probiotic qualities using in vitro tests to select species-specific probiotic candidates." British poultry science 57.4 (2016): 474-482.
Wagg et al. "Soil biodiversity and soil community composition determine ecosystem multifunctionality." Proceedings of the National Academy of Sciences (2014); 111(14): 5266-5270.
Whittaker, "Evolution and Measurement of Species Diversity." Taxon (May 1972), 21 (2/3): 213- 251.
Written Opinion for PCT/US2017/028015, dated Sep. 5, 2017.
Yarza, Pablo, et al. "Uniting the classification of cultured and uncultured bacteria and archaea using 16S rRNA gene sequences." Nature Reviews Microbiology (2014); 12.9: 635-645.
Zebeli, Qendrim, et al. "Intraruminal administration of Megasphaera elsdenii modulated rumen fermentation profile in mid-lactation dairy cows." Journal of Dairy Research (2012); 79.01; 16-25.
Zhang, Ji-Hu, et al. "Directed evolution of a fucosidase from a galactosidase by DNA shuffling and screening." Proceedings of the National Academy of Sciences USA (1997); 94.9: 4504-4509.
Zhou et al. "High-Throughput Metagenomic Technologies for Complex Microbial Community Analysis: Open and Closed formats." MBio (2015); 6(1): e02288-14, 17 pages.
Bremges et al., "Deeply sequenced metagenome and metatranscriptome of a biogas-producing microbial community from an agricultural production-scale biogas plant," GigaScience (2015) 4:33, 6 pages.
International Search Report and Written Opinion, dated Feb. 28, 2018, for PCT International Application No. PCT/US2018/068753, 11 pages.
International Search Report and Written Opinion, dated Feb. 28, 2018, for PCT International Application No. PCT/US2018/068758, 9 pages.

(56) References Cited

OTHER PUBLICATIONS

International Search Report and Written Opinion, dated Mar. 22, 2018, for PCT International Application No. PCT/US2017/068740, 16 pages.
Maurice et al., "Xenobiotics Shape the Physiology and Gene Expression of the Active Human Guy Microbiome," Cell, 152, Jan. 17, 2013, pp. 39-50.
Petrenko et al., "MetAnnotate: function-specific taxonomic profiling and comparison of metagenomes," BMC Biology (2015) 13:92, 8 pages.
De Almeida et al., "Aerobic fungi in the rumen fluid from dairy cattle fed different sources of forage," R. Bras. Zootec., 2012, vol. 41, No. 11, pp. 2336-2342.
Extended European Search Report for European Application No. 17736448.6 dated Aug. 21, 2019.
GenBank Accession No. EU556330 "Issatchenkia orientalis 18S ribosomal RNA gene, partial sequence; internal transcribed spacer 1, complete sequence; and 5.8S ribosomal Rna gene, partial sequence" Apr. 5, 2008, 1 page.
GenBank Accession No. EU663567 "Issatchenkia orientalis 5.8S ribosomal RNA gene, partial sequence; internal transcribed spacer 2, complete sequence; and 28S ribosomal RNA gene, partial sequence" May 17, 2008, 1 page.
Lund, A., "Yeasts and Moulds in the Bovine Rumen," Journal of General Microbiology (1974), 81, 453-462.
Stewart, R. et al., "Compendium of 4,941 rumen metagenome-assembled genomes for rumen microbiome biology and enzyme discovery," Nature Biotechnology, Aug. 2019, vol. 37, pp. 953-961.
Final Office Action in U.S. Appl. No. 15/400,436, dated Jan. 28, 2019.
Final Office Action in U.S. Appl. No. 16/029,398, dated Jun. 26, 2019.
Non-Final Office Action in U.S. Appl. No. 16/029,398 dated Feb. 26, 2019.
Non-Final Office Action in U.S. Appl. No. 16/206,098 dated Aug. 8, 2019.
Non-Final Office Action in U.S. Appl. No. 16/207,811 dated Jul. 29, 2019.
Restriction / Election Requirement in U.S. Appl. No. 16/207,811 dated Feb. 12, 2019.
Kozawa, M., "Probiotics for animal use in Japan," Rev. sci. tech. Off. int. Epiz., 1989, 8(2), 517-531.
Muck, R., "Recent advances in silage microbiology," Agricultural and Food Science (2013) 22:3-15.
Non-Final Office Action in U.S. Appl. No. 16/534,481, dated Sep. 23, 2019.
Jin, G. L. et al., "Effect of Microbial Additives on Metabolic Characteristics in Sheep and Milking Performance of Lactating Dairy Cows," J. Anim. Sci. & Technol. (Kor.), 2007, 49(6):819-828. (with English abstract).
Non-Final Office Action in U.S. Appl. No. 16/655,776 dated Jan. 15, 2020.
Santos and Thompson, "The Family Succinivibrionaceae," The Prokaryotes—Gammaproteobacteria (Eds. E. Rosenberg et al.), 2014, Springer-Verlag Berlin Heidelberg, pp. 639-648.
DDBJ BLAST search results; using blastn program with default parameters; query SEQ ID No. 28 from U.S. Appl. No. 16/655,776 specification; limited to bct database; conducted on Feb. 19, 2020, 831 pages.
Doto and Liu, "Effects of direct-fed microbials and their combinations with yeast culture on in vitro rumen fermentation characteristics," Journal of Animal and Feed Sciences, 2011, 20, 259-271.
NCBI BLAST Nucleotide Sequence search results; using blastn program with default parameters; query SEQ ID No. 28 from U.S. Appl. No. 16/655,776 specification; limited to Clostridium butyricum (taxid:1492); conducted on Feb. 19, 2020, 45 pages.
Non-Final Office Action in U.S. Appl. No. 16/871,290 dated Jun. 18, 2020.
Japanese Office Action for Japanese Application No. 2018-535389 dated Oct. 7, 2020, 15 pages (with English translation).
Nissan Gosei Kogyo Co., Ltd., "Bovine Probiotics and Prebiotics," Nissan News, Mar. 2011, Issue 73, pp. 1-2, retrieved from http://www.nissangosei.co.jp/nissan/073.pdf (with English translation).
Hippe et al., "Phylogenetic analysis of Formivibrio citricus, Propionivibrio dicarboxylicus, Anaerobiospirillum thomasii, Succinimonas amylolytica and Succinivibrio dextrinosolvens and proposal of Succinivibrionaceae fam. nov.," International Journal of Systematic Bacteriology (1999), 49, 779782.
Partial Supplementary European Search Report for European Application No. 18792045.9 dated Mar. 30, 2021, 15 pages.

* cited by examiner

FIG. 6

Ruminal VFA concentrations and pH of Black Angus steers between high- and low-RFI$_1$ at week 10

| VFA (mM) | High-RFI | Low-RFI | SEM | P-value2 |
|---|---|---|---|---|
| Acetate | 16.90 | 19.27 | 1.032 | 0.257 |
| Propionate | 2.10 | 2.23 | 0.149 | 0.667 |
| Butyrate | 6.99 | 7.63 | 0.010 | 0.525 |
| Isobutyrate | 0.09 | 0.13 | 0.492 | 0.038 |
| Valerate3 | 0.41 | 0.97 | 0.164 | 0.093 |
| Acetate:propionate | 7.86 | 8.62 | 0.868 | 0.109 |
| pH | 6.93 | 6.97 | 0.392 | 0.732 |

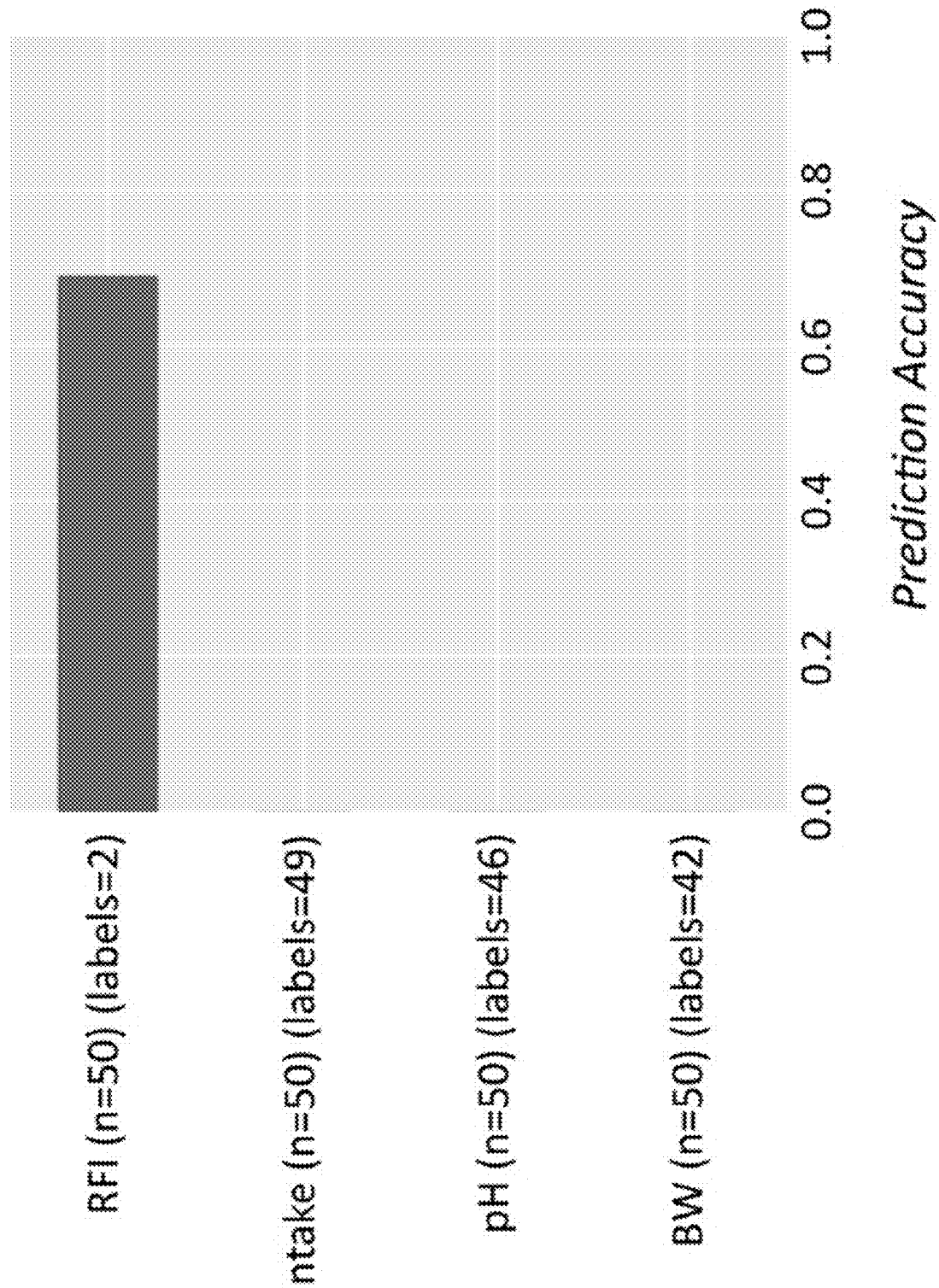

METHODS FOR SUPPORTING GRAIN INTENSIVE AND OR ENERGY INTENSIVE DIETS IN RUMINANTS BY ADMINISTRATION OF A SYNTHETIC BIOENSEMBLE OF MICROBES OR PURIFIED STRAINS THEREFOR

CROSS-REFERENCE TO RELATED APPLICATIONS

This application claims the benefit of priority to U.S. Provisional Application No. 62/491,845, filed Apr. 28, 2017; and U.S. Provisional Application No. 62/578,188, filed Oct. 27, 2017; each of which is herein incorporated by reference in its entirety.

FIELD

The present disclosure relates to isolated and biologically pure microorganisms that have applications, inter alia, in the farming of beef cattle. The disclosed microorganisms can be utilized in their isolated and biologically pure states, as well as being formulated into compositions. Furthermore, the disclosure provides a microbial ensemble, containing at least two members of the disclosed microorganisms, as well as methods of utilizing said microbial ensemble. Furthermore, the disclosure provides for methods of modulating the rumen microbiome.

STATEMENT REGARDING SEQUENCE LISTING

The sequence listing associated with this application is provided in text format in lieu of a paper copy, and is hereby incorporated by reference into the specification. The name of the text file containing the sequence listing is ASBI_005_02US_ST25.txt. The text file is 4,544 kb, was created on Apr. 27, 2018, and is being submitted electronically via EFS-Web.

BACKGROUND

The global population is predicted to increase to over 9 billion people by the year 2050 with a concurrent reduction in the quantity of land, water, and other natural resources available per capita. Projections indicate that the average domestic income will also increase, with the projected rise in the GDP of China and India. The desire for a diet richer in animal-source proteins rises in tandem with increasing income, thus the global livestock sector will be charged with the challenge of producing more animal products using fewer resources. The Food and Agriculture Organization of the United Nations predict that 70% more food will have to be produced, yet the area of arable land available will decrease. It is clear that the food output per unit of resource input will have to increase considerably in order to support the rise in population.

Over recent decades the farm industry has seen fast growth in the meat sector. As more of the world's population ascends into the middle class demand for protein—including beef—is expected to remain robust for years to come. Worldwide beef production tops 59 million tons per annum.

Beef and products thereof are predominantly utilized in the preparation of foodstuffs in many different forms. There have been many strategies to improve beef production through nutritional modulations, hormone treatments, changes in animal management, and selective breeding; however, the need for more efficient production of edible beef foodstuffs per animal is required. Current animal feeding and handling practices, for example, often induce microbial dysbiosis in the rumen that ultimately leads to incidences of sub-acute acidosis or bloat, hindering the efficiency of production, increasing feed costs, and/or increasing a reliance on chemistry based treatments, such as antibiotics.

Identifying compositions and methods for sustainably increasing beef production while balancing animal health and wellbeing have become imperative to satisfy the needs of everyday humans in an expanding population. Increasing the worldwide production of beef by scaling up the total number of beef cattle on farms would not only be economically infeasible for many parts of the world, but would further result in negative environmental consequences as the beef sector's growth and trends towards intensification and concentration have already given rise to a number of environmental concerns, led predominantly by the production of far more waste than can be managed by land disposal.

Population densities of beef cattle, particularly feedlot cattle, on large farms are often accompanied by an increased incidence of microbial pathogens that place the beef yield at risk, and further place the ultimate consumer of the beef at risk in instances of zoonotic pathogens and/or the blooming of organisms in the rumen that lead to incidences of subacute acidosis (ruminal subacute acidosis) or bloat, which further hinders the productivity of feedlot operations. Considering the widespread occurrence of many zoonotic pathogens, it is unlikely that beef can be completely protected from exposure. Research has focused on investigative means of increasing resistance to colonization in beef cattle exposed to these pathogens.

Thus, meeting global beef yield expectations, by simply scaling up current high-input agricultural systems—utilized in most of the developed world—is simply not feasible.

There is therefore an urgent need in the art for improved methods of increasing beef production, while also mitigating the colonization and spread of microbial pathogens and further increasing the desirable aspects of beef.

SUMMARY OF THE DISCLOSURE

In some aspects, the present disclosure provides isolated microbes, including novel strains of microbes, presented in Table 1 and/or Table 2.

In other aspects, the present disclosure provides isolated whole microbial cultures of the microbes identified in Table 1 and Table 2. These cultures may comprise microbes at various concentrations.

In some aspects, the disclosure provides for utilizing one or more microbes selected from Table 1 and/or Table 2 to increase a phenotypic trait of interest in beef cattle.

In some embodiments, a microbial composition comprises at least two microbial strains selected from Table 1 and/or Table 2. In another embodiment, a microbial composition is provided, said composition comprising at least one microbial strain selected from Table 1 and/or Table 2. In a further embodiment, a microbial composition comprises at least two microbial strains, wherein the at least two microbial strains comprise a 16S rRNA sequence encoded by sequences selected from SEQ ID NOs:1-5993

In some embodiments, the disclosure is drawn to a ruminant supplement capable of treating or preventing acidosis or bloat in a ruminant, comprising: a) a purified population of bacteria selected from any one or more bacteria comprising a 16S nucleic acid sequence that is at least about 97% identical to any one of SEQ ID NO:1-5993: and b) a carrier suitable for ruminant administration; wherein the purified population of bacteria of a) is present in the supplement in an amount effective to treat or prevent acidosis or bloat in a ruminant administered the supplement, as compared to a ruminant not administered the supplement.

In some embodiments, the ruminant supplement capable of treating or preventing acidosis or bloat in a ruminant, comprising: a) a purified population of bacteria selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13; and b) a carrier suitable for ruminant administration; wherein the purified population of bacteria of a) is present in the supplement in an
amount effective to treat or prevent acidosis or bloat in a ruminant administered the supplement, as compared to a ruminant not administered the supplement.

On some embodiments, the at least one of the bacteria are selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13

In one embodiment the purified population of bacteria is selected from: (i) *Succinivibrio* bacteria with a 16S nucleic acid sequence that is at least about 99% identical to SEQ ID NO:75, (ii) *Prevotella* bacteria with a 16S nucleic acid sequence that is at least about 99% identical to SEQ ID NO:86, and/or (iii) *Bacteroides* bacteria with a 16S nucleic acid sequence that is at least about 99% identical to SEQ ID NO:13.

In one embodiment, purified population of bacteria is selected from: (i) *Succinivibrio* bacteria with a 16S nucleic acid sequence comprising SEQ ID NO:75, (ii) *Prevotella* bacteria with a 16S nucleic acid sequence comprising SEQ ID NO:86, and/or (iii) *Bacteroides* bacteria with a 16S nucleic acid sequence comprising SEQ ID NO:13.

In one embodiment, the purified population of bacteria is selected from: (i) *Succinivibrio* bacteria deposited as B-67550. (ii) *Prevotella* bacteria deposited as B-67552, and/or (iii) *Bacteroides* bacteria deposited as B-67555.

In one embodiment the purified population of bacteria comprises bacteria with a 16S nucleic acid sequence that is at least about 97% identical to a nucleic acid sequence selected from the group consisting of SEQ ID NO:1-5993.

In one embodiment, the ruminant supplement further comprising a purified population of bacteria that comprises bacteria with a 16S nucleic acid sequence that is at least about 99% identical to a nucleic acid sequence selected from the group consisting of SEQ ID NO:1-5993.

In one embodiment, the ruminant supplement further comprising a purified population of bacteria that comprises bacteria with a 16S nucleic acid sequence comprising a nucleic acid sequence selected from the group consisting of SEQ ID NO:1-5993.

In one embodiment the purified population of bacteria are encapsulated in one or more of a polymer, carbohydrate, sugar, plastic, glass, polysaccharide, lipid, wax, oil, fatty acid, or glyceride.

In one embodiment, the encapsulated bacteria are vitrified. In one embodiment, the encapsulated bacteria are further encapsulated in a wax. In one embodiment, the purified population of bacteria are in the form of spores. In one embodiment, the spores are spray dried. In one embodiment, the ruminant supplement is formulated as a tablet, capsule, pill, feed additive, food ingredient, food additive, food preparation, food supplement, consumable solution, consumable spray additive, consumable solid, consumable gel, injection, bolus, or combinations thereof.

In some embodiments, the disclosure is drawn to a method for treating or preventing acidosis or bloat in a ruminant, comprising: administering to a ruminant an effective amount of a ruminant supplement comprising: a) a purified population of bacteria selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13; and b) a carrier suitable for ruminant administration; wherein the purified population of bacteria of a) is present in the supplement in an amount effective to treat or prevent acidosis or bloat in a ruminant administered the supplement, as compared to a ruminant not administered the supplement.

In some embodiments, at least one of the bacteria are selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13.

In some embodiments, the purified population of bacteria is selected from: (i) *Succinivibrio* bacteria with a 16S nucleic acid sequence that is at least about 99% identical to SEQ ID NO:75, (ii) *Prevotella* bacteria with a 16S nucleic acid sequence that is at least about 99% identical to SEQ ID NO:86, and/or (iii) *Bacteroides* bacteria with a 16S nucleic acid sequence that is at least about 99% identical to SEQ ID NO:13.

In some embodiments, the purified population of bacteria is selected from: (i) *Succinivibrio* bacteria with a 16S nucleic acid sequence comprising SEQ ID NO:75, (ii) *Prevotella* bacteria with a 16S nucleic acid sequence comprising SEQ ID NO:86, and/or (iii) *Bacteroides* bacteria with a 16S nucleic acid sequence comprising SEQ ID NO:13.

In some embodiments, the purified population of bacteria is selected from: (i) *Succinivibrio* bacteria deposited as B-67550. (ii) *Prevotella* bacteria deposited as B-67552, and/or (iii) *Bacteroides* bacteria deposited as B-67555.

In some embodiments, the ruminant supplement further comprises a purified population of bacteria that comprises bacteria with a 16S nucleic acid sequence that is at least about 97% identical to a nucleic acid sequence selected from the group consisting of SEQ ID NO:1-5993.

In some embodiments, the ruminant supplement further comprises a purified population of bacteria that comprises bacteria with a 16S nucleic acid sequence that is at least about 99% identical to a nucleic acid sequence selected from the group consisting of SEQ ID NO:1-5993.

In some embodiments, the ruminant supplement further comprises a purified population of bacteria that comprises bacteria with a 16S nucleic acid sequence comprising a nucleic acid sequence selected from the group consisting of SEQ ID NO:1-5993.

In some embodiments, the purified population of bacteria are encapsulated in one or more of a polymer, carbohydrate, sugar, sugar alcohol, surfactant, plastic, glass, polysaccharide, lipid, wax, oil, fatty acid, amino acid, or glyceride.

In one embodiment, the encapsulated bacteria are vitrified. In one embodiment, the encapsulated bacteria are further encapsulated in a wax, fat, fatty acid, fatty alcohol, or glyceride. In one embodiment, the purified population of bacteria are in the form of spores. In one embodiment, the spores are spray dried. In one embodiment, the supplement is formulated as a tablet, capsule, pill, feed additive, food ingredient, food additive, food preparation, food supplement, consumable solution, consumable spray additive, consumable solid, consumable gel, injection, bolus, or combinations thereof.

In one embodiment, the ruminant is administered to a ruminant orally. In one embodiment, the ruminant is a cow or a steer. In one embodiment, the ruminant is fed a step-up diet. In one embodiment, the ruminant is fed a finishing diet.

The ruminant supplement of claim 36, wherein the purified population of bacteria is selected from: (i) *Succinivibrio* bacteria with a 16S nucleic acid sequence that is at least about 99% identical to SEQ ID NO:75, (ii) *Prevotella* bacteria with a 16S nucleic acid sequence that is at least about 99% identical to SEQ ID NO:86, and/or (iii) *Bacteroides* bacteria with a 16S nucleic acid sequence that is at least about 99% identical to SEQ ID NO:13.

In some embodiments, the purified population of bacteria is selected from: (i) *Succinivibrio* bacteria with a 16S nucleic acid sequence comprising SEQ ID NO:75, (ii) *Prevotella* bacteria with a 16S nucleic acid sequence comprising SEQ ID NO:86, and/or (iii) *Bacteroides* bacteria with a 16S nucleic acid sequence comprising SEQ ID NO:13.

In some embodiments, the purified population of bacteria is selected from (i) *Succinivibrio* bacteria deposited as B-67550, (ii) *Prevotella* bacteria deposited as B-67552, and/or (iii) *Bacteroides* bacteria deposited as B-67555.

In some embodiments, the ruminant supplement further comprises a purified population of bacteria that comprises bacteria with a 16S nucleic acid sequence that is at least about 97% identical to a nucleic acid sequence selected from the group consisting of SEQ ID NO:1-5993.

In some embodiments, the ruminant supplement further comprises a purified population of bacteria that comprises bacteria with a 16S nucleic acid sequence that is at least about 99% identical to a nucleic acid sequence selected from the group consisting of SEQ ID NO:1-5993.

In some embodiments, the ruminant supplement further comprises a purified population of bacteria that comprises bacteria with a 16S nucleic acid sequence comprising a nucleic acid sequence selected from the group consisting of SEQ ID NO:1-5993.

In some embodiments, the purified population of bacteria are encapsulated in one or more of a polymer, carbohydrate, sugar, sugar alcohol, surfactant, plastic, glass, polysaccharide, lipid, wax, oil, fatty acid, amino acid, or glyceride. In some embodiment, the encapsulated bacteria are vitrified. In one embodiment, the encapsulated bacteria are further encapsulated in a wax, fat, fatty acid, fatty alcohol, or glyceride.

In one embodiment, the purified population of bacteria are in the form of spores. In one embodiment, the spores are spray dried. In one embodiment, the ruminant supplement is formulated as a tablet, capsule, pill, feed additive, food ingredient, food additive, food preparation, food supplement, consumable solution, consumable spray additive, consumable solid, consumable gel, injection, bolus, or combinations thereof.

In some embodiments, the disclosure is drawn to a method of decreasing the amount of carbon dioxide and/or carbonic acid in the rumen of a ruminant, comprising: administering to a ruminant an effective amount of a ruminant supplement comprising: a) a purified population of bacteria selected from any one or more bacteria comprising a 16S nucleic acid sequence that is at least about 97% identical to any one of SEQ ID NO:1-5993; and b) a carrier suitable for ruminant administration; wherein the purified population of bacteria of a) is present in the supplement in an amount effective to decrease the amount of carbon dioxide and/or carbonic acid in the rumen of a ruminant administered the supplement, as compared to a ruminant not administered the supplement.

In some embodiments, the disclosure is drawn to a method of decreasing the amount of carbon dioxide and/or carbonic acid in the rumen of a ruminant, comprising: administering to a ruminant an effective amount of a ruminant supplement comprising: a) a purified population of bacteria selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13; and b) a carrier suitable for ruminant administration; wherein the purified population of bacteria of a) is present in the supplement in an amount effective to decrease the amount of carbon dioxide and/or carbonic acid in the rumen of a ruminant administered the supplement, as compared to a ruminant not administered the supplement.

In one embodiment, at least one of the bacteria are selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13.

In one embodiment, the purified population of bacteria is selected from: (i) *Succinivibrio* bacteria with a 16S nucleic acid sequence that is at least about 99% identical to SEQ ID NO:75, (ii) *Prevotella* bacteria with a 16S nucleic acid sequence that is at least about 99% identical to SEQ ID NO:86, and/or (iii) *Bacteroides* bacteria with a 16S nucleic acid sequence that is at least about 99% identical to SEQ ID NO:13.

In one embodiment, the purified population of bacteria is selected from: (i) *Succinivibrio* bacteria with a 16S nucleic acid sequence comprising SEQ ID NO:75, (ii) *Prevotella* bacteria with a 16S nucleic acid sequence comprising SEQ ID NO:86, and/or (iii) *Bacteroides* bacteria with a 16S nucleic acid sequence comprising SEQ ID NO:13.

In one embodiment, the purified population of bacteria is selected from: (i) *Succinivibrio* bacteria deposited as B-67550. (ii) *Prevotella* bacteria deposited as B-67552, and/or (iii) *Bacteroides* bacteria deposited as B-67555.

In one embodiment, the ruminant supplement further comprises a purified population of bacteria that comprises bacteria with a 16S nucleic acid sequence that is at least about 97% identical to a nucleic acid sequence selected from the group consisting of SEQ ID NO:1-5993

In one embodiment, the ruminant supplement further comprises a purified population of bacteria that comprises bacteria with a 16S nucleic acid sequence that is at least about 99% identical to a nucleic acid sequence selected from the group consisting of SEQ ID NO:1-5993.

In one embodiment, the ruminant supplement further comprises a purified population of bacteria that comprises bacteria with a 16S nucleic acid sequence comprising a nucleic acid sequence selected from the group consisting of SEQ ID NO:1-5993.

In one embodiment, the purified population of bacteria are encapsulated in one or more of a polymer, carbohydrate, sugar, sugar alcohol, surfactant, plastic, glass, polysaccharide, lipid, wax, oil, fatty acid, amino acid, or glyceride.

In one embodiment, the encapsulated bacteria are vitrified. In one embodiment, the encapsulated bacteria are further encapsulated in a wax, fat, fatty acid, fatty alcohol, or glyceride. The method of claim 51, wherein the purified population of bacteria are in the form of spores. The method of claim 62, wherein the spores are spray dried.

In one embodiment, the ruminant supplement is formulated as a tablet, capsule, pill, feed additive, food ingredient, food additive, food preparation, food supplement, consumable solution, consumable spray additive, consumable solid, consumable gel, injection, bolus, or combinations thereof.

In one embodiment, the ruminant is administered to a ruminant orally. In one embodiment, the ruminant is a cow or a steer. In one embodiment, the ruminant is fed a step-up diet. In one embodiment, the ruminant is fed a finishing diet.

In one embodiment, the disclosure is drawn to a ruminant supplement capable of increasing the amount of meat marbling in a ruminant, comprising: a) a purified population of bacteria selected from any one or more bacteria comprising a 16S nucleic acid sequence that is at least about 97% identical to any one of SEQ ID NO:1-5993: and b) a carrier suitable for ruminant administration; wherein the purified population of bacteria of a) is present in the supplement in an amount effective to increase the amount of meat marbling in the ruminant administered the supplement, as compared to a ruminant not administered the supplement.

In one embodiment, the disclosure is drawn to a ruminant supplement capable of increasing the amount of meat marbling in a ruminant, comprising: a) a purified population of bacteria selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13; and b) a carrier suitable for ruminant administration; wherein the purified population of bacteria of a) is present in the supplement in an amount effective to increase the amount of meat marbling in the ruminant administered the supplement, as compared to a ruminant not administered the supplement.

In one embodiment, the least one of the bacteria are selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13.

In one embodiment, the purified population of bacteria is selected from: (i) *Succinivibrio* bacteria with a 16S nucleic acid sequence that is at least about 99% identical to SEQ ID NO:75, (ii) *Prevotella* bacteria with a 16S nucleic acid sequence that is at least about 99% identical to SEQ ID NO:86, and/or (iii) *Bacteroides* bacteria with a 16S nucleic acid sequence that is at least about 99% identical to SEQ ID NO:13.

In one embodiment, the purified population of bacteria is selected from: (i) *Succinivibrio* bacteria with a 16S nucleic acid sequence comprising SEQ ID NO:75, (ii) *Prevotella* bacteria with a 16S nucleic acid sequence comprising SEQ ID NO:86, and/or (iii) *Bacteroides* bacteria with a 16S nucleic acid sequence comprising SEQ ID NO:13.

In one embodiment, the purified population of bacteria is selected from: (i) *Succinivibrio* bacteria deposited as B-67550, (ii) *Prevotella* bacteria deposited as B-67552, and/or (iii) *Bacteroides* bacteria deposited as B-67555.

In one embodiment, the rumen supplement further comprises a purified population of bacteria that comprises bacteria with a 16S nucleic acid sequence that is at least about 97% identical to a nucleic acid sequence selected from the group consisting of SEQ ID NO:1-5993.

In one embodiment, the rumen supplement further comprises a purified population of bacteria that comprises bacteria with a 16S nucleic acid sequence that is at least about 99% identical to a nucleic acid sequence selected from the group consisting of SEQ ID NO:1-5993.

In one embodiment, the rumen supplement further comprising a purified population of bacteria that comprises bacteria with a 16S nucleic acid sequence comprising a nucleic acid sequence selected from the group consisting of SEQ ID NO:1-5993.

In one embodiment, the purified population of bacteria are encapsulated in one or more of a polymer, carbohydrate, sugar, sugar alcohol, surfactant, plastic, glass, polysaccharide, lipid, wax, oil, fatty acid, amino acid, or glyceride.

In one embodiment, the encapsulated bacteria are vitrified. In one embodiment, the encapsulated bacteria are further encapsulated in a wax, fat, fatty acid, fatty alcohol, or glyceride. In one embodiment, the purified population of bacteria are in the form of spores. In one embodiment, the spores are spray dried.

In one embodiment, the rumen supplement is formulated as a tablet, capsule, pill, feed additive, food ingredient, food additive, food preparation, food supplement, consumable solution, consumable spray additive, consumable solid, consumable gel, injection, bolus, or combinations thereof.

In some embodiments, the disclosure is drawn to a method increasing the amount of meat marbling in a ruminant, comprising: administering to a ruminant an effective amount of a ruminant supplement comprising: a) a purified population of bacteria selected from any one or more bacteria comprising a 16S nucleic acid sequence that is at least about 97% identical to any one of SEQ ID NO:1-5993; and b) a carrier suitable for ruminant administration; wherein the purified population of bacteria of a) is present in the supplement in an amount effective to increase the amount of meat marbling in the ruminant administered the supplement, as compared to a ruminant not administered the supplement.

In some embodiments, the disclosure is drawn to a method increasing the amount of meat marbling in a ruminant, comprising: administering to a ruminant an effective amount of a ruminant supplement comprising: a) a purified population of bacteria selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13; and b) a carrier suitable for ruminant administration; wherein the purified population of bacteria of a) is present in the supplement in an amount effective to increase the amount of meat marbling in the ruminant administered the supplement, as compared to a ruminant not administered the supplement.

In one embodiment, at least one of the bacteria are selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about
97% identical to SEQ ID NO:13.

In one embodiment, the purified population of bacteria is selected from: (i) *Succinivibrio* bacteria with a 16S nucleic acid sequence that is at least about 99% identical to SEQ ID NO:75, (ii) *Prevotella* bacteria with a 16S nucleic acid sequence that is at least about 99% identical to SEQ ID NO:86, and/or (iii) *Bacteroides* bacteria with a 16S nucleic acid sequence that is at least about
99% identical to SEQ ID NO:13.

In one embodiment, the purified population of bacteria is selected from: (i) *Succinivibrio* bacteria with a 16S nucleic acid sequence comprising SEQ ID NO:75, (ii) *Prevotella* bacteria with a 16S nucleic acid sequence comprising SEQ ID NO:86, and/or (iii) *Bacteroides* bacteria with a 16S nucleic acid sequence comprising SEQ ID NO:13.

In one embodiment, the purified population of bacteria is selected from: (i) *Succinivibrio* bacteria deposited as B-67550, (ii) *Prevotella* bacteria deposited as B-67552, and/or (iii) *Bacteroides* bacteria deposited as B-67555.

In one embodiment, the ruminant supplement further comprises a purified population of bacteria that comprises bacteria with a 16S nucleic acid sequence that is at least about 97% identical to a nucleic acid sequence selected from the group consisting of SEQ ID NO:5993.

In one embodiment, the ruminant supplement further comprises a purified population of bacteria that comprises bacteria with a 16S nucleic acid sequence that is at least about 99% identical to a nucleic acid sequence selected from the group consisting of SEQ ID NO:5993.

In one embodiment, the ruminant supplement further comprises a purified population of bacteria that comprises bacteria with a 16S nucleic acid sequence comprising a nucleic acid sequence selected from the group consisting of SEQ ID NO:1-5993.

In one embodiment, the purified population of bacteria are encapsulated in one or more of a polymer, carbohydrate, sugar, sugar alcohol, surfactant, plastic, glass, polysaccharide, lipid, wax, oil, fatty acid, amino acid, or glyceride.

In one embodiment, the encapsulated bacteria are vitrified. In one embodiment, the encapsulated bacteria are further encapsulated in a wax. On one embodiment, the purified population of bacteria are in the form of spores. In one embodiment, the spores are spray dried.

In one embodiment, the ruminant supplement is formulated as a tablet, capsule, pill, feed additive, food ingredient, food additive, food preparation, food supplement, consumable solution, consumable spray additive, consumable solid, consumable gel, injection, bolus, or combinations thereof. In one embodiment, the ruminant supplement is administered to a ruminant orally. In one embodiment, the ruminant is a cow or a steer. In one embodiment, the ruminant is fed a step-up diet. In one embodiment the ruminant is fed a finishing diet. In one embodiment, the increase in meat marbling is an increase of at least 10%.

In some embodiments, the disclosure is drawn to a ruminant supplement capable of increasing feed efficiency in a ruminant, comprising: a) a purified population of bacteria selected from any one or more bacteria comprising a 16S nucleic acid sequence that is at least about 97% identical to any one of SEQ ID NO:1-5993: and b) a carrier suitable for ruminant administration; wherein the purified population of bacteria of a) is present in the supplement in an amount effective to increase feed efficiency in a ruminant administered the supplement, as compared to a ruminant not administered the supplement.

In some embodiments, the disclosure is drawn to a ruminant supplement capable of increasing feed efficiency in a ruminant, comprising: a) a purified population of bacteria selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13; and b) a carrier suitable for ruminant administration; wherein the purified population of bacteria of a) is present in the supplement in an amount effective to increase feed efficiency in a ruminant administered the supplement, as compared to a ruminant not administered the supplement.

In some embodiments, the at least one of the bacteria are selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13.

In some embodiments, the disclosure is drawn to a method for increasing feed efficiency in a ruminant, comprising: administering to a ruminant an effective amount of a ruminant supplement comprising: a) a purified population of bacteria selected from any one or more bacteria comprising a 16S nucleic acid sequence that is at least about 97% identical to any one of SEQ ID NO:1-5993; and b) a carrier suitable for ruminant administration; wherein the purified population of bacteria of a) is present in the supplement in an amount effective to increase feed efficiency in a ruminant administered the supplement, as compared to a ruminant not administered the supplement.

In some embodiments, the method increasing feed efficiency in a ruminant comprises: administering to a ruminant an effective amount of a ruminant supplement comprising: a) a purified population of bacteria selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13; and b) a carrier suitable for ruminant administration; wherein the purified population of bacteria of a) is present in the supplement in an amount effective to increase feed efficiency in a ruminant administered the supplement, as compared to a ruminant not administered the supplement.

In some embodiments, the at least one of the bacteria are selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13.

In some embodiments, the ruminant supplement capable of increasing performance in a ruminant, comprising: a) a purified population of bacteria selected from any one or more bacteria comprising a 16S nucleic acid sequence that is at least about 97% identical to any one of SEQ ID NO:1-5993: and b) a carrier suitable for ruminant administration; wherein the purified population of bacteria of a) is present in the supplement in an amount effective to increase performance in a ruminant administered the supplement, as compared to a ruminant not administered the supplement.

In some embodiments, the ruminant supplement capable of increasing performance in a ruminant, comprising: a) a purified population of bacteria selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13; and b) a carrier suitable for ruminant administration; wherein the purified population of bacteria of a) is present in the supplement in an amount effective to increase performance in a ruminant administered the supplement, as compared to a ruminant not administered the supplement.

In some embodiments, at least one of the bacteria are selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13.

In some embodiments, the disclosure is drawn to a ruminant supplement capable of reducing methane production and emission in a ruminant, comprising: a) a purified population of bacteria selected from any one or more bacteria comprising a 16S nucleic acid sequence that is at least about 97% identical to any one of SEQ ID NO:1-5993: and b) a carrier suitable for ruminant administration; wherein the purified population of bacteria of a) is present in the supplement in an amount effective to reduce methane production and emission in a ruminant administered the supplement, as compared to a ruminant not administered the supplement.

In some embodiments, the disclosure is drawn to a ruminant supplement capable of reducing methane production and emission in a ruminant, comprising: a) a purified population of bacteria selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13; and b) a carrier suitable for ruminant administration; wherein the purified population of bacteria of a) is present in the supplement in an amount effective to reduce methane production and emission in a ruminant administered the supplement, as compared to a ruminant not administered the supplement.

In some embodiments, at least one of the bacteria are selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13.

In some embodiments, the disclosure is drawn to a ruminant supplement capable of reducing methane production and emission in a ruminant, comprising: a) a purified population of bacteria selected from any one or more bacteria comprising a 16S nucleic acid sequence that is at least about 97% identical to any one of SEQ ID NO:1-5993: and b) a carrier suitable for ruminant administration; wherein the purified population of bacteria of a) is present in the supplement in an amount effective to reduce methane production and emission in a ruminant administered the supplement, as compared to a ruminant not administered the supplement.

In some embodiments, the disclosure is drawn to a ruminant supplement capable of reducing methane production and emission in a ruminant, comprising: a) a purified population of bacteria selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13; and b) a carrier suitable for ruminant administration; wherein the purified population of bacteria of a) is present in the supplement in an amount effective to reduce methane production and emission in a ruminant administered the supplement, as compared to a ruminant not administered the supplement.

In some embodiments, the at least one of the bacteria are selected from: (i) *Succinivibrio* bacteria with a 16S nucleic acid sequence that is at least about 97% identical to SEQ ID NO:75, (ii) *Prevotella* bacteria with a 16S nucleic acid sequence that is at least about 97% identical to SEQ ID NO:86, and/or (iii) *Bacteroides* bacteria with a 16S nucleic acid sequence that is at least about 97% identical to SEQ ID NO:13.

In some embodiments, the microbes are administered with a prebiotic, a vitamin, or a mineral. In some embodiments, the microbes are administered with vitamin B or a precursor thereof.

Budapest Treaty on the International Recognition of the Deposit of Microorganisms for the Purpose of Patent Procedures The microorganisms described in this Application were deposited with (1) the American Type Culture Collection) (ATCC®), located at 10801 University Blvd., Manassas, Va. 20110, USA; and the United States Department of Agriculture (USDA) Agricultural Research Service (ARS) Culture Collection (NRRL®), located at 1815 N. University St., Peoria, Ill. 61604, USA The deposits were made under the terms of the Budapest Treaty on the International Recognition of the Deposit of Microorganisms for the Purposes of Patent Procedure. The ATCC and NRRL accession numbers for the aforementioned Budapest Treaty deposits are provided in Table 1. The Accession numbers and corresponding dates of deposit for the microorganisms described in this Application are separately provided in Table 2.

The strains designated in the below table have been deposited in the labs of Ascus Biosciences, Inc. since at least Apr. 22, 2017, and August 2017.

In Table 1, the closest predicted hits for taxonomy of the microbes are listed in columns 2, and 5. Column 2 is the top taxonomic hit predicted by BLAST, and column 5 is the top taxonomic hit for genus+species predicted by BLAST. The strains designated in the below table have been deposited in the labs of Ascus Biosciences, Inc. since at least Apr. 22, 2017, and August, 2017.

TABLE 1

Microbes of the present disclosure, including bacteria (1-190).

| Predicted Closest Taxa of Isolated Microbes | BLAST Taxonomic Top Hit w/Genus + Species | BLAST % Ident. | Query Cover | Strain Designation | Sequence Identifier for Associated Marker | MIC Score |
|---|---|---|---|---|---|---|
| 1. Prevotella (genus) | Prevotella ruminicola | 93% | 98% | Ascusbbf_6176 | SEQ ID NO: 1 | 1 |
| 2. Prevotella (genus) | Prevotella loescheii | 88% | 99% | Ascusbbf_22143 | SEQ ID NO: 2 | 1 |
| 3. Prevotella (genus) | Prevotella ruminicola | 91% | 100% | Ascusbbf_4883 | SEQ ID NO: 3 | 0.97095 |
| 4. Selenomonas (genus) | Selenomonas ruminantium | 93% | 95% | Ascusbbf_13543 | SEQ ID NO: 4 | 0.97095 |
| 5. Clostridium XIVa (Cluster) | Oscillibacter valericigenes | 92% | 100% | Ascusbbf_152 | SEQ ID NO: 5 | 0.88129 |
| 6. Clostridium XIVa (Cluster) | Oscillibacter valericigenes | | | Ascusbbf_152A | SEQ ID NO: 5398 | 0.88129 |
| 7. Prevotella (genus) | Prevotella ruminicola | 94% | 100% | Ascusbbf_707 | SEQ ID NO: 6 | 0.88129 |
| 8. Fibrobacter (genus) | Fibrobacter intestinalis | 99% | 100% | Ascusbbf_1238 | SEQ ID NO: 7 | 0.88129 |
| 9. Prevotella (genus) | Prevotella ruminicola | 89% | 100% | Ascusbbf_5588 | SEQ ID NO: 8 | 0.88129 |
| 10. Saccharofermentans (genus) | Saccharofermentans acetigenes | 86% | 100% | Ascusbbf_4691 | SEQ ID NO: 9 | 0.88129 |
| 11. Saccharofermentans (genus) | Saccharofermentans acetigenes | | | Ascusbbf_4691C | SEQ ID NO: 5425 | 0.88129 |
| 12. Saccharofermentans (genus) | Intestinimonas butyriciproducens | 86% | 100% | Ascusbbf_59499 | SEQ ID NO: 10 | 0.88129 |
| 13. Bacillus (genus) | Brevibacillus brevis | 86% | 89% | Ascusbbf_9770 | SEQ ID NO: 11 | 0.88129 |
| 14. Spirochaeta (genus) | Treponema parvum | 88% | 92% | Ascusbbf_123632 | SEQ ID NO: 12 | 0.88129 |
| 15. Bacteroides (genus) | Bacteroides xylanisolvens | 99% | 97% | Ascusbbf_14146 | SEQ ID NO: 13 | 0.78606 |
| 16. Lachnospiracea incertae sedis (genus) | Desulfotomaculum sp. | 94% | 100% | Ascusbbf_1103 | SEQ ID NO: 14 | 0.67032 |
| 17. Clostridium XIVa (Cluster) | Lachnoclostridium pacaense | 89% | 100% | Ascusbbf_498 | SEQ ID NO: 15 | 0.66823 |
| 18. Prevotella (genus) | Prevotella oralis | 89% | 100% | Ascusbbf_13717 | SEQ ID NO: 16 | 0.65415 |
| 19. Prevotella (genus) | Prevotella oralis | | | Ascusbbf_13717A | SEQ ID NO: 5450 | 0.65415 |
| 20. Clostridium XIVa (Cluster) | Coprococcus catus | 90% | 97% | Ascusbbf_876 | SEQ ID NO: 17 | 0.65106 |
| 21. Bacteroides (genus) | Bacteroides uniformis | 89% | 100% | Ascusbbf_612 | SEQ ID NO: 18 | 0.65002 |
| 22. Selenomonas (genus) | Selenomonas ruminantium | 97% | 100% | Ascusbbf_4936 | SEQ ID NO: 19 | 0.63816 |
| 23. Selenomonas (genus) | Selenomonas ruminantium | | | Ascusbbf_4936A | SEQ ID NO: 5460 | 0.63816 |
| 24. Prevotella (genus) | Prevotella oulorum | 92% | 100% | Ascusbbf_6809 | SEQ ID NO: 20 | 0.6337 |
| 25. Clostridium XIVa (Cluster) | Clostridium aminophilum | 91% | 100% | Ascusbbf_113152 | SEQ ID NO: 21 | 0.63008 |
| 26. Clostridium XIVa (Cluster) | Clostridium aminophilum | | | Ascusbbf_113152A | SEQ ID NO: 5462 | 0.63008 |
| 27. Ruminococcus (genus) | Ruminococcus bromii | 99% | 96% | Ascusbbf_18 | SEQ ID NO: 22 | 0.62713 |
| 28. Prevotella (genus) | Prevotella ruminicola | 94% | 100% | Ascusbbf_9031 | SEQ ID NO: 23 | 0.62075 |
| 29. Spirochaeta (genus) | Treponema brennaborense | 86% | 98% | Ascusbbf_11823 | SEQ ID NO: 24 | 0.61287 |
| 30. Butyricimonas (genus) | Porphyromonadaceae | 87% | 98% | Ascusbbf_1007 | SEQ ID NO: 25 | 0.60495 |
| 31. Butyricimonas (genus) | Porphyromonadaceae | | | Ascusbbf_1007A | SEQ ID NO: 5473 | 0.60495 |
| 32. Prevotella (genus) | Prevotella baroniae | 87% | 99% | Ascusbbf_24422 | SEQ ID NO: 26 | 0.59156 |
| 33. Prevotella (genus) | Prevotella baroniae | | | Ascusbbf_24422A | SEQ ID NO: 5474 | 0.59156 |
| 34. Olsenella (genus) | Olsenella umbonata | 99% | 100% | Ascusbbf_951 | SEQ ID NO: 27 | 0.59007 |
| 35. Clostridium XIVa (Cluster) | [Clostridium] symbiosum | 96% | 100% | Ascusbbf_80169 | SEQ ID NO: 28 | 0.58852 |
| 36. Spirochaeta (genus) | Treponema bryantii | 90% | 97% | Ascusbbf_5699 | SEQ ID NO: 29 | 0.58423 |
| 37. Spirochaeta (genus) | Treponema bryantii | | | Ascusbbf_5699B | SEQ ID NO: 5483 | 0.58423 |
| 38. Prevotella (genus) | Prevotella ruminicola | 91% | 100% | Ascusbbf_130 | SEQ ID NO: 30 | 0.58333 |
| 39. Acidaminococcus (genus) | Acidaminococcus fermentans | 95% | 100% | Ascusbbf_10109 | SEQ ID NO: 31 | 0.58267 |
| 40. Parabacteroides (genus) | Culturomica massiliensis | 86% | 89% | Ascusbbf_29797 | SEQ ID NO: 32 | 0.58241 |
| 41. Parabacteroides (genus) | Culturomica massiliensis | | | Ascusbbf_29797A | SEQ ID NO: 5502 | 0.58241 |
| 42. Clostridium sensu stricto (genus) | Christensenella timonensis | 86% | 99% | Ascusbbf_24410 | SEQ ID NO: 33 | 0.58142 |
| 43. Oribacterium (genus) | Oribacterium sinus | 91% | 99% | Ascusbbf_54068 | SEQ ID NO: 34 | 0.58113 |
| 44. Clostridium XIVa (Cluster) | [Clostridium] bolteae | 93% | 100% | Ascusbbf_7003 | SEQ ID NO: 35 | 0.58059 |
| 45. Pseudoflavonifractor (genus) | Intestinimonas butyriciproducens | 89% | 100% | Ascusbbf_23 | SEQ ID NO: 36 | 0.57785 |
| 46. Prevotella (genus) | Prevotella ruminicola | 90% | 100% | Ascusbbf_1697 | SEQ ID NO: 37 | 0.57337 |
| 47. Prevotella (genus) | Prevotella ruminicola | | | Ascusbbf_1697B | SEQ ID NO: 5511 | 0.57337 |
| 48. Treponema (genus) | Treponema ziolecki | 99% | 99% | Ascusbbf_24513 | SEQ ID NO: 38 | 0.5696 |
| 49. Prevotella (genus) | Prevotella oralis | 89% | 100% | Ascusbbf_7586 | SEQ ID NO: 39 | 0.56896 |
| 50. Butyricimonas (genus) | Barnesiella viscericola | 85% | 91% | Ascusbbf_27854 | SEQ ID NO: 40 | 0.56657 |

TABLE 1-continued

Microbes of the present disclosure, including bacteria (1-190).

| Predicted Closest Taxa of Isolated Microbes | BLAST Taxonomic Top Hit w/Genus + Species | BLAST % Ident. | Query Cover | Strain Designation | Sequence Identifier for Associated Marker | MIC Score |
|---|---|---|---|---|---|---|
| 51. *Saccharofermentans* (genus) | *Oscillibacter valericigenes* | 87% | 100% | Ascusbbf_1034 | SEQ ID NO: 41 | 0.56476 |
| 52. *Saccharofermentans* (genus) | *Oscillibacter valericigenes* | | | Ascusbbf_1034A | SEQ ID NO: 5517 | 0.56476 |
| 53. *Butyricimonas* (genus) | *Butyricimonas virosa* | 82% | 100% | Ascusbbf_23134 | SEQ ID NO: 42 | 0.56219 |
| 54. *Butyricimonas* (genus) | *Butyricimonas virosa* | | | Ascusbbf_23134A | SEQ ID NO: 5519 | 0.56219 |
| 55. *Rhodobacter* (genus) | *Gemmobacter intermedius* | 99% | 87% | Ascusbbf_7027 | SEQ ID NO: 43 | 0.56127 |
| 56. *Prevotella* (genus) | *Butyricimonas virosa* | 84% | 92% | Ascusbbf_43679 | SEQ ID NO: 44 | 0.56056 |
| 57. *Fluviicola* (genus) | *Anaerocella delicata* | 85% | 87% | Ascusbbf_63954 | SEQ ID NO: 45 | 0.55952 |
| 58. *Fluviicola* (genus) | *Anaerocella delicata* | | | Ascusbbf_63954A | SEQ ID NO: 5526 | 0.55952 |
| 59. *Succiniclasticum* (genus) | *Succiniclasticum ruminis* | 95% | 95% | Ascusbbf_1517 | SEQ ID NO: 46 | 0.55908 |
| 60. *Solobacterium* (genus) | *Solobacterium moorei* | 91% | 99% | Ascusbbf_104 | SEQ ID NO: 47 | 0.55759 |
| 61. *Clostridium* XIVa (Cluster) | [*Clostridium*] *lavalense* | 90% | 100% | Ascusbbf_148 | SEQ ID NO: 48 | 0.55551 |
| 62. *Prevotella* (genus) | *Prevotella bryantii* | 99% | 100% | Ascusbbf_944 | SEQ ID NO: 49 | 0.55265 |
| 63. *Lachnospiracea incertae sedis* (genus) | *Eubacterium oxidoreducens* | 90% | 100% | Ascusbbf_76009 | SEQ ID NO: 50 | 0.55253 |
| 64. *Veillonella* (genus) | *Holdemania filiformis* | 84% | 96% | Ascusbbf_23033 | SEQ ID NO: 51 | 0.55253 |
| 65. *Cellulosimicrobium* (genus) | *Cellulosimicrobium cellulans* | 95% | 100% | Ascusbbf_20389 | SEQ ID NO: 52 | 0.55131 |
| 66. *Cupriavidus* (genus) | *Sutterella wadsworthensis* | 92% | 100% | Ascusbbf_2600 | SEQ ID NO: 53 | 0.54892 |
| 67. *Bacteroides* (genus) | *Paraprevotella xylaniphila* | 86% | 92% | Ascusbbf_8118 | SEQ ID NO: 54 | 0.54888 |
| 68. *Prevotella* (genus) | *Prevotella ruminicola* | 92% | 100% | Ascusbbf_201 | SEQ ID NO: 55 | 0.54656 |
| 69. *Prevotella* (genus) | *Prevotella ruminicola* | | | Ascusbbf_20IK | SEQ ID NO: 5576 | 0.54656 |
| 70. *Spirochaeta* (genus) | *Treponema saccharophilum* | 88% | 100% | Ascusbbf_6315 | SEQ ID NO: 56 | 0.54535 |
| 71. *Megasphaera* (genus) | *Megasphaera elsdenii* | 99% | 100% | Ascusbbf_10712 | SEQ ID NO: 57 | 0.54494 |
| 72. *Megasphaera* (genus) | *Megasphaera elsdenii* | | | Ascusbbf_10712E | SEQ ID NO: 5582 | 0.54494 |
| 73. *Succinivibrio* (genus) | *Succinivibrio dextrinosolvens* | 90% | 99% | Ascusbbf_6012 | SEQ ID NO: 58 | 0.54428 |
| 74. *Succinivibrio* (genus) | *Succinivibrio dextrinosolvens* | | | Ascusbbf_6012C | SEQ ID NO: 5589 | 0.54428 |
| 75. *Spirochaeta* (genus) | *Treponema bryantii* | 98% | 99% | Ascusbbf_2297 | SEQ ID NO: 59 | 0.54413 |
| 76. *Spirochaeta* (genus) | *Treponema bryantii* | | | Ascusbbf_2297G | SEQ ID NO: 5598 | 0.54413 |
| 77. *Bacteroides* (genus) | *Bacteroides uniformis* | 89% | 100% | Ascusbbf_9540 | SEQ ID NO: 60 | 0.54383 |
| 78. *Oscillibacter* (genus) | *Oscillibacter valericigenes* | 94% | 100% | Ascusbbf_873 | SEQ ID NO: 61 | 0.54374 |
| 79. *Prevotella* (genus) | *Prevotella dentalis* | 83% | 95% | Ascusbbf_87102 | SEQ ID NO: 62 | 0.54356 |
| 80. *Pseudomonas* (genus) | *Pseudomonas pertucinogena* | 98% | 99% | Ascusbbf_77105 | SEQ ID NO: 63 | 0.54356 |
| 81. *Corynebacterium* (genus) | *Corynebacterium marinum* | 99% | 100% | Ascusbbf_269 | SEQ ID NO: 64 | 0.54206 |
| 82. *Adlercreutzia* (genus) | *Raoultibacter massiliensis* | 92% | 100% | Ascusbbf_41015 | SEQ ID NO: 65 | 0.54192 |
| 83. *Adlercreutzia* (genus) | *Raoultibacter massiliensis* | | | Ascusbbf_41015A | SEQ ID NO: 5614 | 0.54192 |
| 84. *Acidaminococcus* (genus) | *Acidaminococcus fermentans* | 98% | 97% | Ascusbbf_32877 | SEQ ID NO: 66 | 0.54166 |
| 85. *Acidaminococcus* (genus) | *Acidaminococcus fermentans* | | | Ascusbbf_32877A | SEQ ID NO: 5619 | 0.54166 |
| 86. *Dorea* (genus) | *Dorea longicatena* | 99% | 100% | Ascusbbf_57294 | SEQ ID NO: 67 | 0.53443 |
| 87. *Dorea* (genus) | *Dorea longicatena* | | | Ascusbbf_57294B | SEQ ID NO: 5621 | 0.53443 |
| 88. *Roseburia* (genus) | *Howardella ureilytica* | 88% | 98% | Ascusbbf_27932 | SEQ ID NO: 68 | 0.53375 |
| 89. *Anaerovibrio* (genus) | *Anaerovibrio lipolyticus* | 95% | 97% | Ascusbbf_22558 | SEQ ID NO: 69 | 0.53353 |
| 90. *Anaerovibrio* (genus) | *Anaerovibrio lipolyticus* | | | Ascusbbf_22558B | SEQ ID NO: 5627 | 0.53353 |
| 91. *Bacteroides* (genus) | *Bacteroides helcogenes* | 88% | 100% | Ascusbbf_983757 | SEQ ID NO: 70 | 0.5317 |
| 92. *Bacteroides* (genus) | *Bacteroides helcogenes* | | | Ascusbbf_983757B | SEQ ID NO: 5629 | 0.5317 |
| 93. *Clostridium* XIVa (Cluster) | *Clostridium aminophilum* | 98% | 100% | Ascusbbf_52330 | SEQ ID NO: 71 | 0.53133 |
| 94. *Clostridium* XIVa (Cluster) | *Clostridium aminophilum* | | | Ascusbbf_52330A | SEQ ID NO: 5631 | 0.53133 |
| 95. *Sporosarcina* (genus) | *Lactobacillus floricola* | 79% | 97% | Ascusbbf_88445 | SEQ ID NO: 72 | 0.53069 |
| 96. *Streptomyces* (genus) | *Streptomyces albus* | 99% | 100% | Ascusbbf_4111 | SEQ ID NO: 73 | 0.53006 |
| 97. *Syntrophococcus* (genus) | *Syntrophococcus sucromutans* | 93% | 100% | Ascusbbf_1085 | SEQ ID NO: 74 | 0.5294 |

TABLE 1-continued

Microbes of the present disclosure, including bacteria (1-190).

| Predicted Closest Taxa of Isolated Microbes | BLAST Taxonomic Top Hit w/Genus + Species | BLAST % Ident. | Query Cover | Strain Designation | Sequence Identifier for Associated Marker | MIC Score |
|---|---|---|---|---|---|---|
| 98. Succinivibrio (genus) | Succinivibrio dextrinosolvens | 99% | 99% | Ascusbbf_154 | SEQ ID NO: 75 | 0.52737 |
| 99. Selenomonas (genus) | Selenomonas bovis | 99% | 100% | Ascusbbf_1010 | SEQ ID NO: 76 | 0.527 |
| 100. Parabacteroides (genus) | Megasphaera indica | 99% | 99% | Ascusbbf_5575 | SEQ ID NO: 77 | 0.52675 |
| 101. Parabacteroides (genus) | Megasphaera indica | | | Ascusbbf_5575B | SEQ ID NO: 5663 | 0.52675 |
| 102. Prevotella (genus) | Prevotella oris | 82% | 100% | Ascusbbf_775 | SEQ ID NO: 78 | 0.52672 |
| 103. Prevotella (genus) | Prevotella oris | | | Ascusbbf_775A | SEQ ID NO: 5670 | 0.52672 |
| 104. Butyrivibrio (genus) | Butyrivibrio fibrisolvens | 96% | 100% | Ascusbbf_19348 | SEQ ID NO: 79 | 0.52608 |
| 105. Clostridium sensu stricto (genus) | Clostridium beijerinckii | 99% | 100% | Ascusbbf_24302 | SEQ ID NO: 80 | 0.52361 |
| 106. Succinivibrio (genus) | Succinivibrio dextrinosolvens | 99% | 97% | Ascusbbf_1 | SEQ ID NO: 81 | 0.51924 |
| 107. Lachnobacterium (genus) | Lachnobacterium bovis | 99% | 99% | Ascusbbf_52548 | SEQ ID NO: 82 | 0.51683 |
| 108. ClostridiumIV (Cluster) | Clostridiales bacterium | 93% | 100% | Ascusbbf_50658 | SEQ ID NO: 83 | 0.51263 |
| 109. Lachnospiracea incertae sedis (genus) | Lachnospira pectinoschiza | 89% | 100% | Ascusbbf_850 | SEQ ID NO: 84 | 0.5088 |
| 110. Parabacteroides (genus) | Parabacteroides distasonis | 84% | 100% | Ascusbbf_25259 | SEQ ID NO: 85 | 0.50691 |
| 111. Prevotella (genus) | Prevotella albensis | 98% | 100% | Ascusbbf_4 | SEQ ID NO: 86 | 0.50464 |
| 112. Bacteroides (genus) | Bacteroides uniformis | 89% | 100% | Ascusbbf_5131 | SEQ ID NO: 87 | 0.49238 |
| 113. Clostridium IV (Cluster) | Caproiciproducens galactitolivorans | 89% | 95% | Ascusbbf_8600 | SEQ ID NO: 88 | 0.47814 |
| 114. Clostridium IV (Cluster) | Caproiciproducens galactitolivorans | | | Ascusbbf_8600B | SEQ ID NO: 5726 | 0.47814 |
| 115. Pyramidobacter (genus) | Rarimicrobium hominis | 92% | 94% | Ascusbbf_1273 | SEQ ID NO: 89 | 0.46972 |
| 116. Ruminococcus (genus) | Ruminococcus flavefaciens | 98% | 99% | Ascusbbf_39159 | SEQ ID NO: 90 | 0.46727 |
| 117. Coprococcus (genus) | Eubacterium oxidoreducens | 89% | 100% | Ascusbbf_9751 | SEQ ID NO: 91 | 0.4618 |
| 118. Ruminobacter (genus) | Ruminobacter amylophilus | 99% | 100% | Ascusbbf_318 | SEQ ID NO: 92 | 0.45953 |
| 119. Thermobifida (genus) | Thermobifida fusca | 99% | 100% | Ascusbbf_7046 | SEQ ID NO: 93 | 0.45752 |
| 120. Papillibacter (genus) | Oscillibacter valericigenes | 86% | 100% | Ascusbbf_25993 | SEQ ID NO: 94 | 0.45023 |
| 121. Rhodobacter (genus) | Rhodobacter gluconicum | 95% | 99% | Ascusbbf_7027 | SEQ ID NO: 95 | 0.56127 |
| 122. Prevotella (genus) | Gabonibacter massiliensis | 87% | 76% | Ascusbbf_1372985 | SEQ ID NO: 96 | 0.55953 |
| 123. Prevotella (genus) | Gabonibacter massiliensis | | | Ascusbbf_1372985F | SEQ ID NO: 5746 | 0.55953 |
| 124. Aquamarina atlantica (genus + species) | Gabonibacter massiliensis | 89% | 76% | Ascusbbf_23253 | SEQ ID NO: 97 | 0.50683 |
| 125. Aquamarina pacifica (genus + species) | Gabonibacter massiliensis | 86% | 87% | Ascusbbf_121971 | SEQ ID NO: 98 | 0.42 |
| 126. Aquamarina pacifica (genus + species) | Gabonibacter massiliensis | | | Ascusbbf_121971A | SEQ ID NO: 5757 | 0.42 |
| 127. Treponema bryantii (genus + species) | Treponema bryantii | 98% | 94% | Ascusbbf_5251 | SEQ ID NO: 99 | 0.56738 |
| 128. Treponema bryantii (genus + species) | Treponema bryantii | | | Ascusbbf_5251G | SEQ ID NO: 5764 | 0.56738 |
| 129. Actinomyces turicensis (genus + species) | Actinomyces turicensis | 85% | 100% | Ascusbbf_6716 | SEQ ID NO: 100 | 0.5201 |
| 130. Prevotella (genus) | Prevotella oulorum | 92% | 99% | Ascusbbf_100 | SEQ ID NO: 101 | 0.53729 |
| 131. Staphylococcus (genus) | Paenibacillus hemerocallicola | 84% | 84% | Ascusbbf_20584 | SEQ ID NO: 102 | 0.52104 |
| 132. Prevotella (genus) | Prevotella ruminicola | 88% | 100% | Ascusbbf_4317 | SEQ ID NO: 103 | 0.55564 |
| 133. Prevotella (genus) | Prevotella ruminicola | | | Ascusbbf_4317D | SEQ ID NO: 5777 | 0.55564 |
| 134. Prevotella (genus) | Prevotella ruminicola | 90% | 93% | Ascusbbf_6 | SEQ ID NO: 104 | 0.46763 |
| 135. Mogibacterium (genus) | Mogibacterium pumilum | 91% | 100% | Ascusbbf_19022 | SEQ ID NO: 105 | 0.47803 |
| 136. Pseudobutyribibrio (genus) | Pseudobutyrivibrio ruminis | 99% | 100% | Ascusbbf_2624 | SEQ ID NO: 106 | 0.52337 |
| 137. Pseudobutyribibrio (genus) | Pseudobutyrivibrio ruminis | | | Ascusbbf_2624D | SEQ ID NO: 5797 | 0.52337 |
| 138. Fluviicola (genus) | Fluviicola taffensis | 84% | 90% | Ascusbbf_3427 | SEQ ID NO: 107 | 0.50515 |
| 139. Fluviicola (genus) | Fluviicola taffensis | | | Ascusbbf_3427B | SEQ ID NO: 5802 | 0.50515 |
| 140. Prevotella (genus) | Prevotella ruminicola | 92% | 100% | Ascusbbf_5005 | SEQ ID NO: 108 | 0.57034 |
| 141. Prevotella (genus) | Prevotella ruminicola | 100% | 100% | Ascusbbf_69 | SEQ ID NO: 109 | 0.50536 |

TABLE 1-continued

Microbes of the present disclosure, including bacteria (1-190).

| Predicted Closest Taxa of Isolated Microbes | BLAST Taxonomic Top Hit w/Genus + Species | BLAST % Ident. | Query Cover | Strain Designation | Sequence Identifier for Associated Marker | MIC Score |
|---|---|---|---|---|---|---|
| 142. Succiniclasticum (genus) | Succiniclasticum ruminis | 90% | 90% | Ascusbbf_8082 | SEQ ID NO: 110 | 0.50084 |
| 143. Prevotella (genus) | Prevotella ruminicola | 94% | 100% | Ascusbbf_95 | SEQ ID NO: 111 | 0.53509 |
| 144. Clostridium XIVa (cluster) | Butyrivibrio fibrisolvens | 89% | 100% | Ascusbbf_1136 | SEQ ID NO: 112 | 0.50966 |
| 145. Asteroleplasma (genus) | Asteroleplasma anaerobium | 98% | 100% | Ascusbbf_2770 | SEQ ID NO: 113 | 0.51006 |
| 146. Turicibacter (genus) | Turicibacter sanguinis | 98% | 100% | Ascusbbf_1629 | SEQ ID NO: 114 | 0.51632 |
| 147. Prevotella (genus) | Bacteroides caecicola | 85% | 99% | Ascusbbf_1821 | SEQ ID NO: 115 | 0.53784 |
| 148. Prevotella (genus) | Prevotella ruminicola | 95% | 100% | Ascusbbf_56782 | SEQ ID NO: 116 | 0.5317 |
| 149. Olsenella (genus) | Olsenella scatoligenes | 99% | 100% | Ascusbbf_92 | SEQ ID NO: 117 | 0.46089 |
| 150. Prevotella (genus) | Prevotella ruminicola | 94% | 99% | Ascusbbf_118 | SEQ ID NO: 118 | 0.6108 |
| 151. Prevotella (genus) | Prevotella ruminicola | | | Ascusbbf_118B | SEQ ID NO: 5868 | 0.6108 |
| 152. Aggregatibacter (genus) | Prevotella ruminicola | 87% | 44% | Ascusbbf_5429 | SEQ ID NO: 119 | 0.57983 |
| 153. Aggregatibacter (genus) | Prevotella ruminicola | | | Ascusbbf_5429C | SEQ ID NO: 5872 | 0.57983 |
| 154. Ruminobacter (genus) | Ruminobacter amylophilus | 86% | 88% | Ascusbbf_3 | SEQ ID NO: 120 | 0.56323 |
| 155. Prevotella (genus) | Prevotella ruminicola | 91% | 99% | Ascusbbf_10576 | SEQ ID NO: 121 | 0.56208 |
| 156. Prevotella (genus) | Prevotella ruminicola | 93% | 98% | Ascusbbf_729 | SEQ ID NO: 122 | 0.54949 |
| 157. Prevotella (genus) | Prevotella ruminicola | 92% | 100% | Ascusbbf_201 | SEQ ID NO: 123 | 0.54656 |
| 158. Prevotella (genus) | Prevotella ruminicola | 91% | 99% | Ascusbbf_416 | SEQ ID NO: 124 | 0.53816 |
| 159. Prevotella (genus) | Prevotella ruminicola | 94% | 99% | Ascusbbf_15806 | SEQ ID NO: 125 | 0.52527 |
| 160. Clostridium XIVa (cluster) | Clostridium aminophilum | 94% | 100% | Ascusbbf_6115 | SEQ ID NO: 126 | 0.52278 |
| 161. Anaerovibrio (genus) | Anaerovibrio lipolyticus | 95% | 97% | Ascusbbf_1325058 | SEQ ID NO: 127 | 0.52183 |
| 162. Prevotella (genus) | Prevotella buccalis | 91% | 100% | Ascusbbf_28350 | SEQ ID NO: 128 | 0.51744 |
| 163. Parabacteroides (genus) | Muribaculum intestinale | 93% | 100% | Ascusbbf_372 | SEQ ID NO: 129 | 0.51572 |
| 164. Phascolarctobacterium (genus) | Phascolarctobacterium succinatutens | 96% | 93% | Ascusbbf_667 | SEQ ID NO: 130 | 0.51381 |
| 165. Phascolarctobacterium (genus) | Phascolarctobacterium succinatutens | | | Ascusbbf_667A | SEQ ID NO: 5930 | 0.51381 |
| 166. Bacteroides (genus) | Bacteroides coprophilus | 83% | 100% | Ascusbbf_1207 | SEQ ID NO: 131 | 0.51075 |
| 167. Lachnospiracea incertae sedis (genus) | Coprococcus catus | 92% | 97% | Ascusbbf_3875 | SEQ ID NO: 132 | 0.47237 |
| 168. Clostridium XIVa (cluster) | Clostridium aminophilum | 90% | 100% | Ascusbbf_72889 | SEQ ID NO: 133 | 0.46531 |
| 169. Clostridium XIVa (cluster) | Clostridium aminophilum | | | Ascusbbf_72889B | SEQ ID NO: 5947 | 0.46531 |
| 170. Parabacteroides (genus) | Barnesiella viscericola | 85% | 94% | Ascusbbf_106863 | SEQ ID NO: 134 | 0.45152 |
| 171. Parabacteroides (genus) | Barnesiella viscericola | | | Ascusbbf_106863B | SEQ ID NO: 5949 | 0.45152 |
| 172. Prevotella (genus) | Prevotella ruminicola | 94% | 97% | Ascusbbf_120 | SEQ ID NO: 135 | 0.53376 |
| 173. Prevotella (genus) | Prevotella ruminicola | 93% | 99% | Ascusbbf_930 | SEQ ID NO: 136 | 0.51321 |
| 174. Bacteroides (genus) | Bacteroides uniformis | 89% | 100% | Ascusbbf_915 | SEQ ID NO: 5369 | 0.54396 |
| 175. Bacteroides (genus) | Bacteroides uniformis | | | Ascusbbf_915A | SEQ ID NO: 5955 | 0.54396 |
| 176. Prevotella (genus) | Prevotella ruminicola | 88% | 98% | Ascusbbf_8941 | SEQ ID NO: 5370 | 0.5328 |
| 177. Prevotella (genus) | Prevotella ruminicola | | | Ascusbbf_8941A | SEQ ID NO: 5956 | 0.5328 |
| 178. Anaerovibrio | Anaerovibrio lipolyticus | 96% | 97% | Ascusbbf_8480 | SEQ ID NO: 5371 | 0.48193 |
| 179. Anaerovibrio | Anaerovibrio lipolyticus | | | Ascusbbf_8480A | SEQ ID NO: 5989 | 0.48193 |
| 180. Prevotella (genus) | Prevotella ruminicola | 92% | 98% | Ascusbbf_374 | SEQ ID NO: 5372 | 0.52368 |
| 181. Prevotella (genus) | Prevotella ruminicola | | | Ascusbbf_374C | SEQ ID NO: 5991 | 0.52368 |
| 182. Prevotella (genus) | Prevotella brevis | 92% | 100% | Ascusbbf_6906 | SEQ ID NO: 5373 | 0.4889 |
| 183. Prevotella (genus) | Prevotella ruminicola | 94% | 99% | Ascusbbf_721 | SEQ ID NO: 5374 | 0.88129 |
| 184. Syntrophococcus (genus) | Syntrophococcus sucromutans | 93% | 100% | Ascusbbf_3819 | SEQ ID NO: 5375 | 0.45798 |
| 185. Syntrophococcus (genus) | Syntrophococcus sucromutans | | | Ascusbbf_3819A | SEQ ID NO: 5971 | 0.45798 |
| 186. Bacteroides (genus) | Bacteroides coprocola | 87% | 100% | Ascusbbf_4323 | SEQ ID NO: 5376 | 0.50634 |
| 187. Bacteroides (genus) | Bacteroides coprocola | | | Ascusbbf_4323B | SEQ ID NO: 5973 | 0.50634 |
| 188. Prevotella (genus) | Prevotella ruminicola | 91% | 100% | Ascusbbf_6087 | SEQ ID NO: 5377 | 0.52954 |
| 189. Prevotella (genus) | Prevotella ruminicola | | | Ascusbbf_6087B | SEQ ID NO: 5977 | 0.52954 |
| 190. Saccharofermentans (genus) | Christensenella timonensis | 86% | 99% | Ascusbbf_8414 | SEQ ID NO: 5378 | 0.52719 |

TABLE 2

Deposited Microbes of the present disclosure

| Strain Designation | SEQ ID No: | Deposit Accession # |
|---|---|---|
| Ascusbbf_6176A | 5379 | PTA-125041, PTA-125042, PTA-125049, PTA-125050, PTA-125051, PTA-125052 |
| Ascusbbf_6176B | 5380 | PTA-125041, PTA-125042, PTA-125049, PTA-125050, PTA-125051, PTA-125052 |
| Ascusbbf_6176C | 5381 | PTA-125041, PTA-125049, PTA-125050 |
| Ascusbbf_6176D | 5382 | PTA-125049, PTA-125051, PTA-125052 |
| Ascusbbf_6176E | 5383 | PTA-125049, PTA-125051, PTA-125052 |
| Ascusbbf_6176F | 5384 | PTA-125049 |
| Ascusbbf_6176G | 5385 | PTA-125049, PTA-125050, PTA-125051, PTA-125052 |
| Ascusbbf_6176H | 5386 | PTA-125049, PTA-125051, PTA-125052 |
| Ascusbbf_6176I | 5387 | PTA-125050, PTA-125051, PTA-125052 |
| Ascusbbf_4883A | 5388 | PTA-125042, PTA-125049 |
| Ascusbbf_4883B | 5389 | PTA-125049, PTA-125051 |
| Ascusbbf_4883C | 5390 | PTA-125049, PTA-125050, PTA-125051 |
| Ascusbbf_4883D | 5391 | PTA-125049, PTA-125050, PTA-125051 |
| Ascusbbf_4883E | 5392 | PTA-125050 |
| Ascusbbf_13543A | 5393 | PTA-125033 |
| Ascusbbf_13543B | 5394 | PTA-125041, PTA-125050 |
| Ascusbbf_13543C | 5395 | PTA-125041, PTA-125042, PTA-125050, PTA-125051 |
| Ascusbbf_13543D | 5396 | PTA-125041, PTA-125050 |
| Ascusbbf_13543E | 5397 | PTA-125033, PTA-125041, PTA-125042, PTA-125051, PTA-125052 |
| Ascusbbf_152A | 5398 | PTA-125051 |
| Ascusbbf_152B | 5399 | PTA-125051 |
| Ascusbbf_152C | 5400 | PTA-125051 |
| Ascusbbf_707A | 5401 | PTA-125049, PTA-125050, PTA-125051, PTA-125052 |
| Ascusbbf_707B | 5402 | PTA-125049, PTA-125050, PTA-125051, PTA-125052 |
| Ascusbbf_707C | 5403 | PTA-125049, PTA-125050 |
| Ascusbbf_707D | 5404 | PTA-125049, PTA-125051, PTA-125052 |
| Ascusbbf_707E | 5405 | PTA-125049, PTA-125051, PTA-125052 |
| Ascusbbf_707F | 5406 | PTA-125049, PTA-125050, PTA-125051, PTA-125052 |
| Ascusbbf_707G | 5407 | PTA-125049, PTA-125050, PTA-125051, PTA-125052 |
| Ascusbbf_707H | 5408 | PTA-125049, PTA-125050, PTA-125051, PTA-125052 |
| Ascusbbf_707I | 5409 | PTA-125051 |
| Ascusbbf_707J | 5410 | PTA-125051 |
| Ascusbbf_1238A | 5411 | PTA-125033, PTA-125040, PTA-125041, PTA-125050, PTA-125051, PTA-125052 |
| Ascusbbf_1238B | 5412 | PTA-125040, PTA-125041, PTA-125050, PTA-125052 |
| Ascusbbf_1238C | 5413 | PTA-125033, PTA-125040, PTA-125041, PTA-125042, PTA-125050, PTA-125051, PTA-125052 |
| Ascusbbf_1238D | 5414 | PTA-125033, PTA-125051, PTA-125052 |
| Ascusbbf_5588A | 5415 | PTA-125040, PTA-125041, PTA-125042, PTA-125049, PTA-125050 |
| Ascusbbf_5588B | 5416 | PTA-125040, PTA-125042 |
| Ascusbbf_5588C | 5417 | PTA-125040, PTA-125041, PTA-125042, PTA-125049, PTA-125050, PTA-125051 |
| Ascusbbf_5588D | 5418 | PTA-125040, PTA-125041, PTA-125042, PTA-125049, PTA-125050, PTA-125051, PTA-125052 |
| Ascusbbf_5588E | 5419 | PTA-125042 |
| Ascusbbf_5588F | 5420 | PTA-125042 |
| Ascusbbf_5588G | 5421 | PTA-125042 |
| Ascusbbf_5588H | 5422 | PTA-125049, PTA-125051 |
| Ascusbbf_4691A | 5423 | PTA-125050, PTA-125051 |
| Ascusbbf_4691B | 5424 | PTA-125051, PTA-125052 |
| Ascusbbf_4691C | 5425 | PTA-125051 |
| Ascusbbf_9770A | 5426 | PTA-125041, PTA-125042, PTA-125049, PTA-125050 |
| Ascusbbf_9770B | 5427 | PTA-125041, PTA-125049, PTA-125050 |
| Ascusbbf_9770C | 5428 | PTA-125049, PTA-125051, PTA-125052 |
| Ascusbbf_9770D | 5429 | PTA-125049, PTA-125050 |
| Ascusbbf_9770E | 5430 | PTA-125049, PTA-125050 |
| Ascusbbf_9770F | 5431 | PTA-125049, PTA-125050 |
| Ascusbbf_9770G | 5432 | PTA-125049, PTA-125050 |
| Ascusbbf_9770H | 5433 | PTA-125049, PTA-125050, PTA-125051 |
| Ascusbbf_14146A | 5434 | PTA-124942, PTA-125033, PTA-125041, PTA-125042, PTA-125051, PTA-125052, B-67555 |
| Ascusbbf_14146B | 5435 | PTA-125033, PTA-125041, PTA-125042, PTA-125051, PTA-125052 |
| Ascusbbf_14146C | 5436 | PTA-125041 |
| Ascusbbf_14146D | 5437 | PTA-125033, PTA-125041, PTA-125042, PTA-125051, PTA-125052 |
| Ascusbbf_14146E | 5438 | PTA-125033, PTA-125041 |
| Ascusbbf_14146F | 5439 | PTA-125041 |
| Ascusbbf_14146G | 5440 | PTA-125042, PTA-125051, PTA-125052 |
| Ascusbbf_1103A | 5441 | PTA-125033, PTA-125041 |
| Ascusbbf_1103B | 5442 | PTA-125041, PTA-125051, PTA-125052 |
| Ascusbbf_1103C | 5443 | PTA-125041, PTA-125051, PTA-125052 |
| Ascusbbf_1103D | 5444 | PTA-125041, PTA-125042, PTA-125051 |
| Ascusbbf_1103E | 5445 | PTA-125041, PTA-125051, PTA-125052 |
| Ascusbbf_1103F | 5446 | PTA-125051, PTA-125052 |
| Ascusbbf_1103G | 5447 | PTA-125051, PTA-125052 |
| Ascusbbf_1103H | 5448 | PTA-125051, PTA-125052 |
| Ascusbbf_1103I | 5449 | PTA-125051 |
| Ascusbbf_13717A | 5450 | PTA-125051, PTA-125052 |
| Ascusbbf_13717B | 5451 | PTA-125051 |
| Ascusbbf_13717C | 5452 | PTA-125051 |
| Ascusbbf_876A | 5453 | PTA-124942, PTA-125042 |
| Ascusbbf_876B | 5454 | PTA-125042 |
| Ascusbbf_876C | 5455 | PTA-125033, PTA-125040, PTA-125041, PTA-125042, PTA-125050 |
| Ascusbbf_876D | 5456 | PTA-125033, PTA-125040, PTA-125041, PTA-125042, PTA-125050, PTA-125052 |
| Ascusbbf_876E | 5457 | B-67553 |
| Ascusbbf_876F | 5458 | PTA-125033, PTA-125040, PTA-125041, PTA-125042, PTA-125050, PTA-125052 |
| Ascusbbf_876G | 5459 | PTA-125033, PTA-125042 |
| Ascusbbf_4936A | 5460 | PTA-125041, PTA-125050 |
| Ascusbbf_4936B | 5461 | PTA-125041 |
| Ascusbbf_113152A | 5462 | PTA-125050 |
| Ascusbbf_9031A | 5463 | PTA-125049 |
| Ascusbbf_9031B | 5464 | PTA-125049 |
| Ascusbbf_9031C | 5465 | PTA-125049 |
| Ascusbbf_9031D | 5466 | PTA-125049, PTA-125050 |
| Ascusbbf_9031E | 5467 | PTA-125049, PTA-125050 |
| Ascusbbf_9031F | 5468 | PTA-125049, PTA-125050 |
| Ascusbbf_9031G | 5469 | PTA-125050 |
| Ascusbbf_11823A | 5470 | PTA-125041 |
| Ascusbbf_11823B | 5471 | PTA-125041, PTA-125042, PTA-125049 |

TABLE 2-continued

Deposited Microbes of the present disclosure

| Strain Designation | SEQ ID No: | Deposit Accession # |
|---|---|---|
| Ascusbbf_11823C | 5472 | PTA-125050 |
| Ascusbbf_1007A | 5473 | PTA-125041 |
| Ascusbbf_24422A | 5474 | PTA-125051, PTA-125052 |
| Ascusbbf_951A | 5475 | PTA-124942, PTA-125042 |
| Ascusbbf_951B | 5476 | PTA-125033, PTA-125040, PTA-125041, PTA-125042, PTA-125049, PTA-125050, PTA-125051, PTA-125052 |
| Ascusbbf_951C | 5477 | PTA-125033, PTA-125040, PTA-125041, PTA-125042, PTA-125049, PTA-125050, PTA-125051, PTA-125052 |
| Ascusbbf_951D | 5478 | PTA-125033, PTA-125040, PTA-125041, PTA-125042, PTA-125049 |
| Ascusbbf_951E | 5479 | PTA-125033, PTA-125042, PTA-125051, PTA-125052 |
| Ascusbbf_951F | 5480 | PTA-125033 |
| Ascusbbf_951G | 5481 | PTA-125033 |
| Ascusbbf_5699A | 5482 | PTA-125049, PTA-125050 |
| Ascusbbf_5699B | 5483 | PTA-125049, PTA-125050 |
| Ascusbbf_5699C | 5484 | PTA-125049, PTA-125050 |
| Ascusbbf_5699D | 5485 | PTA-125050, PTA-125051 |
| Ascusbbf_130A | 5486 | PTA-125049, PTA-125050, PTA-125051, PTA-125052 |
| Ascusbbf_130B | 5487 | PTA-125049 |
| Ascusbbf_130C | 5488 | PTA-125049, PTA-125050 |
| Ascusbbf_130D | 5489 | PTA-125049, PTA-125050 |
| Ascusbbf_130E | 5490 | PTA-125049 |
| Ascusbbf_130F | 5491 | PTA-125049, PTA-125050 |
| Ascusbbf_130G | 5492 | PTA-125051 |
| Ascusbbf_10109A | 5493 | PTA-124942 |
| Ascusbbf_10109B | 5494 | PTA-124942 |
| Ascusbbf_10109C | 5495 | PTA-125033, PTA-125049 |
| Ascusbbf_10109D | 5496 | PTA-125049 |
| Ascusbbf_10109E | 5497 | PTA-125049, PTA-125050 |
| Ascusbbf_10109F | 5498 | PTA-125049 |
| Ascusbbf_10109G | 5499 | PTA-125049, PTA-125052 |
| Ascusbbf_10109H | 5500 | PTA-125049, PTA-125050 |
| Ascusbbf_10109I | 5501 | PTA-125050 |
| Ascusbbf_29797A | 5502 | PTA-125051 |
| Ascusbbf_54068A | 5503 | PTA-124942 |
| Ascusbbf_54068B | 5504 | PTA-125033 |
| Ascusbbf_54068C | 5505 | PTA-125033, PTA-125040, PTA-125041, PTA-125042, PTA-125049 |
| Ascusbbf_54068D | 5506 | PTA-125033, PTA-125041, PTA-125042, PTA-125049, PTA-125050 |
| Ascusbbf_7003A | 5507 | PTA-124942 |
| Ascusbbf_7003C | 5508 | PTA-125033 |
| Ascusbbf_23A | 5509 | PTA-125051, PTA-125052 |
| Ascusbbf_1697A | 5510 | PTA-125049 |
| Ascusbbf_1697B | 5511 | PTA-125050 |
| Ascusbbf_1697C | 5512 | PTA-125050 |
| Ascusbbf_7586A | 5513 | PTA-125041 |
| Ascusbbf_7586B | 5514 | PTA-125041, PTA-125042, PTA-125050 |
| Ascusbbf_7586C | 5515 | PTA-125041, PTA-125042, PTA-125050 |
| Ascusbbf_7586D | 5516 | PTA-125042 |
| Ascusbbf_1034A | 5517 | PTA-125051, PTA-125052 |
| Ascusbbf_1034B | 5518 | PTA-125051 |
| Ascusbbf_23134A | 5519 | PTA-125049 |
| Ascusbbf_43679A | 5520 | PTA-125040, PTA-125041, PTA-125050 |
| Ascusbbf_43679B | 5521 | PTA-125041 |
| Ascusbbf_43679C | 5522 | PTA-125041 |
| Ascusbbf_43679D | 5523 | PTA-125041 |
| Ascusbbf_43679E | 5524 | PTA-125041, PTA-125050 |
| Ascusbbf_43679F | 5525 | PTA-125050 |
| Ascusbbf_63954A | 5526 | PTA-125049 |
| Ascusbbf_1517A | 5527 | PTA-125033, PTA-125040, PTA-125041, PTA-125042, PTA-125051, PTA-125052 |
| Ascusbbf_1517B | 5528 | PTA-125040, PTA-125041, PTA-125042, PTA-125051, PTA-125052 |
| Ascusbbf_1517C | 5529 | PTA-125040, PTA-125042, PTA-125049, PTA-125050, PTA-125051 |
| Ascusbbf_1517D | 5530 | PTA-125033, PTA-125040, PTA-125042, PTA-125049, PTA-125050, PTA-125051, PTA-125052 |
| Ascusbbf_1517E | 5531 | PTA-125033, PTA-125041, PTA-125050 |
| Ascusbbf_1517F | 5532 | PTA-125042 |
| Ascusbbf_1517G | 5533 | PTA-125042 |
| Ascusbbf_1517H | 5534 | PTA-125042 |
| Ascusbbf_15171 | 5535 | PTA-125049 |
| Ascusbbf_104A | 5536 | PTA-124942 |
| Ascusbbf_104B | 5537 | PTA-125040, PTA-125042, PTA-125049, PTA-125050 |
| Ascusbbf_104C | 5538 | PTA-125040, PTA-125042, PTA-125049, PTA-125050 |
| Ascusbbf_104D | 5539 | PTA-125040 |
| Ascusbbf_104E | 5540 | PTA-125040, PTA-125041, PTA-125042 |
| Ascusbbf_104F | 5541 | PTA-125033, PTA-125042 |
| Ascusbbf_104G | 5542 | PTA-125050 |
| Ascusbbf_104H | 5543 | PTA-125042 |
| Ascusbbf_104I | 5544 | PTA-125042 |
| Ascusbbf_148A | 5545 | PTA-125049, PTA-125051, PTA-125052 |
| Ascusbbf_148B | 5546 | PTA-125049, PTA-125051 |
| Ascusbbf_148C | 5547 | PTA-125049, PTA-125050, PTA-125051, PTA-125052 |
| Ascusbbf_148D | 5548 | PTA-125051, PTA-125052 |
| Ascusbbf_148E | 5549 | PTA-125051, PTA-125052 |
| Ascusbbf_148F | 5550 | PTA-125051, PTA-125052 |
| Ascusbbf_148G | 5551 | PTA-125051 |
| Ascusbbf_148H | 5552 | PTA-125051 |
| Ascusbbf_944A | 5553 | PTA-124942 |
| Ascusbbf_944B | 5554 | PTA-125041, PTA-125049, PTA-125051, PTA-125052 |
| Ascusbbf_944C | 5555 | PTA-125049, PTA-125051 |
| Ascusbbf_944D | 5556 | PTA-125049, PTA-125050 |
| Ascusbbf_944E | 5557 | PTA-125049 |
| Ascusbbf_944F | 5558 | PTA-125049 |
| Ascusbbf_944G | 5559 | PTA-125049, PTA-125051, PTA-125052 |
| Ascusbbf_23033A | 5560 | PTA-125051, PTA-125052 |
| Ascusbbf_23033B | 5561 | PTA-125051, PTA-125052 |
| Ascusbbf_23033C | 5562 | PTA-125051, PTA-125052 |
| Ascusbbf_23033D | 5563 | PTA-125051 |
| Ascusbbf_2600A | 5564 | PTA-124942 |
| Ascusbbf_2600B | 5565 | PTA-125033, PTA-125040, PTA-125041, PTA-125042 |
| Ascusbbf_2600C | 5566 | PTA-125033, PTA-125040, PTA-125041, PTA-125042 |
| Ascusbbf_2600D | 5567 | PTA-125041 |
| Ascusbbf_2600E | 5568 | PTA-125033, PTA-125041 |
| Ascusbbf_2600F | 5569 | PTA-125033, PTA-125041 |
| Ascusbbf_2600G | 5570 | PTA-125041 |
| Ascusbbf_2600H | 5571 | PTA-125042 |
| Ascusbbf_8118A | 5572 | PTA-125051, PTA-125052 |
| Ascusbbf_8118B | 5573 | PTA-125051 |
| Ascusbbf_201A | 5574 | PTA-125042 |
| Ascusbbf_201J | 5575 | PTA-125033, PTA-125042, PTA-125049 |
| Ascusbbf_20IK | 5576 | PTA-125042, PTA-125049, PTA-125051, PTA-125052 |
| Ascusbbf_20IL | 5577 | PTA-125042, PTA-125052 |
| Ascusbbf_10712A | 5578 | PTA-124942, PTA-125033, PTA-125042, PTA-125050 |
| Ascusbbf_10712B | 5579 | PTA-124942 |
| Ascusbbf_10712C | 5580 | PTA-125033, PTA-125042, PTA-125049 |
| Ascusbbf_10712D | 5581 | PTA-125033, PTA-125042 |
| Ascusbbf_10712E | 5582 | PTA-125042, PTA-125049 |

TABLE 2-continued

Deposited Microbes of the present disclosure

| Strain Designation | SEQ ID No: | Deposit Accession # |
|---|---|---|
| Ascusbbf_10712F | 5583 | PTA-125033, PTA-125042, PTA-125050 |
| Ascusbbf_10712G | 5584 | PTA-125033, PTA-125042, PTA-125049, PTA-125050, PTA-125052 |
| Ascusbbf_10712H | 5585 | PTA-125033, PTA-125042, PTA-125049, PTA-125050, PTA-125052 |
| Ascusbbf_10712I | 5586 | PTA-125042, PTA-125050 |
| Ascusbbf_6012A | 5587 | PTA-124942 |
| Ascusbbf_6012B | 5588 | PTA-125040, PTA-125041, PTA-125049, PTA-125050 |
| Ascusbbf_6012C | 5589 | PTA-125040, PTA-125041, PTA-125049, PTA-125050 |
| Ascusbbf_6012D | 5590 | PTA-125041, PTA-125049 |
| Ascusbbf_6012E | 5591 | PTA-125041 |
| Ascusbbf_2297A | 5592 | PTA-125049, PTA-125050, PTA-125051 |
| Ascusbbf_2297B | 5593 | PTA-125049, PTA-125051 |
| Ascusbbf_2297C | 5594 | PTA-125049, PTA-125051, PTA-125052 |
| Ascusbbf_2297D | 5595 | PTA-125049, PTA-125051, PTA-125052 |
| Ascusbbf_2297E | 5596 | PTA-125049, PTA-125051, PTA-125052 |
| Ascusbbf_2297F | 5597 | PTA-125051, PTA-125052 |
| Ascusbbf_2297G | 5598 | PTA-125051, PTA-125052 |
| Ascusbbf_2297H | 5599 | PTA-125051 |
| Ascusbbf_873A | 5600 | PTA-125033 |
| Ascusbbf_873B | 5601 | PTA-125033, PTA-125041, PTA-125042, PTA-125049, PTA-125050, PTA-125052 |
| Ascusbbf_873C | 5602 | PTA-125040, PTA-125041, PTA-125042, PTA-125050 |
| Ascusbbf_873D | 5603 | PTA-125041, PTA-125042, PTA-125050 |
| Ascusbbf_873E | 5604 | PTA-125033, PTA-125041, PTA-125042, PTA-125049, PTA-125050 |
| Ascusbbf_873F | 5605 | PTA-125033, PTA-125041, PTA-125042, PTA-125052 |
| Ascusbbf_873G | 5606 | PTA-125042 |
| Ascusbbf_269A | 5607 | PTA-125033, PTA-125041, PTA-125042, PTA-125050 |
| Ascusbbf_269B | 5608 | PTA-125033 |
| Ascusbbf_269C | 5609 | PTA-125033, PTA-125042 |
| Ascusbbf_269D | 5610 | PTA-125041, PTA-125050 |
| Ascusbbf_269E | 5611 | PTA-125033, PTA-125041, PTA-125050 |
| Ascusbbf_269F | 5612 | PTA-125033 |
| Ascusbbf_269G | 5613 | PTA-125033 |
| Ascusbbf_41015A | 5614 | PTA-125033, PTA-125041, PTA-125050 |
| Ascusbbf_41015B | 5615 | PTA-125033 |
| Ascusbbf_41015C | 5616 | PTA-125041 |
| Ascusbbf_41015D | 5617 | PTA-125042 |
| Ascusbbf_41015E | 5618 | PTA-125042 |
| Ascusbbf_32877A | 5619 | PTA-124942 |
| Ascusbbf_57294A | 5620 | PTA-124942, PTA-125041 |
| Ascusbbf_57294B | 5621 | PTA-125033, PTA-125050 |
| Ascusbbf_57294C | 5622 | PTA-125033, PTA-125052 |
| Ascusbbf_27932A | 5623 | PTA-125040 |
| Ascusbbf_27932B | 5624 | PTA-125040, PTA-125041, PTA-125050 |
| Ascusbbf_27932C | 5625 | PTA-125040, PTA-125049, PTA-125052 |
| Ascusbbf_22558A | 5626 | PTA-125051 |
| Ascusbbf_22558B | 5627 | PTA-125051 |
| Ascusbbf_983757A | 5628 | PTA-125051, PTA-125052 |
| Ascusbbf_983757B | 5629 | PTA-125051, PTA-125052 |
| Ascusbbf_983757C | 5630 | PTA-125051, PTA-125052 |
| Ascusbbf_52330A | 5631 | PTA-125033 |
| Ascusbbf_1085A | 5632 | PTA-124942, PTA-125033, PTA-125041, PTA-125049, PTA-125050 |
| Ascusbbf_1085B | 5633 | PTA-125033, PTA-125042, PTA-125050, PTA-125051, B-67554 |
| Ascusbbf_1085C | 5634 | PTA-125033, PTA-125040, PTA-125041, PTA-125042, PTA-125049, PTA-125050, PTA-125051, PTA-125052 |
| Ascusbbf_1085D | 5635 | PTA-125040, PTA-125041, PTA-125042, PTA-125049, PTA-125050, PTA-125052 |
| Ascusbbf_1085E | 5636 | PTA-125033, PTA-125040, PTA-125041, PTA-125042, PTA-125049, PTA-125050, PTA-125052 |
| Ascusbbf_1085F | 5637 | PTA-125033, PTA-125049, PTA-125051, PTA-125052 |
| Ascusbbf_1085G | 5638 | PTA-125033, PTA-125050 |
| Ascusbbf_1085H | 5639 | PTA-125033, PTA-125050 |
| Ascusbbf_1085I | 5640 | PTA-125033, PTA-125050 |
| Ascusbbf_1085J | 5641 | PTA-125033, PTA-125042 |
| Ascusbbf_1085K | 5642 | PTA-125042 |
| Ascusbbf_154A | 5643 | PTA-124942 |
| Ascusbbf_154B | 5644 | PTA-125042, PTA-125049, PTA-125050, PTA-125051, B-67550 |
| Ascusbbf_154D | 5645 | PTA-125040, PTA-125041, PTA-125042, PTA-125051 |
| Ascusbbf_154E | 5646 | PTA-125040, PTA-125041, PTA-125049, PTA-125050, PTA-125052 |
| Ascusbbf_154F | 5647 | PTA-125033, PTA-125040, PTA-125041, PTA-125042, PTA-125049, PTA-125050, PTA-125052 |
| Ascusbbf_154G | 5648 | PTA-125033, PTA-125041, PTA-125042, PTA-125049, PTA-125050, PTA-125051, PTA-125052 |
| Ascusbbf_154H | 5649 | PTA-125049, PTA-125050 |
| Ascusbbf_154I | 5650 | PTA-125049, PTA-125050 |
| Ascusbbf_154M | 5651 | PTA-125042 |
| Ascusbbf_1010A | 5652 | PTA-124942 |
| Ascusbbf_1010B | 5653 | PTA-125033, PTA-125040, PTA-125041, PTA-125042, PTA-125049, PTA-125050, PTA-125051, PTA-125052 |
| Ascusbbf_1010C | 5654 | PTA-125040, PTA-125041, PTA-125042, PTA-125049, PTA-125050, PTA-125051, PTA-125052 |
| Ascusbbf_1010D | 5655 | PTA-125033, PTA-125040, PTA-125041, PTA-125042, PTA-125049, PTA-125050, PTA-125051, PTA-125052 |
| Ascusbbf_1010E | 5656 | PTA-125033, PTA-125040, PTA-125041, PTA-125042, PTA-125052 |
| Ascusbbf_1010F | 5657 | PTA-125033, PTA-125040, PTA-125041, PTA-125052 |
| Ascusbbf_1010G | 5658 | PTA-125033, PTA-125040, PTA-125041, PTA-125042, PTA-125049, PTA-125050, PTA-125051, PTA-125052 |
| Ascusbbf_1010H | 5659 | PTA-125033, PTA-125041 |
| Ascusbbf_1010I | 5660 | PTA-125033, PTA-125041, PTA-125051 |
| Ascusbbf_1010J | 5661 | PTA-125041, PTA-125050, PTA-125052 |
| Ascusbbf_5575A | 5662 | PTA-124942 |
| Ascusbbf_5575B | 5663 | PTA-124942 |
| Ascusbbf_5575C | 5664 | PTA-125033, PTA-125042, PTA-125050 |
| Ascusbbf_5575D | 5665 | PTA-125042, PTA-125050 |
| Ascusbbf_5575E | 5666 | PTA-125033, PTA-125042, PTA-125049, PTA-125052 |
| Ascusbbf_5575F | 5667 | PTA-125033, PTA-125042, PTA-125049 |

TABLE 2-continued

Deposited Microbes of the present disclosure

| Strain Designation | SEQ ID No: | Deposit Accession # |
|---|---|---|
| Ascusbbf_5575G | 5668 | PTA-125033, PTA-125042, PTA-125049, PTA-125050 |
| Ascusbbf_5575H | 5669 | PTA-125033, PTA-125042, PTA-125050 |
| Ascusbbf_775A | 5670 | PTA-125049, PTA-125050, PTA-125051, PTA-125052 |
| Ascusbbf_775B | 5671 | PTA-125051 |
| Ascusbbf_24302A | 5672 | PTA-125041, PTA-125050, B-67551 |
| Ascusbbf_24302B | 5673 | PTA-125033, PTA-125040, PTA-125041, PTA-125049 |
| Ascusbbf_24302C | 5674 | PTA-125033, PTA-125040, PTA-125041, PTA-125051, PTA-125052 |
| Ascusbbf_24302D | 5675 | PTA-125041, PTA-125049 |
| Ascusbbf_24302E | 5676 | PTA-125033, PTA-125041, PTA-125052 |
| Ascusbbf_24302F | 5677 | PTA-125033, PTA-125041, PTA-125042, PTA-125049, PTA-125050, PTA-125052 |
| Ascusbbf_24302G | 5678 | PTA-125033, PTA-125041, PTA-125049, PTA-125050, PTA-125051, PTA-125052 |
| Ascusbbf_24302H | 5679 | PTA-125041, PTA-125052 |
| Ascusbbf_24302I | 5680 | PTA-125041, PTA-125050, PTA-125051, PTA-125052 |
| Ascusbbf_24302J | 5681 | PTA-125051, PTA-125052 |
| Ascusbbf_1A | 5682 | PTA-125040, PTA-125041, PTA-125042, PTA-125052 |
| Ascusbbf_1B | 5683 | PTA-125040, PTA-125041, PTA-125042, PTA-125049, PTA-125050, PTA-125052 |
| Ascusbbf_1C | 5684 | PTA-125040, PTA-125041, PTA-125042, PTA-125050 |
| Ascusbbf_1D | 5685 | PTA-125033, PTA-125040, PTA-125041, PTA-125042, PTA-125049, PTA-125050, PTA-125051, PTA-125052 |
| Ascusbbf_1E | 5686 | PTA-125033, PTA-125040, PTA-125042 |
| Ascusbbf_1F | 5687 | PTA-125033, PTA-125040, PTA-125041, PTA-125042, PTA-125050, PTA-125051, PTA-125052 |
| Ascusbbf_1G | 5688 | PTA-125033, PTA-125040, PTA-125041, PTA-125042, PTA-125049, PTA-125050, PTA-125052 |
| Ascusbbf_1H | 5689 | PTA-125033, PTA-125040, PTA-125041, PTA-125050 |
| Ascusbbf_1I | 5690 | PTA-125033, PTA-125040, PTA-125041, PTA-125042, PTA-125050, PTA-125052 |
| Ascusbbf_1J | 5691 | PTA-125033, PTA-125040, PTA-125041, PTA-125042, PTA-125049, PTA-125050 |
| Ascusbbf_1K | 5692 | PTA-125041, PTA-125042, PTA-125049, PTA-125050 |
| Ascusbbf_52548A | 5693 | PTA-125051, PTA-125052 |
| Ascusbbf_52548B | 5694 | PTA-125051, PTA-125052 |
| Ascusbbf_50658A | 5695 | PTA-125050 |
| Ascusbbf_850A | 5696 | PTA-124942 |
| Ascusbbf_850B | 5697 | PTA-125033 |
| Ascusbbf_850C | 5698 | PTA-125033, PTA-125040, PTA-125041, PTA-125049, PTA-125050 |
| Ascusbbf_850D | 5699 | PTA-125040 |
| Ascusbbf_850E | 5700 | PTA-125040, PTA-125041, PTA-125042, PTA-125049, PTA-125050 |
| Ascusbbf_850F | 5701 | PTA-125033, PTA-125040, PTA-125041, PTA-125042, PTA-125049, PTA-125050 |
| Ascusbbf_850G | 5702 | PTA-125033, PTA-125040, PTA-125041, PTA-125049, PTA-125050 |
| Ascusbbf_850H | 5703 | PTA-125033, PTA-125041, PTA-125050 |
| Ascusbbf_850I | 5704 | PTA-125033, PTA-125050 |
| Ascusbbf_850J | 5705 | PTA-125033, PTA-125042 |
| Ascusbbf_4A | 5706 | PTA-124942 |
| Ascusbbf_4B | 5707 | PTA-125040, PTA-125041, PTA-125042, PTA-125049, PTA-125050, PTA-125052 |
| Ascusbbf_4C | 5708 | PTA-125041, PTA-125052 |
| Ascusbbf_4D | 5709 | PTA-125040, PTA-125041, PTA-125042, PTA-125050, PTA-125051, PTA-125052, B-67552 |
| Ascusbbf_4E | 5710 | PTA-125040, PTA-125041, PTA-125050, PTA-125052 |
| Ascusbbf_4F | 5711 | PTA-125033, PTA-125040, PTA-125041, PTA-125042, PTA-125050, PTA-125051, PTA-125052 |
| Ascusbbf_4G | 5712 | PTA-125041, PTA-125042, PTA-125049, PTA-125050, PTA-125051, PTA-125052 |
| Ascusbbf_4H | 5713 | PTA-125041, PTA-125042, PTA-125049, PTA-125050, PTA-125051, PTA-125052 |
| Ascusbbf_4I | 5714 | PTA-125041, PTA-125049, PTA-125050, PTA-125052 |
| Ascusbbf_4J | 5715 | PTA-125041, PTA-125050 |
| Ascusbbf_4K | 5716 | PTA-125051 |
| Ascusbbf_5131A | 5717 | PTA-125049, PTA-125050, PTA-125051 |
| Ascusbbf_5131B | 5718 | PTA-125049, PTA-125051 |
| Ascusbbf_5131C | 5719 | PTA-125049, PTA-125051 |
| Ascusbbf_5131D | 5720 | PTA-125049, PTA-125051 |
| Ascusbbf_5131E | 5721 | PTA-125051, PTA-125052 |
| Ascusbbf_5131F | 5722 | PTA-125051 |
| Ascusbbf_5131G | 5723 | PTA-125051 |
| Ascusbbf_5131H | 5724 | PTA-125051 |
| Ascusbbf_8600A | 5725 | PTA-125051 |
| Ascusbbf_8600B | 5726 | PTA-125051 |
| Ascusbbf_1273A | 5727 | PTA-125049, PTA-125051, PTA-125052 |
| Ascusbbf_1273B | 5728 | PTA-125051 |
| Ascusbbf_1273C | 5729 | PTA-125051 |
| Ascusbbf_1273D | 5730 | PTA-125051 |
| Ascusbbf_39159A | 5731 | PTA-125041 |
| Ascusbbf_39159B | 5732 | PTA-125041 |
| Ascusbbf_39159C | 5733 | PTA-125050 |
| Ascusbbf_39159D | 5734 | PTA-125042 |
| Ascusbbf_318A | 5735 | PTA-125049, PTA-125050 |
| Ascusbbf_318B | 5736 | PTA-125049 |
| Ascusbbf_318C | 5737 | PTA-125049, PTA-125050 |
| Ascusbbf_318D | 5738 | PTA-125042, PTA-125050, PTA-125051 |
| Ascusbbf_318E | 5739 | PTA-125042, PTA-125050, PTA-125051, PTA-125052 |
| Ascusbbf_7046A | 5740 | PTA-125050 |
| Ascusbbf_1372985A | 5741 | PTA-124942, PTA-125041 |
| Ascusbbf_1372985B | 5742 | PTA-125033, PTA-125041, PTA-125042 |
| Ascusbbf_1372985C | 5743 | PTA-125033, PTA-125041 |
| Ascusbbf_1372985D | 5744 | PTA-125040, PTA-125041, PTA-125042, PTA-125049, PTA-125050 |
| Ascusbbf_1372985E | 5745 | PTA-125040, PTA-125041, PTA-125049, PTA-125050 |
| Ascusbbf_1372985F | 5746 | PTA-125041 |
| Ascusbbf_1372985G | 5980 | PTA-125033, PTA-125041 |
| Ascusbbf_1372985H | 5981 | PTA-125033, PTA-125041 |
| Ascusbbf_1372985I | 5747 | PTA-125033, PTA-125041 |
| Ascusbbf_1372985J | 5982 | PTA-125033, PTA-125041, PTA-125042, PTA-125051, PTA-125052 |
| Ascusbbf_1372985K | 5983 | PTA-125033, PTA-125041, PTA-125050, PTA-125051 |

TABLE 2-continued

Deposited Microbes of the present disclosure

| Strain Designation | SEQ ID No: | Deposit Accession # |
|---|---|---|
| Ascusbbf_1372985L | 5748 | PTA-125041 |
| Ascusbbf_1372985M | 5749 | PTA-125041 |
| Ascusbbf_1372985N | 5750 | PTA-125041 |
| Ascusbbf_1372985O | 5751 | PTA-125041 |
| Ascusbbf_1372985P | 5752 | PTA-125041 |
| Ascusbbf_1372985Q | 5753 | PTA-125041 |
| Ascusbbf_1372985R | 5754 | PTA-125041 |
| Ascusbbf_1372985S | 5755 | PTA-125041, PTA-125049, PTA-125050 |
| Ascusbbf_1372985T | 5756 | PTA-125041, PTA-125049, PTA-125050 |
| Ascusbbf_121971A | 5757 | PTA-125041 |
| Ascusbbf_5251A | 5758 | PTA-125033, PTA-125049, PTA-125050 |
| Ascusbbf_5251B | 5759 | PTA-125033, PTA-125041 |
| Ascusbbf_5251C | 5760 | PTA-125041, PTA-125049, PTA-125050, PTA-125051 |
| Ascusbbf_5251D | 5761 | PTA-125033, PTA-125041, PTA-125049 |
| Ascusbbf_5251E | 5762 | PTA-125049, PTA-125050, PTA-125051 |
| Ascusbbf_5251F | 5763 | PTA-125051, PTA-125052 |
| Ascusbbf_5251G | 5764 | PTA-125051 |
| Ascusbbf_100A | 5765 | PTA-125033, PTA-125049, PTA-125050, PTA-125052 |
| Ascusbbf_100B | 5766 | PTA-125040, PTA-125042 |
| Ascusbbf_100C | 5767 | PTA-125033, PTA-125040, PTA-125041, PTA-125042, PTA-125049, PTA-125050, PTA-125052 |
| Ascusbbf_100D | 5768 | PTA-125033, PTA-125040, PTA-125041, PTA-125050 |
| Ascusbbf_100E | 5769 | PTA-125033, PTA-125040, PTA-125041, PTA-125042, PTA-125049, PTA-125050 |
| Ascusbbf_100F | 5770 | PTA-125041 |
| Ascusbbf_100G | 5771 | PTA-125042 |
| Ascusbbf_20584A | 5772 | PTA-125049 |
| Ascusbbf_20584B | 5773 | PTA-125051, PTA-125052 |
| Ascusbbf_4317A | 5774 | PTA-125041 |
| Ascusbbf_4317B | 5775 | PTA-125041 |
| Ascusbbf_4317C | 5776 | PTA-125042 |
| Ascusbbf_4317D | 5777 | PTA-125051, PTA-125052 |
| Ascusbbf_4317E | 5778 | PTA-125051, PTA-125052 |
| Ascusbbf_6A | 5779 | PTA-125040, PTA-125041, PTA-125049, PTA-125050, PTA-125052 |
| Ascusbbf_6B | 5780 | PTA-125040, PTA-125041, PTA-125042, PTA-125049, PTA-125050, PTA-125052 |
| Ascusbbf_6C | 5781 | PTA-125040, PTA-125041, PTA-125042, PTA-125049, PTA-125050, PTA-125052 |
| Ascusbbf_6D | 5782 | PTA-125040, PTA-125041, PTA-125050, PTA-125052 |
| Ascusbbf_6E | 5783 | PTA-125040, PTA-125041, PTA-125042, PTA-125049, PTA-125050, PTA-125052 |
| Ascusbbf_6F | 5784 | PTA-125040, PTA-125052 |
| Ascusbbf_6G | 5785 | PTA-125040, PTA-125041, PTA-125042, PTA-125049, PTA-125050, PTA-125052 |
| Ascusbbf_6H | 5786 | PTA-125041, PTA-125042, PTA-125050 |
| Ascusbbf_6I | 5787 | PTA-125041, PTA-125050 |
| Ascusbbf_6J | 5788 | PTA-125041, PTA-125050 |
| Ascusbbf_6K | 5789 | PTA-125042 |
| Ascusbbf_6L | 5790 | PTA-125042 |
| Ascusbbf_19022A | 5791 | PTA-125033, PTA-125040, PTA-125041 |
| Ascusbbf_19022B | 5792 | PTA-125040, PTA-125041, PTA-125042, PTA-125050 |
| Ascusbbf_19022C | 5793 | PTA-125042, PTA-125052 |
| Ascusbbf_2624A | 5794 | PTA-125033, PTA-125041, PTA-125042, PTA-125051, PTA-125052 |
| Ascusbbf_2624B | 5795 | PTA-125041, PTA-125042, PTA-125050, PTA-125051, PTA-125052 |
| Ascusbbf_2624C | 5796 | PTA-125042, PTA-125051, PTA-125052 |
| Ascusbbf_2624D | 5797 | PTA-125042, PTA-125051, PTA-125052 |
| Ascusbbf_2624E | 5798 | PTA-125042, PTA-125051, PTA-125052 |
| Ascusbbf_2624F | 5799 | PTA-125051, PTA-125052 |
| Ascusbbf_2624G | 5800 | PTA-125051 |
| Ascusbbf_3427A | 5801 | PTA-125041, PTA-125049, PTA-125050 |
| Ascusbbf_3427B | 5802 | PTA-125041, PTA-125042, PTA-125049, PTA-125050, PTA-125051, PTA-125052 |
| Ascusbbf_3427C | 5803 | PTA-125042, PTA-125049, PTA-125050, PTA-125051 |
| Ascusbbf_3427D | 5804 | PTA-125050 |
| Ascusbbf_3427E | 5805 | PTA-125052 |
| Ascusbbf_5005A | 5806 | PTA-125049, PTA-125050, PTA-125051 |
| Ascusbbf_5005B | 5807 | PTA-125050 |
| Ascusbbf_69A | 5808 | PTA-125033, PTA-125040, PTA-125041, PTA-125042, PTA-125049, PTA-125050, PTA-125051, PTA-125052 |
| Ascusbbf_69B | 5809 | PTA-125033, PTA-125040, PTA-125041, PTA-125042, PTA-125049, PTA-125050, PTA-125051, PTA-125052 |
| Ascusbbf_69C | 5810 | PTA-125033, PTA-125040, PTA-125041, PTA-125042, PTA-125049, PTA-125050, PTA-125051, PTA-125052 |
| Ascusbbf_69D | 5811 | PTA-125033, PTA-125040, PTA-125041, PTA-125049, PTA-125050, PTA-125051, PTA-125052 |
| Ascusbbf_69E | 5812 | PTA-125033, PTA-125040, PTA-125041, PTA-125042, PTA-125049, PTA-125050, PTA-125051, PTA-125052 |
| Ascusbbf_69F | 5813 | PTA-125033, PTA-125040, PTA-125041, PTA-125042, PTA-125049, PTA-125050, PTA-125051, PTA-125052 |
| Ascusbbf_69G | 5814 | PTA 125033, PTA-125041, PTA-125042, PTA-125049, PTA-125050, PTA-125051, PTA-125052 |
| Ascusbbf_69H | 5815 | PTA-125033, PTA-125041, PTA-125042, PTA-125049, PTA-125050, PTA-125051, PTA-125052 |
| Ascusbbf_69I | 5816 | PTA-125033, PTA-125041, PTA-125042, PTA-125049, PTA-125051, PTA-125052 |
| Ascusbbf_69J | 5817 | PTA-125033, PTA-125051, PTA-125052 |
| Ascusbbf_8082A | 5818 | PTA-125033, PTA-125040, PTA-125041, PTA-125042, PTA-125050, PTA-125052 |
| Ascusbbf_8082B | 5819 | PTA-125040, PTA-125041, PTA-125042, PTA-125050 |
| Ascusbbf_8082C | 5820 | PTA-125033, PTA-125040, PTA-125041, PTA-125042, PTA-125050, PTA-125052 |
| Ascusbbf_8082D | 5821 | PTA-125033, PTA-125040, PTA-125041, PTA-125042, PTA-125050, PTA-125052 |
| Ascusbbf_8082E | 5822 | PTA-125033, PTA-125041 |
| Ascusbbf_8082F | 5823 | PTA-125033, PTA-125041, PTA-125042 |
| Ascusbbf_8082G | 5824 | PTA-125033, PTA-125042 |
| Ascusbbf_8082H | 5825 | PTA-125033, PTA-125042 |

TABLE 2-continued

Deposited Microbes of the present disclosure

| Strain Designation | SEQ ID No: | Deposit Accession # |
|---|---|---|
| Ascusbbf_8082I | 5826 | PTA-125033 |
| Ascusbbf_95A | 5827 | PTA-125049, PTA-125050 |
| Ascusbbf_95B | 5828 | PTA-125049, PTA-125050, PTA-125051, PTA-125052 |
| Ascusbbf_95C | 5829 | PTA-125049, PTA-125050 |
| Ascusbbf_95D | 5830 | PTA-125049, PTA-125050, PTA-125051, PTA-125052 |
| Ascusbbf_95E | 5831 | PTA-125051, PTA-125052 |
| Ascusbbf_95F | 5832 | PTA-125051, PTA-125052 |
| Ascusbbf_95G | 5833 | PTA-125051, PTA-125052 |
| Ascusbbf_95H | 5834 | PTA-125051 |
| Ascusbbf_1136A | 5835 | PTA-125040, PTA-125041, PTA-125042, PTA-125049, PTA-125050 |
| Ascusbbf_1136B | 5836 | PTA-125040, PTA-125041, PTA-125042, PTA-125049, PTA-125050, PTA-125052 |
| Ascusbbf_1136C | 5837 | PTA-125033, PTA-125040, PTA-125041, PTA-125042, PTA-125049, PTA-125050 |
| Ascusbbf_1136D | 5838 | PTA-125040, PTA-125041, PTA-125042, PTA-125049, PTA-125050, PTA-125052 |
| Ascusbbf_1136E | 5839 | PTA-125040, PTA-125041, PTA-125049, PTA-125050 |
| Ascusbbf_1136F | 5840 | PTA-125042 |
| Ascusbbf_2770A | 5841 | PTA-125042, PTA-125049, PTA-125050, PTA-125051 |
| Ascusbbf_2770B | 5842 | PTA-125049, PTA-125050 |
| Ascusbbf_2770C | 5843 | PTA-125049 |
| Ascusbbf_1629A | 5844 | PTA-125033 |
| Ascusbbf_1629B | 5845 | PTA-125040, PTA-125041 |
| Ascusbbf_1629C | 5846 | PTA-125040, PTA-125041, PTA-125042, PTA-125049, PTA-125050 |
| Ascusbbf_1629D | 5847 | PTA-125033, PTA-125040, PTA-125041, PTA-125049, PTA-125050 |
| Ascusbbf_1629E | 5848 | PTA-125041, PTA-125050 |
| Ascusbbf_1629F | 5849 | PTA-125050 |
| Ascusbbf_1629G | 5850 | PTA-125050 |
| Ascusbbf_1821A | 5851 | PTA-125049 |
| Ascusbbf_1821B | 5852 | PTA-125049, PTA-125050 |
| Ascusbbf_1821C | 5853 | PTA-125049, PTA-125050 |
| Ascusbbf_1821D | 5854 | PTA-125049, PTA-125050 |
| Ascusbbf_56782A | 5855 | PTA-125033, PTA-125041, PTA-125042, PTA-125049, PTA-125050, PTA-125051 |
| Ascusbbf_56782B | 5856 | PTA-125051 |
| Ascusbbf_56782C | 5857 | PTA-125051 |
| Ascusbbf_92A | 5858 | PTA-125040, PTA-125050 |
| Ascusbbf_92B | 5859 | PTA-125040, PTA-125041, PTA-125049, PTA-125050 |
| Ascusbbf_92C | 5860 | PTA-125040, PTA-125050 |
| Ascusbbf_92D | 5861 | PTA-125040, PTA-125049, PTA-125050, PTA-125052 |
| Ascusbbf_92E | 5862 | PTA-125040 |
| Ascusbbf_92F | 5863 | PTA-125040, PTA-125049, PTA-125050 |
| Ascusbbf_92G | 5984 | PTA-125041, PTA-125042 |
| Ascusbbf_92H | 5864 | PTA-125041, PTA-125049 |
| Ascusbbf_92I | 5985 | PTA-125041 |
| Ascusbbf_92J | 5986 | PTA-125041 |
| Ascusbbf_92K | 5865 | PTA-125041, PTA-125051, PTA-125052 |
| Ascusbbf_92L | 5866 | PTA-125050 |
| Ascusbbf_118A | 5867 | PTA-125049, PTA-125051 |
| Ascusbbf_118B | 5868 | PTA-125051, PTA-125052 |
| Ascusbbf_118C | 5869 | PTA-125051 |
| Ascusbbf_5429A | 5870 | PTA-125040, PTA-125041, PTA-125049, PTA-125050, PTA-125052 |
| Ascusbbf_5429B | 5871 | PTA-125040, PTA-125041, PTA-125049, PTA-125050, PTA-125052 |
| Ascusbbf_5429C | 5872 | PTA-125033, PTA-125042 |
| Ascusbbf_5429D | 5873 | PTA-125049 |
| Ascusbbf_3A | 5874 | PTA-125033, PTA-125040, PTA-125041, PTA-125049, PTA-125050, PTA-125052 |
| Ascusbbf_3B | 5875 | PTA-125040, PTA-125041, PTA-125049, PTA-125050, PTA-125052 |
| Ascusbbf_3C | 5876 | PTA-125040, PTA-125041, PTA-125049, PTA-125050 |
| Ascusbbf_3D | 5877 | PTA-125040 |
| Ascusbbf_3E | 5878 | PTA-125042 |
| Ascusbbf_3F | 5879 | PTA-125042 |
| Ascusbbf_3G | 5880 | PTA-125050 |
| Ascusbbf_10576A | 5881 | PTA-125049, PTA-125050, PTA-125051 |
| Ascusbbf_10576B | 5882 | PTA-125049, PTA-125050, PTA-125051, PTA-125052 |
| Ascusbbf_10576C | 5883 | PTA-125049, PTA-125050, PTA-125051 |
| Ascusbbf_10576D | 5884 | PTA-125049 |
| Ascusbbf_10576E | 5885 | PTA-125051 |
| Ascusbbf_729A | 5886 | PTA-125049, PTA-125051 |
| Ascusbbf_729B | 5887 | PTA-125051, PTA-125052 |
| Ascusbbf_729C | 5888 | PTA-125051 |
| Ascusbbf_729D | 5889 | PTA-125051 |
| Ascusbbf_729E | 5890 | PTA-125051 |
| Ascusbbf_729F | 5891 | PTA-125051 |
| Ascusbbf_201A | 5892 | PTA-125042 |
| Ascusbbf_201B | 5893 | PTA-125041, PTA-125042, PTA-125050, PTA-125051, PTA-125052 |
| Ascusbbf_201C | 5894 | PTA-125033 |
| Ascusbbf_201D | 5895 | PTA-125033, PTA-125041, PTA-125042, PTA-125051, PTA-125052 |
| Ascusbbf_201E | 5896 | PTA-125040, PTA-125041 |
| Ascusbbf_201F | 5897 | PTA-125040 |
| Ascusbbf_201G | 5898 | PTA-125033, PTA-125041, PTA-125050 |
| Ascusbbf_201H | 5899 | PTA-125033, PTA-125041, PTA-125042, PTA-125050 |
| Ascusbbf_201I | 5900 | PTA-125033, PTA-125041, PTA-125042, PTA-125050, PTA-125051, PTA-125052 |
| Ascusbbf_416A | 5901 | PTA-125049 |
| Ascusbbf_416B | 5902 | PTA-125049, PTA-125051, PTA-125052 |
| Ascusbbf_416C | 5903 | PTA-125049, PTA-125050 |
| Ascusbbf_416D | 5904 | PTA-125049, PTA-125050 |
| Ascusbbf_416E | 5905 | PTA-125049 |
| Ascusbbf_416F | 5906 | PTA-125049, PTA-125051 |
| Ascusbbf_416G | 5907 | PTA-125050 |
| Ascusbbf_15806A | 5908 | PTA-125049 |
| Ascusbbf_15806B | 5909 | PTA-125049, PTA-125051, PTA-125052 |
| Ascusbbf_6115A | 5910 | PTA-125033, PTA-125041 |
| Ascusbbf_6115B | 5911 | PTA-125041, PTA-125050 |
| Ascusbbf_6115C | 5912 | PTA-125041, PTA-125050 |
| Ascusbbf_6115D | 5913 | PTA-125041 |
| Ascusbbf_1325058A | 5914 | PTA-125041, PTA-125049, PTA-125051 |
| Ascusbbf_1325058B | 5915 | PTA-125041, PTA-125042, PTA-125049, PTA-125050, PTA-125051 |
| Ascusbbf_1325058C | 5916 | PTA-125049 |
| Ascusbbf_1325058D | 5917 | PTA-125049 |
| Ascusbbf_1325058E | 5918 | PTA-125050 |
| Ascusbbf_1325058F | 5919 | PTA-125051 |
| Ascusbbf_28350A | 5920 | PTA-125041, PTA-125050 |
| Ascusbbf_28350B | 5921 | PTA-125041, PTA-125050 |
| Ascusbbf_28350C | 5922 | PTA-125041, PTA-125050 |
| Ascusbbf_372A | 5923 | PTA-125033, PTA-125040, PTA-125041, PTA-125042, PTA-125049, PTA-125050, PTA-125052 |

TABLE 2-continued

Deposited Microbes of the present disclosure

| Strain Designation | SEQ ID No: | Deposit Accession # |
|---|---|---|
| Ascusbbf_372B | 5924 | PTA-125033 |
| Ascusbbf_372C | 5925 | PTA-125040, PTA-125041, PTA-125049, PTA-125050 |
| Ascusbbf_372D | 5926 | PTA-125033, PTA-125040, PTA-125041 |
| Ascusbbf_372E | 5927 | PTA-125033, PTA-125040, PTA-125041, PTA-125042, PTA-125049, PTA-125050 |
| Ascusbbf_372F | 5928 | PTA-125033, PTA-125041, PTA-125050 |
| Ascusbbf_372G | 5929 | PTA-125033, PTA-125042 |
| Ascusbbf_667A | 5930 | PTA-125042, PTA-125049, PTA-125050, PTA-125052 |
| Ascusbbf_667B | 5931 | PTA-125042, PTA-125049 |
| Ascusbbf_1207A | 5932 | PTA-125033, PTA-125042, PTA-125049, PTA-125050 |
| Ascusbbf_1207B | 5933 | PTA-125033, PTA-125042 |
| Ascusbbf_1207C | 5934 | PTA-125033 |
| Ascusbbf_1207D | 5935 | PTA-125040, PTA-125041 |
| Ascusbbf_1207E | 5936 | PTA-125040, PTA-125041 |
| Ascusbbf_1207F | 5937 | PTA-125040, PTA-125041, PTA-125042 |
| Ascusbbf_1207G | 5938 | PTA-125033, PTA-125040, PTA-125041, PTA-125042, PTA-125049, PTA-125050, PTA-125052 |
| Ascusbbf_1207H | 5939 | PTA-125033, PTA-125040 |
| Ascusbbf_1207I | 5940 | PTA-125033, PTA-125040, PTA-125041, PTA-125049, PTA-125050 |
| Ascusbbf_1207J | 5941 | PTA-125033, PTA-125042, PTA-125049 |
| Ascusbbf_3875A | 5942 | PTA-125033, PTA-125041, PTA-125042 |
| Ascusbbf_3875B | 5943 | PTA-125040, PTA-125042 |
| Ascusbbf_3875C | 5944 | PTA-125033, PTA-125041 |
| Ascusbbf_3875D | 5945 | PTA-125041 |
| Ascusbbf_72889A | 5946 | PTA-125051, PTA-125052 |
| Ascusbbf_72889B | 5947 | PTA-125051, PTA-125052 |
| Ascusbbf_106863A | 5948 | PTA-125051, PTA-125052 |
| Ascusbbf_106863B | 5949 | PTA-125051 |
| Ascusbbf_120A | 5987 | PTA-125051 |
| Ascusbbf_120B | 5950 | PTA-125051 |
| Ascusbbf_120C | 5951 | PTA-125051 |
| Ascusbbf_1207K | 5952 | PTA-125033, PTA-125049, PTA-125050 |
| Ascusbbf_1207L | 5953 | PTA-125049 |
| Ascusbbf_930A | 5954 | PTA-125051, PTA-125052 |
| Ascusbbf_930B | 5988 | PTA-125051 |
| Ascusbbf_915A | 5955 | PTA-125051 |
| Ascusbbf_8941A | 5956 | PTA-125051, PTA-125052 |
| Ascusbbf_8480A | 5989 | PTA-125051, PTA-125052 |
| Ascusbbf_8480B | 5957 | PTA-125051 |
| Ascusbbf_374A | 5990 | PTA-125051, PTA-125052 |
| Ascusbbf_374B | 5958 | PTA-125051, PTA-125052 |
| Ascusbbf_374C | 5991 | PTA-125051, PTA-125052 |
| Ascusbbf_6906A | 5959 | PTA-125051, PTA-125052 |
| Ascusbbf_6906B | 5960 | PTA-125051, PTA-125052 |
| Ascusbbf_6906C | 5992 | PTA-125051, PTA-125052 |
| Ascusbbf_6906D | 5961 | PTA-125051 |
| Ascusbbf_6906E | 5962 | PTA-125051 |
| Ascusbbf_69K | 5963 | PTA-125033, PTA-125042 |
| Ascusbbf_69L | 5993 | PTA-125033, PTA-125042 |
| Ascusbbf_69M | 5964 | PTA-125033, PTA-125042 |
| Ascusbbf_69N | 5965 | PTA-125033, PTA-125042 |
| Ascusbbf_69O | 5966 | PTA-125033, PTA-125042 |
| Ascusbbf_69P | 5967 | PTA-125033 |
| Ascusbbf_721A | 5968 | PTA-125051, PTA-125052 |
| Ascusbbf_721B | 5969 | PTA-125051, PTA-125052 |
| Ascusbbf_721C | 5970 | PTA-125051, PTA-125052 |
| Ascusbbf_3819A | 5971 | PTA-125051 |
| Ascusbbf_4323A | 5972 | PTA-125051, PTA-125052 |
| Ascusbbf_4323B | 5973 | PTA-125051, PTA-125052 |
| Ascusbbf_4323C | 5974 | PTA-125051, PTA-125052 |
| Ascusbbf_4323D | 5975 | PTA-125051 |
| Ascusbbf_6087A | 5976 | PTA-125051, PTA-125052 |
| Ascusbbf_6087B | 5977 | PTA-125051, PTA-125052 |
| Ascusbbf_6087C | 5978 | PTA-125051 |
| Ascusbbf_8414A | 5979 | PTA-125051 |

BRIEF DESCRIPTION OF THE FIGURES

FIG. 6 depicts the average ruminal VFA concentrations of high-RFI and low-RFI steers. More efficient animals tended to have a higher production of VFAs.

FIG. 11A and FIG. 11B depict the machine learning prediction accuracy utilized in the study. The residual feed intake (RFI) is predictive of serum metabolic signature (FIG. 11A) and the RFI is predictive of rumen microbiome signature (FIG. 11B).

In FIG. 21 reveals the comparison as to how much the microbial community changes week to week between high RFI animals and low RFI animals. The figure indicates that in week 4 the amount of change in the microbial communities is important to the RFI.

DETAILED DESCRIPTION

Definitions

Figure 1:
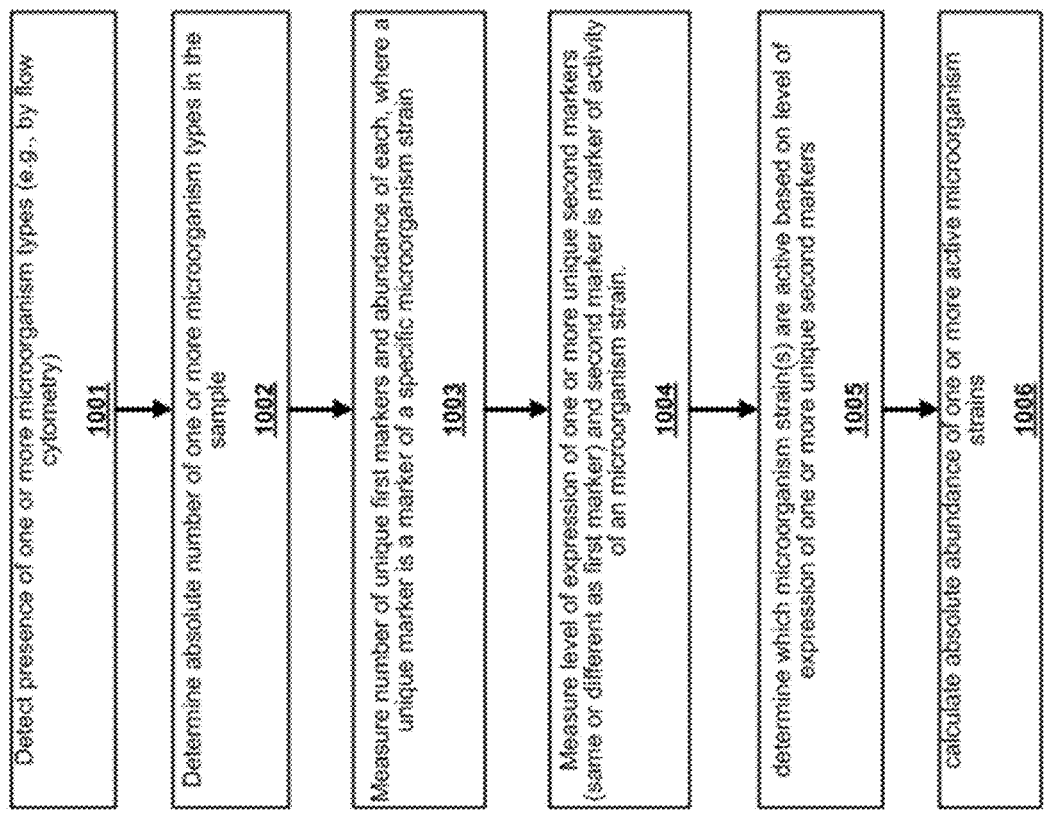
FIG. 1 shows a general workflow of one embodiment of the method for determining the absolute abundance of one or more active microorganism strains.

While the following terms are believed to be well understood by one of ordinary skill in the art, the following definitions are set forth to facilitate explanation of the presently disclosed subject matter.

The term "a" or "an" may refer to one or more of that entity, i.e. can refer to plural referents. As such, the terms "a" or "an", "one or more" and "at least one" are used interchangeably herein. In addition, reference to "an element" by the indefinite article "a" or "an" does not exclude the possibility that more than one of the elements is present, unless the context clearly requires that there is one and only one of the elements.

Reference throughout this specification to "one embodiment", "an embodiment", "one aspect", or "an aspect" means that a particular feature, structure or characteristic described in connection with the embodiment is included in at least one embodiment of the present disclosure. Thus, the appearances of the phrases "in one embodiment" or "in an embodiment" in various places throughout this specification are not necessarily all referring to the same embodiment. Furthermore, the particular features, structures, or characteristics can be combined in any suitable manner in one or more embodiments.

As used herein, in particular embodiments, the terms "about" or "approximately" when preceding a numerical value indicates the value plus or minus a range of 10%.

As used herein the terms "microorganism" or "microbe" should be taken broadly. These terms are used interchangeably and include, but are not limited to, the two prokaryotic domains, Bacteria and Archaea, eukaryotic fungi and protozoa, as well as viruses. In some embodiments, the disclosure refers to the "microbes" of Table 1 and/or Table 2, or the "microbes" incorporated by reference. This characterization can refer to not only the predicted taxonomic microbial identifiers of the table, but also the identified strains of the microbes listed in the table.

The term "microbial community" means a group of microbes comprising two or more species or strains. Unlike microbial ensemble, a microbial community does not have to be carrying out a common function, or does not have to be participating in, or leading to, or correlating with, a recognizable parameter, such as a phenotypic trait of interest (e.g. increased feed efficiency in beef cattle).

As used herein, "isolate," "isolated," "isolated microbe," and like terms, are intended to mean that the one or more microorganisms has been separated from at least one of the materials with which it is associated in a particular environment (for example soil, water, animal tissue).

Microbes of the present disclosure may include spores and/or vegetative cells. In some embodiments, microbes of the present disclosure include microbes in a viable but non-culturable (VBNC) state, or a quiescent state. See Liao and Zhao (US Publication US2015267163A1). In some embodiments, microbes of the present disclosure include microbes in a biofilm. See Merritt et al. (U.S. Pat. No. 7,427,408).

Thus, an "isolated microbe" does not exist in its naturally occurring environment; rather, it is through the various techniques described herein that the microbe has been removed from its natural setting and placed into a non-naturally occurring state of existence. Thus, the isolated strain or isolated microbe may exist as, for example, a biologically pure culture, or as spores (or other forms of the strain) in association with an acceptable carrier.

As used herein, "spore" or "spores" refer to structures produced by bacteria and fungi that are adapted for survival and dispersal. Spores are generally characterized as dormant structures; however, spores are capable of differentiation through the process of germination. Germination is the differentiation of spores into vegetative cells that are capable of metabolic activity, growth, and reproduction. The germination of a single spore results in a single fungal or bacterial vegetative cell. Fungal spores are units of asexual reproduction, and in some cases are necessary structures in fungal life cycles. Bacterial spores are structures for surviving conditions that may ordinarily be nonconductive to the survival or growth of vegetative cells.

As used herein, "microbial composition" refers to a composition comprising one or more microbes of the present disclosure, wherein a microbial composition, in some embodiments, is administered to animals of the present disclosure.

As used herein, "carrier", "acceptable carrier", or "pharmaceutical carrier" refers to a diluent, adjuvant, excipient, or vehicle with which the compound is administered. Such carriers can be sterile liquids, such as water and oils, including those of petroleum, animal, vegetable, or synthetic origin; such as peanut oil, soybean oil, mineral oil, sesame oil, and the like. Water or aqueous solution saline solutions and aqueous dextrose and glycerol solutions are preferably employed as carriers, in some embodiments as injectable solutions. In some embodiments, gelling agents are employed as carriers. Alternatively, the carrier can be a solid dosage form carrier, including but not limited to one or more of a binder (for compressed pills), a glidant, an encapsulating agent, a flavorant, and a colorant. The choice of carrier can be selected with regard to the intended route of administration and standard pharmaceutical practice. See Hardee and Baggo (1998. Development and Formulation of Veterinary Dosage Forms. $2^{nd}$ Ed. CRC Press. 504 pg.); E. W. Martin (1970. Remington's Pharmaceutical Sciences. $17^{th}$ Ed. Mack Pub. Co.); and Blaser et al. (US Publication US20110280840A1).

In some aspects, carriers may be granular in structure, such as sand or sand particles. In further aspects, the carriers may be dry, as opposed to a moist or wet carrier. In some aspects, carriers can be nutritive substances and/or prebiotic substances selected from fructo-oligosaccharides, inulins, isomalto-oligosaccharides, lactitol, lactosucruse, lactulose, pyrodextrines, soy oligosaccharides, transgalacto-oligosaccharides, xylo-oligosaccharides, trace minerals, and vitamins. In some aspects, carriers can be in solid or liquid form.

In some aspects, carriers can be zeolites, calcium carbonate, magnesium carbonate, silicon dioxide, ground corn, trehalose, chitosan, shellac, albumin, starch, skim-milk powder, sweet-whey powder, maltodextrin, lactose, and inulin. In some aspects, a carrier is water or physiological saline.

The term "bioensemble," "microbial ensemble," or "synthetic ensemble" refers to a composition comprising one or more active microbes identified by methods, systems, and/or apparatuses of the present disclosure and that do not naturally exist in a naturally occurring environment and/or at ratios or amounts that do not exist in nature. A bioensemble is a subset of a microbial community of individual microbial species, or strains of a species, which can be described as carrying out a common function, or can be described as participating in, or leading to, or correlating with, a recognizable parameter, such as a phenotypic trait of interest (e.g. increased feed efficiency in feedlot cattle). The bioensemble may comprise two or more species, or strains of a species, of microbes. In some instances, the microbes coexist within the community symbiotically.

In certain aspects of the disclosure, the isolated microbes exist as isolated and biologically pure cultures. It will be appreciated by one of skill in the art, that an isolated and biologically pure culture of a particular microbe, denotes that said culture is substantially free (within scientific reason) of other living organisms and contains only the individual microbe in question. The culture can contain varying concentrations of said microbe. The present disclosure notes that isolated and biologically pure microbes often "necessarily differ from less pure or impure materials." See, e.g. *In re Bergstrom,* 427 F.2d 1394, (CCPA 1970)(discussing purified prostaglandins), see also, *In re Bergy,* 596 F.2d 952 (CCPA 1979)(discussing purified microbes), see also, *Parke-Davis & Co. v. H. K. Mulford & Co.,* 189 F. 95 (S.D.N.Y. 1911) (Learned Hand discussing purified adrenaline), *aff'd in part, rev'd in part,* 196 F. 496 (2d Cir. 1912), each of which are incorporated herein by reference. Furthermore, in some aspects, the disclosure provides for certain quantitative measures of the concentration, or purity limitations, that must be found within an isolated and biologically pure microbial culture. The presence of these purity values, in certain embodiments, is a further attribute that distinguishes the presently disclosed microbes from those microbes existing in a natural state. See, e.g., *Merck & Co. v. Olin Mathieson Chemical Corp.,* 253 F.2d 156 (4th Cir. 1958) (discussing purity limitations for vitamin B12 produced by microbes), incorporated herein by reference.

As used herein, "individual isolates" should be taken to mean a composition, or culture, comprising a predominance of a single genera, species, or strain, of microorganism, following separation from one or more other microorganisms. The phrase should not be taken to indicate the extent to which the microorganism has been isolated or purified. However, "individual isolates" can comprise substantially only one genus, species, or strain, of microorganism.

As used herein, "microbiome" refers to the collection of microorganisms that inhabit the digestive tract or gastrointestinal tract of an animal (including the rumen if said animal is a ruminant) and the microorganism's physical environment (i.e. the microbiome has a biotic and physical component). The microbiome is fluid and may be modulated by numerous naturally occurring and artificial conditions (e.g., change in diet, disease, antimicrobial agents, influx of additional microorganisms, etc.). The modulation of the microbiome of a rumen that can be achieved via administration of the compositions of the disclosure, can take the form of: (a) increasing or decreasing a particular Family, Genus, Species, or functional grouping of microbe (i.e. alteration of the biotic component of the rumen microbiome) and/or (b) increasing or decreasing volatile fatty acids in the rumen, increasing or decreasing rumen pH, increasing or decreasing any other physical parameter important for rumen health (i.e. alteration of the abiotic component of the rumen microbiome).

As used herein, "probiotic" refers to a substantially pure microbe (i.e., a single isolate) or a mixture of desired microbes, and may also include any additional components that can be administered to beef cattle for restoring microbiota. Probiotics or microbial inoculant compositions of the disclosure may be administered with an agent to allow the microbes to survive the environment of the gastrointestinal tract, i.e., to resist low pH and to grow in the gastrointestinal environment. In some embodiments, the present compositions (e.g., microbial compositions) are probiotics in some aspects.

As used herein, "prebiotic" refers to an agent that increases the number and/or activity of one or more desired microbes. Non-limiting examples of prebiotics that may be useful in the methods of the present disclosure include fructooligosaccharides (e.g., oligofructose, inulin, inulin-type fructans), galactooligosaccharides, amino acids, alcohols, and mixtures thereof. See Ramirez-Farias et al. (2008. *Br. J. Nutr.* 4:1-10) and Pool-Zobel and Sauer (2007. *J. Nutr.* 137:2580-2584 and supplemental).

The term "growth medium" as used herein, is any medium which is suitable to support growth of a microbe. By way of example, the media may be natural or artificial including gastrin supplemental agar, LB media, blood serum, and tissue culture gels. It should be appreciated that the media may be used alone or in combination with one or more other media. It may also be used with or without the addition of exogenous nutrients.

The term "relative abundance" as used herein, is the number or percentage of a microbe present in the gastrointestinal tract or other organ system, relative to the number or percentage of total microbes present in said tract or organ system. The relative abundance may also be determined for particular types of microbes such as bacteria, fungi, viruses, and/or protozoa, relative to the total number or percentage of bacteria, fungi, viruses, and/or protozoa present. In one embodiment, relative abundance is determined by PCR. In another embodiment, relative abundance is determined by colony forming unit assays (cfu) or plaque forming unit assays (pfu) performed on samples from the gastrointestinal tract or other organ system of interest.

The medium may be amended or enriched with additional compounds or components, for example, a component which may assist in the interaction and/or selection of specific groups of microorganisms. For example, antibiotics (such as penicillin) or sterilants (for example, quaternary ammonium salts and oxidizing agents) could be present and/or the physical conditions (such as salinity, nutrients (for example organic and inorganic minerals (such as phosphorus, nitrogenous salts, ammonia, potassium and micronutrients such as cobalt and magnesium), pH, and/or temperature), methionine, prebiotics, ionophores, and beta glucans could be amended.

As used herein, the term "ruminant" includes mammals that are capable of acquiring nutrients from plant-based food by fermenting it in a specialized stomach (rumen) prior to digestion, principally through microbial actions. Ruminants included cattle, goats, sheep, giraffes, yaks, deer, antelope, and others.

As used herein, the term "bovid" includes any member of family Bovidae, which include hoofed mammals such as antelope, sheep, goats, and cattle, among others.

As used herein, the term "steer" includes any member, species, variant, or hybrid of *Bos indicus, Bos taurus indicus*, or *Bos taurus taurus*. The term "steer" further includes reference to cow (mature female), steer (castrated male), heifer (immature female not having born offspring), bull (mature uncastrated male), and calve (immature males or females).

As used herein, the terms "beef cattle" and "feedlot cattle" are used synonymously to refer to cattle that are grown and utilized for the production of beef. Said cattle of the present disclosure include varieties such as the following: Africander, Angus, Aubrac, Barzona, Bazadaise, Beef Shorthorn, Beefalo, Beefmaster, Belgian Blue, Belmont Red, Belted Galloway, Black Angus, Blonde d'Aquitaine, Bonsmara, Boran, Bradford, Brahman, Brahmousin, Brangus, British White, Buelingo, Canchim, Caracu, Charolais, Chianina, Composite, Corriente, Devon, Dexter, Drakensberger, Droughtmaster, English Longhorn, Galloway, Gelbvieh, Gloucester, Hays Converter, Hereford, Highland, Holstein, Hybridmaster, Limousin, Lincoln Red, Lowline, Luing, Maine-Anjou, Rouge des Pres, Marchigiana, Miniature Hereford, Mirandesa, Mongolian, Murray Grey, Nelore, Nguni, Parthenais, Piemontese, Pinzgauer, Red Angus, Red Poll, Retinta, Romagnola, Salers, Sanganer, Santa Cruz, Santa Gertrudis, Senepol, Shetland, Simbrah, Simmental, South Devon, Speckle Park, Square Meaters, Sussex, Tarentaise, Texas Longhorn, Tuli, Wagyu, Watusi, Welsh Black, Whitebred Shorthorn, and Zebu; or hybrids and/or crosses thereof.

As used herein, "dairy cattle" or "dairy cows" are used synonymously to refer to cows that are grown and utilized for the production of milk.

As used herein, "performance" should be taken to be increased weight gain, improved feed efficiency, improved residual feed intake, improved feed intake.

As used herein, "improved" should be taken broadly to encompass improvement of a characteristic of interest, as compared to a control group, or as compared to a known average quantity associated with the characteristic in question. For example, "improved" feed efficiency associated with application of a beneficial microbe, or microbial ensemble, of the disclosure can be demonstrated by comparing the feed efficiency of beef cattle treated by the microbes taught herein to the feed efficiency of beef cattle not treated. In the present disclosure, "improved" does not necessarily demand that the data be statistically significant (i.e. $p<0.05$); rather, any quantifiable difference demonstrating that one value (e.g. the average treatment value) is different from another (e.g. the average control value) can rise to the level of "improved."

As used herein, "inhibiting and suppressing" and like terms should not be construed to require complete inhibition or suppression, although this may be desired in some embodiments.

The term "marker" or "unique marker" as used herein is an indicator of unique microorganism type, microorganism strain or activity of a microorganism strain. A marker can be measured in biological samples and includes without limitation, a nucleic acid-based marker such as a ribosomal RNA gene, a peptide- or protein-based marker, and/or a metabolite or other small molecule marker.

The term "metabolite" as used herein is an intermediate or product of metabolism. A metabolite in one embodiment is a small molecule. Metabolites have various functions, including in fuel, structural, signaling, stimulatory and inhibitory effects on enzymes, as a cofactor to an enzyme, in defense, and in interactions with other organisms (such as pigments, odorants and pheromones). A primary metabolite is directly involved in normal growth, development and reproduction. A secondary metabolite is not directly involved in these processes but usually has an important ecological function. Examples of metabolites include but are not limited to antibiotics and pigments such as resins and terpenes, etc. Some antibiotics use primary metabolites as precursors, such as actinomycin which is created from the primary metabolite, tryptophan. Metabolites, as used herein, include small, hydrophilic carbohydrates; large, hydrophobic lipids and complex natural compounds.

As used herein, the term "genotype" refers to the genetic makeup of an individual cell, cell culture, tissue, organism, or group of organisms.

As used herein, the term "allele(s)" means any of one or more alternative forms of a gene, all of which alleles relate to at least one trait or characteristic. In a diploid cell, the two alleles of a given gene occupy corresponding loci on a pair of homologous chromosomes. Since the present disclosure, in embodiments, relates to QTLs, i.e. genomic regions that may comprise one or more genes or regulatory sequences, it is in some instances more accurate to refer to "haplotype" (i.e. an allele of a chromosomal segment) instead of "allele", however, in those instances, the term "allele" should be understood to comprise the term "haplotype". Alleles are considered identical when they express a similar phenotype. Differences in sequence are possible but not important as long as they do not influence phenotype.

As used herein, the term "locus" (loci plural) means a specific place or places or a site on a chromosome where for example a gene or genetic marker is found.

As used herein, the term "genetically linked" refers to two or more traits that are co-inherited at a high rate during breeding such that they are difficult to separate through crossing.

A "recombination" or "recombination event" as used herein refers to a chromosomal crossing over or independent assortment. The term "recombinant" refers to an organism having a new genetic makeup arising as a result of a recombination event.

As used herein, the term "molecular marker" or "genetic marker" refers to an indicator that is used in methods for visualizing differences in characteristics of nucleic acid sequences. Examples of such indicators are restriction fragment length polymorphism (RFLP) markers, amplified fragment length polymorphism (AFLP) markers, single nucleotide polymorphisms (SNPs), insertion mutations, microsatellite markers (SSRs), sequence-characterized amplified regions (SCARs), cleaved amplified polymorphic sequence (CAPS) markers or isozyme markers or combinations of the markers described herein which defines a specific genetic and chromosomal location. Markers further include polynucleotide sequences encoding 16S or 18S rRNA, and internal transcribed spacer (ITS) sequences, which are sequences found between small-subunit and large-subunit rRNA genes that have proven to be especially useful in elucidating relationships or distinctions among when compared against one another. Mapping of molecular markers in the vicinity of an allele is a procedure which can be performed by the average person skilled in molecular-biological techniques.

The primary structure of major rRNA subunit 16S comprise a particular combination of conserved, variable, and hypervariable regions that evolve at different rates and enable the resolution of both very ancient lineages such as domains, and more modern lineages such as genera. The secondary structure of the 16S subunit include approximately 50 helices which result in base pairing of about 67% of the residues. These highly conserved secondary structural features are of great functional importance and can be used to ensure positional homology in multiple sequence alignments and phylogenetic analysis. Over the previous few decades, the 16S rRNA gene has become the most sequenced taxonomic marker and is the cornerstone for the current systematic classification of bacteria and archaea (Yarza et al. 2014. *Nature Rev. Micro.* 12:635-45).

A sequence identity of 94.5% or lower for two 16S rRNA genes is strong evidence for distinct genera, 86.5% or lower is strong evidence for distinct families, 82% or lower is strong evidence for distinct orders, 78.5% is strong evidence for distinct classes, and 75% or lower is strong evidence for distinct phyla. The comparative analysis of 16S rRNA gene sequences enables the establishment of taxonomic thresholds that are useful not only for the classification of cultured microorganisms but also for the classification of the many environmental sequences. Yarza et al. 2014. *Nature Rev. Micro.* 12:635-45).

As used herein, the term "trait" refers to a characteristic or phenotype. For example, in the context of some embodiments of the present disclosure; efficiency of feed utilization, particularly with corn-intensive diets; amount of feces produced; susceptibility to gut pathogens; and a decrease in mortality rates; among others. Desirable traits may also include other characteristics, including but not limited to: an increase in weight; an increase in average daily weight gain; an increase of musculature; an increase of fatty acid concentration in the gastrointestinal tract; an improved efficiency in feed utilization and digestibility; an increase in polysaccharide and lignin degradation; an increase in fat, starch, and/or protein digestion; an increase in fatty acid concentration in the rumen; pH balance in the rumen, an increase in vitamin availability; an increase in mineral availability; an increase in amino acid availability; a reduction in methane and/or nitrous oxide emissions; a reduction in manure production; an improved dry matter intake; an improved efficiency of nitrogen utilization; an improved efficiency of phosphorous utilization; an increased resistance to colonization of pathogenic microbes that colonize cattle; reduced mortality; increased production of antimicrobials; increased clearance of pathogenic microbes; increased resistance to colonization of pathogenic microbes that colonize cattle; increased resistance to colonization of pathogenic microbes that infect humans; reduced incidence of acidosis or bloat; increased meat marbling, increased or decreased red coloring of meat, increased or decreased texture/coarseness of meat; increased amount of USDA Prime, USDA Choice, and USDA Select quality meat per animal, increased in the number of animals producing USDA Prime, USDA Choice, and USDA Select quality meat; increase or reduced concentration or presence of volatile compounds in the meat; reduced prevalence of acidosis or bloat; reduced body temperature; and any combination thereof; wherein said increase or reduction is determined by comparing against an animal not having been administered said composition.

A trait may be inherited in a dominant or recessive manner, or in a partial or incomplete-dominant manner. A trait may be monogenic (i.e. determined by a single locus) or polygenic (i.e. determined by more than one locus) or may also result from the interaction of one or more genes with the environment.

In the context of this disclosure, traits may also result from the interaction of one or more beef cattle genes and one or more microorganism genes.

As used herein, the term "homozygous" means a genetic condition existing when two identical alleles reside at a specific locus, but are positioned individually on corresponding pairs of homologous chromosomes in the cell of a diploid organism. Conversely, as used herein, the term "heterozygous" means a genetic condition existing when two different alleles reside at a specific locus, but are positioned individually on corresponding pairs of homologous chromosomes in the cell of a diploid organism.

As used herein, the term "phenotype" refers to the observable characteristics of an individual cell, cell culture, organism (e.g., cattle), or group of organisms which results from the interaction between that individual's genetic makeup (i.e., genotype) and the environment.

As used herein, the term "chimeric" or "recombinant" when describing a nucleic acid sequence or a protein sequence refers to a nucleic acid, or a protein sequence, that links at least two heterologous polynucleotides, or two heterologous polypeptides, into a single macromolecule, or that re-arranges one or more elements of at least one natural nucleic acid or protein sequence. For example, the term "recombinant" can refer to an artificial combination of two otherwise separated segments of sequence, e.g., by chemical synthesis or by the manipulation of isolated segments of nucleic acids by genetic engineering techniques.

As used herein, a "synthetic nucleotide sequence" or "synthetic polynucleotide sequence" is a nucleotide sequence that is not known to occur in nature or that is not naturally occurring. Generally, such a synthetic nucleotide sequence will comprise at least one nucleotide difference when compared to any other naturally occurring nucleotide sequence.

As used herein, the term "nucleic acid" refers to a polymeric form of nucleotides of any length, either ribonucleotides or deoxyribonucleotides, or analogs thereof. This term refers to the primary structure of the molecule, and thus includes double- and single-stranded DNA, as well as double- and single-stranded RNA. It also includes modified nucleic acids such as methylated and/or capped nucleic acids, nucleic acids containing modified bases, backbone modifications, and the like. The terms "nucleic acid" and "nucleotide sequence" are used interchangeably.

As used herein, the term "gene" refers to any segment of DNA associated with a biological function. Thus, genes include, but are not limited to, coding sequences and/or the regulatory sequences required for their expression. Genes can also include non-expressed DNA segments that, for example, form recognition sequences for other proteins. Genes can be obtained from a variety of sources, including cloning from a source of interest or synthesizing from known or predicted sequence information, and may include sequences designed to have desired parameters.

As used herein, the term "homologous" or "homologue" or "ortholog" is known in the art and refers to related sequences that share a common ancestor or family member and are determined based on the degree of sequence identity. The terms "homology," "homologous," "substantially similar" and "corresponding substantially" are used interchangeably herein. They refer to nucleic acid fragments wherein changes in one or more nucleotide bases do not affect the ability of the nucleic acid fragment to mediate gene expression or produce a certain phenotype. These terms also refer to modifications of the nucleic acid fragments of the instant disclosure such as deletion or insertion of one or more nucleotides that do not substantially alter the functional properties of the resulting nucleic acid fragment relative to the initial, unmodified fragment. It is therefore understood, as those skilled in the art will appreciate, that the disclosure encompasses more than the specific exemplary sequences. These terms describe the relationship between a gene found in one species, subspecies, variety, cultivar or strain and the corresponding or equivalent gene in another species, subspecies, variety, cultivar or strain. For purposes of this disclosure homologous sequences are compared. "Homologous sequences" or "homologues" or "orthologs" are thought, believed, or known to be functionally related. A functional relationship may be indicated in any one of a number of ways, including, but not limited to: (a) degree of sequence identity and/or (b) the same or similar biological function. Preferably, both (a) and (b) are indicated. Homology can be determined using software programs readily available in the art, such as those discussed in Current Protocols in Molecular Biology (F. M. Ausubel et al., eds., 1987) Supplement 30, section 7.718, Table 7.71. Some alignment programs are MacVector (Oxford Molecular Ltd, Oxford, U.K.), ALIGN Plus (Scientific and Educational Software, Pennsylvania) and AlignX (Vector NTI, Invitrogen, Carlsbad, Calif.). Another alignment program is Sequencher (Gene Codes, Ann Arbor, Mich.), using default parameters.

As used herein, the term "nucleotide change" refers to, e.g., nucleotide substitution, deletion, and/or insertion, as is well understood in the art. For example, mutations contain alterations that produce silent substitutions, additions, or deletions, but do not alter the properties or activities of the encoded protein or how the proteins are made.

As used herein, the term "protein modification" refers to, e.g., amino acid substitution, amino acid modification, deletion, and/or insertion, as is well understood in the art.

As used herein, the term "at least a portion" or "fragment" of a nucleic acid or polypeptide means a portion having the minimal size characteristics of such sequences, or any larger fragment of the full length molecule, up to and including the full length molecule. A fragment of a polynucleotide of the disclosure may encode a biologically active portion of a genetic regulatory element. A biologically active portion of a genetic regulatory element can be prepared by isolating a portion of one of the polynucleotides of the disclosure that comprises the genetic regulatory element and assessing activity as described herein. Similarly, a portion of a polypeptide may be 4 amino acids, 5 amino acids, 6 amino acids, 7 amino acids, and so on, going up to the full length polypeptide. The length of the portion to be used will depend on the particular application. A portion of a nucleic acid useful as a hybridization probe may be as short as 12 nucleotides; in some embodiments, it is 20 nucleotides. A portion of a polypeptide useful as an epitope may be as short as 4 amino acids. A portion of a polypeptide that performs the function of the full-length polypeptide would generally be longer than 4 amino acids.

Variant polynucleotides also encompass sequences derived from a mutagenic and recombinogenic procedure such as DNA shuffling. Strategies for such DNA shuffling are known in the art. See, for example, Stemmer (1994) PNAS 91:10747-10751; Stemmer (1994) Nature 370:389-391; Crameri et al. (1997) Nature Biotech. 15:436-438; Moore et al. (1997) J. Mol. Biol. 272:336-347; Zhang et al. (1997) PNAS 94:4504-4509; Crameri et al. (1998) Nature 391:288-291; and U.S. Pat. Nos. 5,605,793 and 5,837,458. For PCR amplifications of the polynucleotides disclosed herein, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook et al. (1989) Molecular Cloning: A Laboratory Manual (2nd ed., Cold Spring Harbor Laboratory Press, Plainview, N.Y.). See also Innis et al., eds. (1990) PCR Protocols: A Guide to Methods and Applications (Academic Press, New York); Innis and Gelfand, eds. (1995) PCR Strategies (Academic Press, New York); and Innis and Gelfand, eds. (1999) PCR Methods Manual (Academic Press, New York). Known methods of PCR include, but are not limited to, methods using paired primers, nested primers, single specific primers, degenerate primers, gene-specific primers, vector-specific primers, partially-mismatched primers, and the like.

The term "primer" as used herein refers to an oligonucleotide which is capable of annealing to the amplification target allowing a DNA polymerase to attach, thereby serving as a point of initiation of DNA synthesis when placed under conditions in which synthesis of primer extension product is induced, i.e., in the presence of nucleotides and an agent for polymerization such as DNA polymerase and at a suitable temperature and pH. The (amplification) primer is preferably single stranded for maximum efficiency in amplification. Preferably, the primer is an oligodeoxyribonucleotide. The primer must be sufficiently long to prime the synthesis of extension products in the presence of the agent for polymerization. The exact lengths of the primers will depend on many factors, including temperature and composition (A/T vs. G/C content) of primer. A pair of bi-directional primers consists of one forward and one reverse primer as commonly used in the art of DNA amplification such as in PCR amplification.

The terms "stringency" or "stringent hybridization conditions" refer to hybridization conditions that affect the stability of hybrids, e.g., temperature, salt concentration, pH, formamide concentration and the like. These conditions are empirically optimized to maximize specific binding and minimize non-specific binding of primer or probe to its target nucleic acid sequence. The terms as used include reference to conditions under which a probe or primer will hybridize to its target sequence, to a detectably greater degree than other sequences (e.g. at least 2-fold over background). Stringent conditions are sequence dependent and will be different in different circumstances. Longer sequences hybridize specifically at higher temperatures. Generally, stringent conditions are selected to be about 5° C. lower than the thermal melting point (Tm) for the specific sequence at a defined ionic strength and pH. The Tm is the temperature (under defined ionic strength and pH) at which 50% of a complementary target sequence hybridizes to a perfectly matched probe or primer. Typically, stringent conditions will be those in which the salt concentration is less than about 1.0 M Na+ ion, typically about 0.01 to 1.0 M Na+ ion concentration (or other salts) at pH 7.0 to 8.3 and the temperature is at least about 30° C. for short probes or primers (e.g. 10 to 50 nucleotides) and at least about 60° C. for long probes or primers (e.g. greater than 50 nucleotides). Stringent conditions may also be achieved with the addition of destabilizing agents such as formamide. Exemplary low stringent conditions or "conditions of reduced stringency" include hybridization with a buffer solution of 30% formamide, 1 M NaCl, 1% SDS at 37° C. and a wash in 2×SSC at 40° C. Exemplary high stringency conditions include hybridization in 50% formamide, 1M NaCl, 1% SDS at 37° C., and a wash in 0.1×SSC at 60° C. Hybridization procedures are well known in the art and are described by e.g. Ausubel et al., 1998 and Sambrook et al., 2001. In some embodiments, stringent conditions are hybridization in 0.25 M $Na_2HPO_4$ buffer (pH 7.2) containing 1 mM $Na_2EDTA$, 0.5-20% sodium dodecyl sulfate at 45° C., such as 0.5%, 1%, 2%, 3%, 4%, 5%, 6%, 7%, 8%, 9%, 10%, 11%, 12%, 13%, 14%, 15%, 16%, 17%, 18%, 19% or 20%, followed by a wash in 5×SSC, containing 0.1% (w/v) sodium dodecyl sulfate, at 55° C. to 65° C.

As used herein, "promoter" refers to a DNA sequence capable of controlling the expression of a coding sequence or functional RNA. The promoter sequence consists of proximal and more distal upstream elements, the latter elements often referred to as enhancers. Accordingly, an "enhancer" is a DNA sequence that can stimulate promoter activity, and may be an innate element of the promoter or a heterologous element inserted to enhance the level or tissue specificity of a promoter. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. It is further recognized that since in most cases the exact boundaries of regulatory sequences have not been completely defined, DNA fragments of some variation may have identical promoter activity.

As used herein, a "constitutive promoter" is a promoter which is active under most conditions and/or during most development stages. There are several advantages to using constitutive promoters in expression vectors used in biotechnology, such as: high level of production of proteins used to select transgenic cells or organisms; high level of expression of reporter proteins or scorable markers, allowing easy detection and quantification; high level of production of a transcription factor that is part of a regulatory transcription system; production of compounds that requires ubiquitous activity in the organism; and production of compounds that are required during all stages of development. Non-limiting exemplary constitutive promoters include, CaMV 35S promoter, opine promoters, ubiquitin promoter, alcohol dehydrogenase promoter, etc.

As used herein, a "non-constitutive promoter" is a promoter which is active under certain conditions, in certain types of cells, and/or during certain development stages. For example, tissue specific, tissue preferred, cell type specific, cell type preferred, inducible promoters, and promoters under development control are non-constitutive promoters. Examples of promoters under developmental control include promoters that preferentially initiate transcription in certain tissues.

As used herein, "inducible" or "repressible" promoter is a promoter which is under chemical or environmental factors control. Examples of environmental conditions that may affect transcription by inducible promoters include anaerobic conditions, certain chemicals, the presence of light, acidic or basic conditions, etc.

As used herein, a "tissue specific" promoter is a promoter that initiates transcription only in certain tissues. Unlike constitutive expression of genes, tissue-specific expression is the result of several interacting levels of gene regulation. As such, in the art sometimes it is preferable to use promoters from homologous or closely related species to achieve efficient and reliable expression of transgenes in particular tissues. This is one of the main reasons for the large amount of tissue-specific promoters isolated from particular tissues found in both scientific and patent literature.

As used herein, the term "operably linked" refers to the association of nucleic acid sequences on a single nucleic acid fragment so that the function of one is regulated by the other. For example, a promoter is operably linked with a coding sequence when it is capable of regulating the expression of that coding sequence (i.e., that the coding sequence is under the transcriptional control of the promoter). Coding sequences can be operably linked to regulatory sequences in a sense or antisense orientation. In another example, the complementary RNA regions of the disclosure can be operably linked, either directly or indirectly, 5' to the target mRNA, or 3' to the target mRNA, or within the target mRNA, or a first complementary region is 5' and its complement is 3' to the target mRNA.

As used herein, the phrases "recombinant construct", "expression construct", "chimeric construct", "construct", and "recombinant DNA construct" are used interchangeably herein. A recombinant construct comprises an artificial combination of nucleic acid fragments, e.g., regulatory and coding sequences that are not found together in nature. For example, a chimeric construct may comprise regulatory sequences and coding sequences that are derived from different sources, or regulatory sequences and coding sequences derived from the same source, but arranged in a manner different than that found in nature. Such construct may be used by itself or may be used in conjunction with a vector. If a vector is used then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the disclosure. The skilled artisan will also recognize that different independent transformation events will result in different levels and patterns of expression (Jones et al., (1985) EMBO J. 4:2411-2418; De Almeida et al., (1989) Mol. Gen. Genetics 218:78-86), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others. Vectors can be plasmids, viruses, bacteriophages, pro-viruses, phagemids, transposons, artificial chromosomes, and the like, that replicate autonomously or can integrate into a chromosome of a host cell. A vector can also be a naked RNA polynucleotide, a naked DNA polynucleotide, a polynucleotide composed of both DNA and RNA within the same strand, a poly-lysine-conjugated DNA or RNA, a peptide-conjugated DNA or RNA, a liposome-conjugated DNA, or the like, that is not autonomously replicating. As used herein, the term "expression" refers to the production of a functional end-product e.g., an mRNA or a protein (precursor or mature).

In some embodiments, the cell or organism has at least one heterologous trait. As used herein, the term "heterologous trait" refers to a phenotype imparted to a transformed host cell or transgenic organism by an exogenous DNA segment, heterologous polynucleotide or heterologous nucleic acid. Various changes in phenotype are of interest to the present disclosure, including but not limited to increasing yield of an economically important trait (e.g., weight, etc.) and the like. These results can be achieved by providing expression of heterologous products or increased expression of endogenous products in organisms using the methods and compositions of the present disclosure.

As used herein, the term "MIC" means maximal information coefficient. MIC is a type of nonparamentric network analysis that identifies a score (MIC score) between active microbial strains of the present disclosure and at least one measured metadata (e.g., milk fat). Further, U.S. application Ser. No. 15/217,575, filed on Jul. 22, 2016 (issued as U.S. Pat. No. 9,540,676 on Jan. 10, 2017) is hereby incorporated by reference in its entirety.

Figure 2:
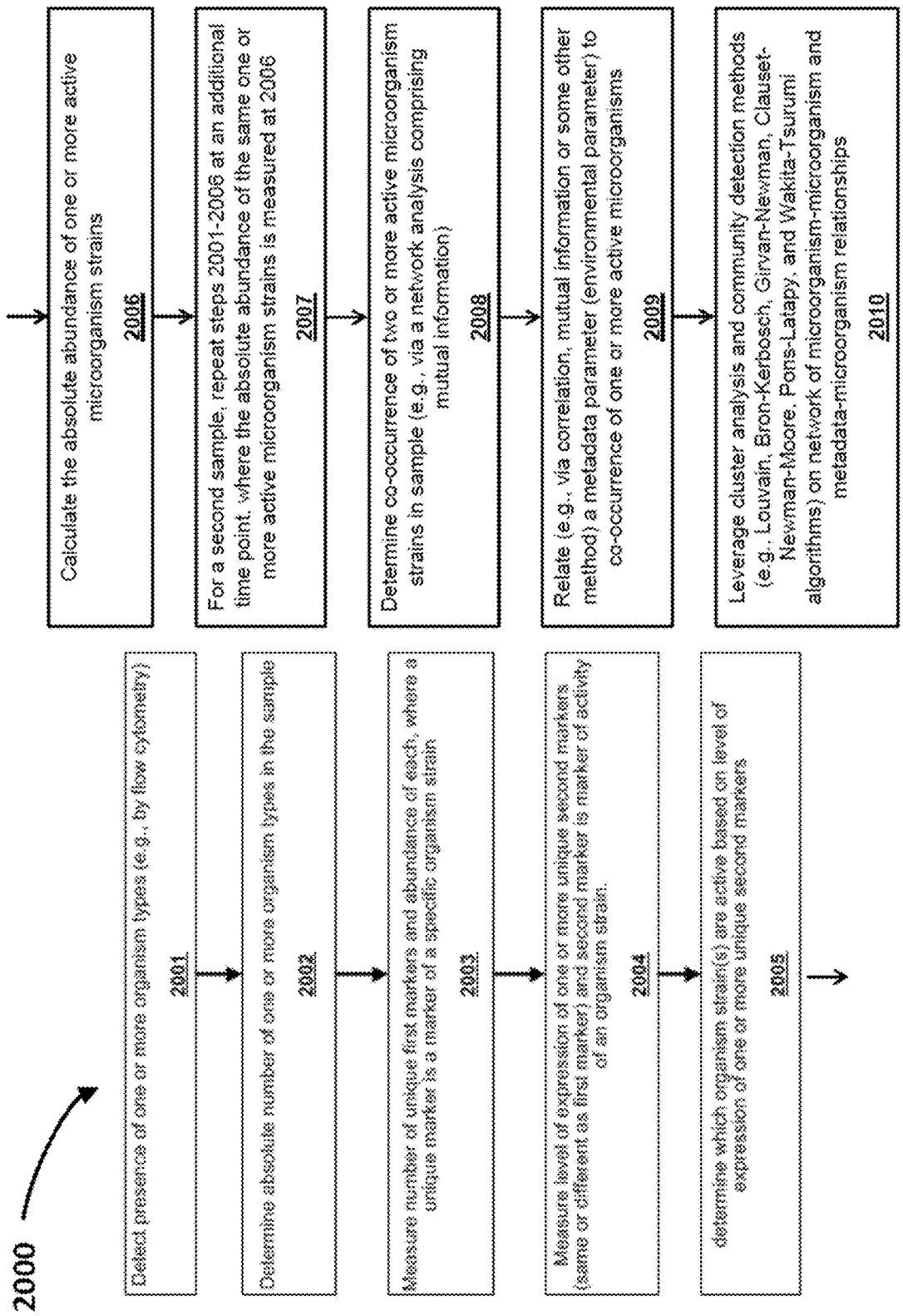
FIG. 2 shows a general workflow of one embodiment of a method for determining the co-occurrence of one or more, or two or more, active microorganism strains in a sample with one or more metadata (environmental) parameters, followed by leveraging cluster analysis and community detection methods on the network of determined relationships.

The maximal information coefficient (MIC) is then calculated between strains and metadata 3021*a*, and between strains 3021*b*; as seen in FIG. 2. Results are pooled to create a list of all relationships and their corresponding MIC scores 3022. If the relationship scores below a given threshold 3023, the relationship is deemed/identified as irrelevant 3023*b*. If the relationship is above a given threshold 3023, the relationship deemed/identified as relevant 2023*a*, and is further subject to network analysis 3024. The following code fragment shows an exemplary methodology for such analysis, according to one embodiment:

```
Read total list of relationships file as links
threshold = 0.8
for i in range(len(links)):
    if links >= threshold
        multiplier[i] = 1
    else
        multiplier[i] = 0
    end if
links_temp = multiplier*links
final_links = links_temp[links_temp != 0]
savetxt(output_file,final_links)
output_file.close( )
```

In some embodiments, the compositions of the present disclosure comprise one or more bacteria and/or one or more fungi that have a MIC score of at least about 0.1, at least about 0.15, at least about 0.2, at least about 0.25, at least about 0.3, at least about 0.35, at least about 0.4, at least about 0.45, at least about 0.5, at least about 0.55, at least about 0.6, at least about 0.65, at least about 0.7, at least about 0.75, at least about 0.80, at least about 0.85, at least about 0.9, or at least about 0.95.

In some embodiments, the compositions of the present disclosure comprise one or more bacteria and/or one or more fungi that have a MIC score of at least 0.1, at least 0.15, at least 0.2, at least 0.25, at least 0.3, at least 0.35, at least 0.4, at least 0.45, at least 0.5, at least 0.55, at least 0.6, at least 0.65, at least 0.7, at least 0.75, at least 0.80, at least 0.85, at least 0.9, or at least 0.95.

Based on the output of the network analysis, active strains are selected 3025 for preparing products (e.g., ensembles, aggregates, and/or other synthetic groupings) containing the selected strains. The output of the network analysis can also be used to inform the selection of strains for further product composition testing.

The use of thresholds is discussed above for analyses and determinations. Thresholds can be, depending on the implementation and application: (1) empirically determined (e.g., based on distribution levels, setting a cutoff at a number that removes a specified or significant portion of low level reads); (2) any non-zero value; (3) percentage/percentile based; (4) only strains whose normalized second marker (i.e., activity) reads is greater than normalized first marker (cell count) reads; (5) log 2 fold change between activity and quantity or cell count; (6) normalized second marker (activity) reads is greater than mean second marker (activity) reads for entire sample (and/or sample set); and/or any magnitude threshold described above in addition to a statistical threshold (i.e., significance testing). The following example provides thresholding detail for distributions of RNA-based second marker measurements with respect to DNA-based first marker measurements, according to one embodiment.

As used herein "shelf-stable" refers to a functional attribute and new utility acquired by the microbes formulated according to the disclosure, which enable said microbes to exist in a useful/active state outside of their natural environment in the rumen (i.e. a markedly different characteristic). Thus, shelf-stable is a functional attribute created by the formulations/compositions of the disclosure and denoting that the microbe formulated into a shelf-stable composition can exist outside the rumen and under ambient conditions for a period of time that can be determined depending upon the particular formulation utilized, but in general means that the microbes can be formulated to exist in a composition that is stable under ambient conditions for at least a few days and generally at least one week. Accordingly, a "shelf-stable ruminant supplement" is a composition comprising one or more microbes of the disclosure, said microbes formulated in a composition, such that the composition is stable under ambient conditions for at least one week, meaning that the microbes comprised in the composition (e.g. whole cell, spore, or lysed cell) are able to impart one or more beneficial phenotypic properties to a ruminant when administered (e.g. increased milk yield, improved milk compositional characteristics, improved rumen health, and/or modulation of the rumen microbiome).

Feedlot Cattle Vs. Dairy Cows

The instant subject matter is distinct over the subject matter of prior Ascus Biosciences, Inc. applications. The 16S sequences of the microbes of the instant disclosure are believed to be distinct over those of any prior Ascus Biosciences, Inc. applications. One of ordinary skill in the art would be aware that the diet of a dairy cow would be distinct from that of a steer on a beef feedlot. The steer on the beef feedlot would be fed a high-energy high-grain diet in order to quickly increase the rate of weight gain and to increase the maximum weight prior to rendering. The cow on the dairy farm would be fed a different diet that is optimized for the production of milk with little consideration for rapid weight gain or highest maximum weight. The two diets would result in the rumen of the animals in the two environments to yield drastically different microbiota. Thus, the microorganisms in the rumen of the dairy cow and that of the feedlot steer are expected to be different from one another.

Isolated Microbes

In some aspects, the present disclosure provides isolated microbes, including novel strains of microbes, presented in Table 1 and Table 2.

In other aspects, the present disclosure provides isolated whole microbial cultures of the microbes identified in Table 1 and Table 2. These cultures may comprise microbes at various concentrations.

In some aspects, the disclosure provides for utilizing one or more microbes selected from Table 1 and Table 2 to increase a phenotypic trait of interest in beef cattle.

In some embodiments, the disclosure provides isolated microbial species belonging to taxonomic families of Prevotellaceae, Veillonellaceae, Ruminococcaceae, Fibrobacteraceae, Bacillaceae 1, Spirochaetaceae, Bacteroidaceae, Lachnospiraceae, Porphyromonadaceae, Coriobacteriaceae, Acidaminococcaceae, Clostridiaceae 1, Rhodobacteraceae, Cryomorphaceae, Erysipelotrichaceae, Promicromonosporaceae, Burkholderiaceae, Succinivibrionaceae, Pseudomonadaceae, Corynebacteriaceae, Planococcaceae, Streptomycetaceae, Synergistaceae, Nocardiopsaceae, Flavobacteriaceae, Propionibacteriaceae, Staphylococcaceae, Clostridiales incertae sedis XIII, Anaeroplasmataceae, Pasteurellaceae, Caulobacteraceae, and Sphingomonadaceae.

In further embodiments, isolated microbial species may be selected from genera of *Fibrobacter, Saccharofermentans, Bacillus, Spirochaeta, Bacteroides, Lachnospiracea incertae sedis, Clostridium* XLVa, *Ruminococcus, Butyricimonas, Olsenella, Acidaminococcus, Parabacteroides, Clostridum sensu stricto, Oribacterium, Pseudoflavonifractor, Treponema, Rhodobacter, Fluviicola, Succiniclasticum, Solobacterium, Veillonella, Cellulosimicrobium, Cupriavidus, Megasphaera, Succinivibrio, Oscillibacter, Pseudomonas, Corynebacterium, Adlercreutzia, Dorea, Roseburia, Anaerovibrio, Sporosarcina, Streptomyces, Syntrophococcus, Butyrivibrio, Lachnobacterium, Pyramidobacter, Coprococcus, Ruminobacter, Thermobifidia, Papillibacter, Aquimarina, Propioniciclava, Staphylococcus, Mogibacterium, Pseudobutyrivibrio, Asteroleplasma, Turicibacter, Aggregatibacter, Brevundimonas, Phascolarctobacterium,* and *Sphingobium.*

Furthermore, the disclosure relates to microbes having characteristics substantially similar to that of a microbe identified in Table 1 and/or Table 2.

The isolated microbial species, and novel strains of said species, identified in the present disclosure, are able to impart beneficial properties or traits to beef cattle production.

For instance, the isolated microbes described in Table 1 and Table 2, or microbial ensemble of said microbes, are able to increase feed efficiency. The increase can be quantitatively measured, for example, by measuring the effect that said microbial application has upon the modulation of feed efficiency.

In some embodiments, the isolated microbial strains are microbes of the present disclosure that have been genetically modified. In some embodiments, the genetically modified or recombinant microbes comprise polynucleotide sequences which do not naturally occur in said microbes. In some embodiments, the microbes may comprise heterologous polynucleotides. In further embodiments, the heterologous polynucleotides may be operably linked to one or more polynucleotides native to the microbes.

In some embodiments, the heterologous polynucleotides may be reporter genes or selectable markers. In some embodiments, reporter genes may be selected from any of the family of fluorescence proteins (e.g., GFP, RFP, YFP, and the like), β-galactosidase, luciferase. In some embodiments, selectable markers may be selected from neomycin phosphotransferase, hygromycin phosphotransferase, aminoglycoside adenyltransferase, dihydrofolate reductase, acetolactase synthase, bromoxynil nitrilase, β-glucuronidase, dihydrogolate reductase, and chloramphenicol acetyltransferase. In some embodiments, the heterologous polynucleotide may be operably linked to one or more promoter.

In some embodiments the isolated microbial strains express transgenic or native polypeptides selected from cellulases (endocellulases, exocellulases, glucosidases), pectinases, amylases, amylopectinases, ligninases, and phytases.

The isolated microbes of Table 2 represent variants of the microbes recited in Table 1. The microbes of Table 2, comprise the reference strains, and the microbes of Table 1 comprise the variants thereof. Generally, the variants of Table 2 comprise 16S rRNA sequences that share at least about 97% sequence identity with the 16S rRNA of the corresponding reference strain in Table B. For example, strains Asbusbbf_873A to Asbusbbf_873G (Table 2 correspond to variants of the reference strain Ascusbbf_873 (Table 1), wherein the 16S rRNA of the variants share at least about 97% sequence identity with that of the reference strain.

Microbial Compositions

In some aspects, the disclosure provides microbial compositions comprising a combination of at least any two microbes selected from amongst the microbes identified in Table 1 and Table 2.

In certain embodiments, the compositions of the present disclosure comprise two microbes, or three microbes, or four microbes, or five microbes, or six microbes, or seven microbes, or eight microbes, or nine microbes, or ten or more microbes. Said microbes of the compositions are different microbial species, or different strains of a microbial species.

In some embodiments, the disclosure provides microbial compositions, comprising: at least one or at least two isolated microbial species belonging to genera of: *Fibrobacter, Saccharofermentans, Bacillus, Spirochaeta, Bacteroides, Lachnospiracea incertae sedis, Clostridium* XLVa, *Ruminococcus, Butyricimonas, Olsenella, Acidaminococcus, Parabacteroides, Clostridum sensu stricto, Oribacterium, Pseudoflavonifractor, Treponema, Rhodobacter, Fluviicola, Succiniclasticum, Solobacterium, Veillonella, Cellulosimicrobium, Cupriavidus, Megasphaera, Succinivibrio, Oscillibacter, Pseudomonas, Corynebacterium, Adlercreutzia, Dorea, Roseburia, Anaerovibrio, Sporosarcina, Streptomyces, Syntrophococcus, Butyrivibrio, Lachnobacterium, Pyramidobacter, Coprococcus, Ruminobacter, Thermobifidia, Papillibacter, Aquimarina, Propioniciclava, Staphylococcus, Mogibacterium, Pseudobutyrivibrio, Asteroleplasma, Turicibacter, Aggregatibacter, Brevundimonas, Phascolarctobacterium,* and *Sphingobium*. Particular novel strains of species of these aforementioned genera can be found in Table 1 and Table 2.

In some embodiments, the disclosure provides microbial compositions, comprising: at least one or at least two isolated microbial species belonging to the family of: Prevotellaceae, Veillonellaceae, Ruminococcaceae, Fibrobacteraceae, Bacillaceae 1, Spirochaetaceae, Bacteroidaceae, Lachnospiraceae, Porphyromonadaceae, Coriobacteriaceae, Acidaminococcaceae, Clostridiaceae 1, Rhodobacteraceae, Cryomorphaceae, Erysipelotrichaceae, Promicromonosporaceae, Burkholderiaceae, Succinivibrionaceae, Pseudomonadaceae, Corynebacteriaceae, Planococcaceae, Streptomycetaceae, Synergistaceae, Nocardiopsaceae, Flavobacteriaceae, Propionibacteriaceae, Staphylococcaceae, Clostridiales incertae sedis XIII, Anaeroplasmataceae, Pasteurellaceae, Caulobacteraceae, and Sphingomonadaceae.

Particular novel strains of species of these aforementioned genera can be found in Table 1 and Table 2.

In particular aspects, the disclosure provides microbial compositions, comprising species as grouped in Tables 3-9. With respect to Tables 3-9, the letters A through I represent a non-limiting selection of microbes of the present disclosure, defined as:

A=Strain designation Ascusbbf_154 identified in Table 1;
B=Strain designation Ascusbbf_4 identified in Table 1;
C=Strain designation Ascusbbf_14146 identified in Table 1;
D=Strain designation Ascusbbf_876 identified in Table 1;
E=Strain designation Ascusbbf_24302 identified in Table 1;
F=Strain designation Ascusbbf_1085 identified in Table 1;
G=Strain designation Ascusbbf_1 identified in Table 1;
H=Strain designation Ascusbbf_6176 identified in Table 1; and
I=Strain designation Ascusbbf_3427 identified in Table 1.

TABLE 3

Eight and Nine Strain Compositions

| | | | | | | |
|---|---|---|---|---|---|---|
| A, B, C, D, E, F, G, H | A, B, C, D, E, F, G, I | A, B, C, D, E, F, H, I | A, B, C, D, E, G, H, I | A, B, C, D, F, G, H, I | A, B, C, E, F, G, H, I | |
| A, B, D, E, F, G, H, I | A, C, D, E, F, G, H, I | B, C, D, E, F, G, H, I | A, B, C, D, E, F, G, H, I | | | |

TABLE 4

Seven Strain Compositions

| | | | | | |
|---|---|---|---|---|---|
| A, B, C, D, E, F, G | A, B, C, D, E, F, H | A, B, C, D, E, F, I | A, B, C, D, E, G, H | A, B, C, D, E, G, I | A, B, C, D, E, H, I |
| A, B, C, D, F, G, H | A, B, C, D, F, G, I | A, B, C, D, F, H, I | A, B, C, D, G, H, I | A, B, C, E, F, G, H | A, B, C, E, F, G, I |
| A, B, C, E, F, H, I | A, B, C, E, G, H, I | A, B, C, F, G, H, I | A, B, D, E, F, G, H | A, B, D, E, F, G, I | A, B, D, E, F, H, I |
| A, B, D, E, G, H, I | A, B, D, F, G, H, I | A, B, E, F, G, H, I | A, C, D, E, F, G, H | A, C, D, E, F, G, I | A, C, D, E, F, H, I |
| A, C, D, E, G, H, I | A, C, D, F, G, H, I | A, C, E, F, G, H, I | A, D, E, F, G, H, I | B, C, D, E, F, G, H | B, C, D, E, F, G, I |
| B, C, D, E, F, H, I | B, C, D, E, G, H, I | B, C, D, F, G, H, I | B, C, E, F, G, H, I | B, D, E, F, G, H, I | C, D, E, F, G, H, I |

TABLE 5

Six Strain Compositions

| | | | | | | |
|---|---|---|---|---|---|---|
| A, B, C, D, E, F | A, B, C, D, E, G | A, B, C, D, E, H | A, B, C, D, E, I | A, B, C, D, F, G | A, B, C, D, F, H | A, B, C, D, F, I |
| A, B, C, D, G, H | A, B, C, D, G, I | A, B, C, D, H, I | A, B, C, E, F, G | A, B, C, E, F, H | A, B, C, E, F, I | A, B, C, E, G, H |
| A, B, C, E, G, I | A, B, C, E, H, I | A, B, C, F, G, H | A, B, C, F, G, I | A, B, C, F, H, I | A, B, C, G, H, I | A, B, D, E, F, G |
| A, B, D, E, F, H | A, B, D, E, F, I | A, B, D, E, G, H | A, B, D, E, G, I | A, B, D, E, H, I | A, B, D, F, G, H | A, B, D, F, G, I |
| D, E, F, G, H, I | C, E, F, G, H, I | A, B, D, F, H, I | A, B, D, G, H, I | A, B, E, F, G, H | A, B, E, F, G, I | A, B, E, F, H, I |

TABLE 5-continued

Six Strain Compositions

| | | | | | | |
|---|---|---|---|---|---|---|
| A, B, E, G, H, I | A, B, F, G, H, I | A, C, D, E, F, G | A, C, D, E, F, H | A, C, D, E, F, I | A, C, D, E, G, H | A, C, D, E, G, I |
| A, C, D, E, H, I | A, C, D, F, G, H | A, C, D, F, G, I | A, C, D, F, H, I | A, C, D, G, H, I | A, C, E, F, G, H | A, C, E, F, G, I |
| A, C, E, F, H, I | A, C, E, G, H, I | A, C, F, G, H, I | A, D, E, F, G, H | A, D, E, F, G, I | A, D, E, F, H, I | A, D, E, G, H, I |
| A, D, F, G, H, I | A, E, F, G, H, I | B, C, D, E, F, G | B, C, D, E, F, H | B, C, D, E, F, I | B, C, D, E, G, H | B, C, D, E, G, I |
| B, C, D, E, H, I | B, C, D, F, G, H | B, C, D, F, G, I | B, C, D, F, H, I | B, C, D, G, H, I | B, C, E, F, G, H | B, C, E, F, G, I |
| B, C, E, F, H, I | B, C, E, G, H, I | B, C, F, G, H, I | B, D, E, F, G, H | B, D, E, F, G, I | B, D, E, F, H, I | B, D, E, G, H, I |
| B, D, F, G, H, I | B, E, F, G, H, I | C, D, E, F, G, H | C, D, E, F, G, I | C, D, E, F, H, I | C, D, E, G, H, I | C, D, F, G, H, I |

TABLE 6

Five Strain Compositions

| | | | | | | | |
|---|---|---|---|---|---|---|---|
| A, B, C, D, E | A, B, C, D, F | A, B, C, D, G | A, B, C, D, H | A, B, C, D, I | A, B, C, E, F | A, B, C, E, G | A, B, C, E, H |
| A, B, C, F, H | A, B, C, F, G | A, B, C, F, I | A, B, C, G, H | A, B, C, G, I | A, B, C, H, I | A, B, D, E, F | A, B, D, E, G |
| A, B, D, E, I | A, B, D, F, G | A, B, D, F, H | A, B, D, F, I | A, B, D, G, H | A, B, D, G, I | A, B, D, H, I | A, B, E, F, G |
| A, B, E, F, I | A, B, E, G, H | A, B, E, G, I | A, B, E, H, I | A, B, F, G, H | A, B, F, G, I | A, B, F, H, I | A, B, G, H, I |
| A, C, D, E, G | A, C, D, E, H | A, C, D, E, I | A, C, D, F, G | A, C, D, F, H | A, C, D, F, I | A, C, D, G, H | A, C, D, G, I |
| A, C, E, F, G | A, C, E, F, H | A, C, E, F, I | A, C, E, G, H | A, C, E, G, I | A, C, E, H, I | A, C, F, G, H | A, C, F, G, I |
| A, C, G, H, I | A, D, E, F, G | A, D, E, F, H | A, D, E, F, I | A, D, E, G, H | A, D, E, G, I | A, D, E, H, I | A, D, F, G, H |
| A, D, F, H, I | A, D, G, H, I | A, E, F, G, H | A, E, F, G, I | A, E, F, H, I | A, E, G, H, I | A, F, G, H, I | B, C, D, E, F |
| B, C, D, E, H | B, C, D, E, I | B, C, D, F, G | B, C, D, F, H | B, C, D, F, I | B, C, D, G, H | B, C, D, G, I | B, C, D, H, I |
| B, C, E, F, H | B, C, E, F, I | B, C, E, G, H | B, C, E, G, I | B, C, E, H, I | B, C, F, G, H | B, C, F, G, I | B, C, F, H, I |
| B, D, E, F, G | B, D, E, F, H | B, D, E, F, I | B, D, E, G, H | B, D, E, G, I | B, D, E, H, I | B, D, F, G, H | B, D, F, G, I |
| B, D, G, H, I | B, E, F, G, H | B, E, F, G, I | B, E, F, H, I | B, E, G, H, I | B, F, G, H, I | C, D, E, F, G | C, D, E, F, H |
| C, D, E, G, H | C, D, E, G, I | C, D, E, H, I | C, D, F, G, H | C, D, F, G, I | C, D, F, H, I | C, D, G, H, I | C, E, F, G, H |
| C, E, F, H, I | C, E, G, H, I | C, F, G, H, I | D, E, F, G, H | D, E, F, G, I | D, E, F, H, I | D, E, G, H, I | D, F, G, H, I |
| A, B, C, E, I | A, B, D, E, H | A, B, E, F, H | A, C, D, E, F | A, C, D, H, I | A, C, F, H, I | A, D, F, G, I | B, C, D, E, G |
| B, C, E, F, G | B, C, G, H, I | B, D, F, H, I | C, D, E, F, I | C, E, F, G, I | E, F, G, H, I | | |

TABLE 7

Four Strain Compositions

| | | | | | | | |
|---|---|---|---|---|---|---|---|
| A, B, C, D | A, B, C, E | A, B, C, F | A, B, C, G | A, B, C, H | A, B, C, I | A, B, D, E | A, B, D, F | D, G, H, I |
| A, B, D, G | A, B, D, H | A, B, D, I | A, B, E, F | A, B, E, G | A, B, E, H | A, B, E, I | A, B, F, G | E, F, G, H |
| A, B, F, H | A, D, F, H | A, D, F, I | A, D, G, H | A, D, G, I | A, D, H, I | A, E, F, G | A, E, F, H | E, F, G, I |
| A, B, F, I | A, B, G, H | A, B, G, I | A, B, H, I | A, C, D, E | A, C, D, F | A, C, D, G | A, C, D, H | E, F, H, I |
| A, C, D, I | A, C, E, F | A, C, E, G | A, C, E, H | A, C, E, I | A, C, F, G | A, C, F, H | A, C, F, I | E, G, H, I |
| A, C, G, H | A, C, G, I | A, C, H, I | A, D, E, F | A, D, E, G | A, D, E, H | A, D, E, I | A, D, F, G | F, G, H, I |
| A, E, F, I | A, E, G, H | A, E, G, I | A, E, H, I | A, F, G, H | A, F, G, I | A, F, H, I | A, G, H, I | D, E, F, H |
| B, C, D, E | B, C, D, F | B, C, D, G | B, C, D, H | B, C, D, I | B, C, E, F | B, C, E, G | B, C, E, H | D, E, F, I |
| B, C, E, I | B, C, F, G | B, C, F, H | B, C, F, I | B, C, G, H | B, C, G, I | B, C, H, I | B, D, E, F | D, E, G, H |
| B, D, E, G | B, D, E, H | B, D, E, I | B, D, F, G | B, D, F, H | B, D, F, I | B, D, G, H | B, D, G, I | D, E, G, I |
| B, D, H, I | B, E, F, G | B, E, F, H | B, E, F, I | B, E, G, H | B, E, G, I | B, E, H, I | B, F, G, H | D, E, H, I |
| B, F, G, I | B, F, H, I | B, G, H, I | C, D, E, F | C, D, E, G | C, D, E, H | C, D, E, I | C, D, F, G | D, F, G, H |
| C, D, F, H | C, D, F, I | C, D, G, H | C, D, G, I | C, D, H, I | C, E, F, G | C, E, F, H | C, E, F, I | D, F, G, I |
| C, E, G, H | C, E, G, I | C, E, H, I | C, F, G, H | C, F, G, I | C, F, H, I | C, G, H, I | D, E, F, G | D, F, H, I |

TABLE 8

Three Strain Compositions

| | | | | | | | | | |
|---|---|---|---|---|---|---|---|---|---|
| A, B, C | A, B, D | A, B, E | A, B, F | A, B, G | A, B, H | A, B, I | A, C, D | A, C, E | G, H, I | E, F, H |
| A, C, F | A, C, G | A, C, H | A, C, I | A, D, E | A, D, F | A, D, G | A, D, H | A, D, I | F, H, I | E, F, G |
| A, E, F | A, E, G | A, E, H | A, E, I | A, F, G | A, F, H | A, F, I | A, G, H | A, G, I | F, G, I | D, H, I |
| A, H, I | B, C, D | B, C, E | B, C, F | B, C, G | B, C, H | B, C, I | B, D, E | B, D, F | F, G, H | D, G, I |
| B, D, G | B, D, H | B, D, I | B, E, F | B, E, G | B, E, H | B, E, I | B, F, G | B, F, H | E, H, I | E, F, I |
| B, F, I | B, G, H | B, G, I | B, H, I | C, D, E | C, D, F | C, D, G | C, D, H | C, D, I | E, G, I | D, G, H |
| C, E, F | C, E, G | C, E, H | C, E, I | C, F, G | C, F, H | C, F, I | C, G, H | C, G, I | E, G, H | D, F, I |
| C, H, I | D, E, F | D, E, G | D, E, H | D, E, I | D, F, G | D, F, H | | | | |

TABLE 9

Two Strain Compositions

| | | | | | | | | | | | | | | | | | |
|---|---|---|---|---|---|---|---|---|---|---|---|---|---|---|---|---|---|
| A, B | A, C | A, D | A, E | A, F | A, G | A, H | A, I | B, C | B, D | B, E | B, F | B, G | B, H | B, I | C, D |
| C, E | C, F | C, G | C, H | C, I | D, E | D, F | D, G | D, H | D, I | E, F | E, G | E, H | E, I | F, G | F, H |
| F, I | G, H | G, I | H, I | | | | | | | | | | | | |

In some embodiments, the microbial compositions may be selected from any member group from Tables 3-9.

Isolated Microbes—Source Material

In particular embodiments, the microbes of the present compositions are not naturally found in association with the same animal. In some aspects, the microbial species forming the microbial community are all found in association with animals from the same geographic location. In other aspects, each microbial species forming the composition is from a different geographic location. A geographic location can be defined based upon the predominant soil type in a region, the predominant climate in a region, the predominant plant community present in a region, the predominant plant community present in a region, the distance between regions, the average rainfall in a region, among others.

In some embodiments, the microbes of the present compositions are not naturally found in association with the same species of animal. In some embodiments, the microbes of the present compositions are found in the same species of animal, but separated by geographic region.

In a particular embodiment, at least one microbial species that is a member of the microbial community derived by the disclosed method is native to, or was acquired from, a geographic region at least about 1 m, 10 m, 100 m, 1 km, 10 km, 100 km, 1,000 km, 10,000 km, 20,000 km, 30,000 km, or 40,000 km from the location of the plant upon which a phenotypic trait is to be increased based upon the taught methods.

The microbes of the present disclosure were obtained, among other places, at various locales in the United States from the gastrointestinal tract of beef cattle.

Isolated Microbes—Microbial Culture Techniques

The microbes of Table 1 and Table 2 were matched to their nearest taxonomic groups by utilizing classification tools of the Ribosomal Database Project (RDP) for 16s rRNA sequences and the User-friendly Nordic ITS Ectomycorrhiza (UNITE) database for ITS rRNA sequences. Examples of matching microbes to their nearest taxa may be found in Lan et al. (2012. *PLOS one.* 7(3):e32491), Schloss and Westcott (2011. *Appl. Environ. Microbiol.* 77(10):3219-3226), and Koljalg et al. (2005. *New Phytologist.* 166(3): 1063-1068).

The isolation, identification, and culturing of the microbes of the present disclosure can be effected using standard microbiological techniques. Examples of such techniques may be found in Gerhardt, P. (ed.) Methods for General and Molecular Microbiology. American Society for Microbiology, Washington, D.C. (1994) and Lennette, E. H. (ed.) Manual of Clinical Microbiology, Third Edition. American Society for Microbiology, Washington, D.C. (1980), each of which is incorporated by reference.

Isolation can be effected by streaking the specimen on a solid medium (e.g., nutrient agar plates) to obtain a single colony, which is characterized by the phenotypic traits described hereinabove (e.g., Gram positive/negative, capable of forming spores aerobically/anaerobically, cellular morphology, carbon source metabolism, acid/base production, enzyme secretion, metabolic secretions, etc.) and to reduce the likelihood of working with a culture which has become contaminated.

For example, for microbes of the disclosure, biologically pure isolates can be obtained through repeated subculture of biological samples, each subculture followed by streaking onto solid media to obtain individual colonies or colony forming units. Methods of preparing, thawing, and growing lyophilized bacteria are commonly known, for example, Gherna, R. L. and C. A. Reddy. 2007. Culture Preservation, p 1019-1033. In C. A. Reddy, T. J. Beveridge, J. A. Breznak, G. A. Marzluf, T. M. Schmidt, and L. R. Snyder, eds. American Society for Microbiology, Washington, D.C., 1033 pages; herein incorporated by reference. Thus freeze dried liquid formulations and cultures stored long term at $-70°$ C. in solutions containing glycerol are contemplated for use in providing formulations of the present disclosure.

The microbes of the disclosure can be propagated in a liquid medium under aerobic conditions, or alternatively anaerobic conditions. Medium for growing the bacterial strains of the present disclosure includes a carbon source, a nitrogen source, and inorganic salts, as well as specially required substances such as vitamins, amino acids, nucleic acids and the like. Examples of suitable carbon sources which can be used for growing the microbes include, but are not limited to, starch, peptone, yeast extract, amino acids, sugars such as glucose, arabinose, mannose, glucosamine, maltose, and the like; salts of organic acids such as acetic acid, fumaric acid, adipic acid, propionic acid, citric acid, gluconic acid, malic acid, pyruvic acid, malonic acid and the like; alcohols such as ethanol and glycerol and the like; oil or fat such as soybean oil, rice bran oil, olive oil, corn oil, sesame oil. The amount of the carbon source added varies according to the kind of carbon source and is typically between 1 to 100 gram(s) per liter of medium. Preferably, glucose, starch, and/or peptone is contained in the medium as a major carbon source, at a concentration of 0.1-5% (W/V). Examples of suitable nitrogen sources which can be used for growing the bacterial strains of the present disclosure include, but are not limited to, amino acids, yeast extract, tryptone, beef extract, peptone, potassium nitrate, ammonium nitrate, ammonium chloride, ammonium sulfate, ammonium phosphate, ammonia or combinations thereof. The amount of nitrogen source varies according to the type of nitrogen source, typically between 0.1 to 30 gram per liter of medium. The inorganic salts, potassium dihydrogen phosphate, dipotassium hydrogen phosphate, disodium hydrogen phosphate, magnesium sulfate, magnesium chloride, ferric sulfate, ferrous sulfate, ferric chloride, ferrous chloride, manganous sulfate, manganous chloride, zinc sulfate, zinc chloride, cupric sulfate, calcium chloride, sodium chloride, calcium carbonate, sodium carbonate can be used alone or in combination. The amount of inorganic acid varies according to the kind of the inorganic salt, typically between 0.001 to 10 gram per liter of medium. Examples of specially required substances include, but are not limited to, vitamins, nucleic acids, yeast extract, peptone, meat extract, malt extract, dried yeast and combinations thereof. Cultivation can be effected at a temperature, which allows the growth of the microbial strains, essentially, between 20° C. and 46° C. In some aspects, a temperature range is 30° C.-39° C. For optimal growth, in some embodiments, the medium can be adjusted to pH 6.0-7.4. It will be appreciated that commercially available media may also be used to culture the microbial strains, such as Nutrient Broth or Nutrient Agar available from Difco, Detroit, Mich. It will be appreciated that cultivation time may differ depending on the type of culture medium used and the concentration of sugar as a major carbon source.

In some aspects, cultivation lasts between 24-96 hours. Microbial cells thus obtained are isolated using methods, which are well known in the art. Examples include, but are not limited to, membrane filtration and centrifugal separation. The pH may be adjusted using sodium hydroxide and the like and the culture may be dried using a freeze dryer, until the water content becomes equal to 4% or less. Microbial co-cultures may be obtained by propagating each strain as described hereinabove. In some aspects, microbial multi-strain cultures may be obtained by propagating two or more of the strains described hereinabove. It will be appreciated that the microbial strains may be cultured together when compatible culture conditions can be employed.

Isolated Microbes—Microbial Strains

Microbes can be distinguished into a genus based on polyphasic taxonomy, which incorporates all available phenotypic and genotypic data into a consensus classification (Vandamme et al. 1996. Polyphasic taxonomy, a consensus approach to bacterial systematics. *Microbial Rev* 1996, 60:407-438). One accepted genotypic method for defining species is based on overall genomic relatedness, such that strains which share approximately 70% or more relatedness using DNA-DNA hybridization, with 5° C. or less $\Delta T_m$ (the difference in the melting temperature between homologous and heterologous hybrids), under standard conditions, are considered to be members of the same species. Thus, populations that share greater than the aforementioned 70% threshold can be considered to be variants of the same species. Another accepted genotypic method for defining species is to isolate marker genes of the present disclosure, sequence these genes, and align these sequenced genes from multiple isolates or variants. The microbes are interpreted as belonging to the same species if one or more of the sequenced genes share at least 97% sequence identity.

The 16S or 18S rRNA sequences or ITS sequences are often used for making distinctions between species and strains, in that if one of the aforementioned sequences shares less than a specified % sequence identity from a reference sequence, then the two organisms from which the sequences were obtained are said to be of different species or strains.

Thus, one could consider microbes to be of the same species, if they share at least 80%, 85%, 90%, 95%, 97%, 98%, or 99% sequence identity across the 16S or 18S rRNA sequence, or the ITS1 or ITS2 sequence.

Further, one could define microbial strains of a species, as those that share at least 80%, 85%, 90%, 95%, 97%, 98%, or 99% sequence identity across the 16S or 18S rRNA sequence, or the ITS1 or ITS2 sequence.

In one embodiment, microbial strains of the present disclosure include those that comprise polynucleotide sequences that share at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity with any one of SEQ ID NOs:1-5,993. In a further embodiment, microbial strains of the present disclosure include those that comprise polynucleotide sequences that share at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity with any one of SEQ ID NOs:1-5,993.

Comparisons may also be made with 23S rRNA sequences against reference sequences.

Unculturable microbes often cannot be assigned to a definite species in the absence of a phenotype determination, the microbes can be given a candidatus designation within a genus provided their 16S or 18S rRNA sequences or ITS sequences subscribes to the principles of identity with known species.

One approach is to observe the distribution of a large number of strains of closely related species in sequence space and to identify clusters of strains that are well resolved from other clusters. This approach has been developed by using the concatenated sequences of multiple core (housekeeping) genes to assess clustering patterns, and has been called multilocus sequence analysis (MLSA) or multilocus sequence phylogenetic analysis. MLSA has been used successfully to explore clustering patterns among large numbers of strains assigned to very closely related species by current taxonomic methods, to look at the relationships between small numbers of strains within a genus, or within a broader taxonomic grouping, and to address specific taxonomic questions. More generally, the method can be used to ask whether bacterial species exist—that is, to observe whether large populations of similar strains invariably fall into well-resolved clusters, or whether in some cases there is a genetic continuum in which clear separation into clusters is not observed.

In order to more accurately make a determination of genera, a determination of phenotypic traits, such as morphological, biochemical, and physiological characteristics are made for comparison with a reference genus archetype. The colony morphology can include color, shape, pigmentation, production of slime, etc. Features of the cell are described as to shape, size, Gram reaction, extracellular material, presence of endospores, flagella presence and location, motility, and inclusion bodies. Biochemical and physiological features describe growth of the organism at different ranges of temperature, pH, salinity and atmospheric conditions, growth in presence of different sole carbon and nitrogen sources. One of ordinary skill in the art would be reasonably apprised as to the phenotypic traits that define the genera of the present disclosure.

In one embodiment, the microbes taught herein were identified utilizing 16S rRNA gene sequences and ITS sequences. It is known in the art that 16S rRNA contains hypervariable regions that can provide species/strain-specific signature sequences useful for bacterial identification, and that ITS sequences can also provide species/strain-specific signature sequences useful for fungal identification.

Phylogenetic analysis using the rRNA genes and/or ITS sequences are used to define "substantially similar" species belonging to common genera and also to define "substantially similar" strains of a given taxonomic species. Furthermore, physiological and/or biochemical properties of the isolates can be utilized to highlight both minor and significant differences between strains that could lead to advantageous behavior in beef cattle.

Compositions of the present disclosure may include combinations of fungal spores and bacterial spores, fungal spores and bacterial vegetative cells, fungal vegetative cells and bacterial spores, fungal vegetative cells and bacterial vegetative cells. In some embodiments, compositions of the present disclosure comprise bacteria only in the form of spores. In some embodiments, compositions of the present disclosure comprise bacteria only in the form of vegetative cells. In some embodiments, compositions of the present disclosure comprise bacteria in the absence of fungi. In some embodiments, compositions of the present disclosure comprise fungi in the absence of bacteria. In some embodiments, compositions of the present disclosure comprise VBNC bacteria and/or fungi. In some embodiments, compositions of the present disclosure comprise bacteria and/or fungi in a quiescent state. In some embodiments, compositions of the present disclosure include dormant bacteria and/or fungi.

Bacterial spores may include endospores and akinetes. Fungal spores may include statismospores, ballistospores, autospores, aplanospores, zoospores, mitospores, megaspores, microspores, meiospores, chlamydospores, urediniospores, teliospores, oospores, carpospores, tetraspores, sporangiospores, zygospores, ascospores, basidiospores, ascospores, and asciospores.

In some embodiments, spores of the composition germinate upon administration to animals of the present disclosure. In some embodiments, spores of the composition germinate only upon administration to animals of the present disclosure.

Microbial Compositions

In some embodiments, the microbes of the disclosure are combined into microbial compositions.

In some embodiments, the microbial compositions include cattle feed, such as grain and grain byproducts (barley, maize, oats, sorghum, wheat, distillers grains, sweet bran, and the like); roughage (alfalfa, silage, fescue, clover, ryegrass, and the like); starches (tapioca and the like); protein (oilseed cakes, vegetable wastes, corn by-products, wheat by-products, and the like); liquid feeds (condensed corn distillers solubles, molasses, tallow, yellow grease, corn oil, and the like); or non-nitrogen protein. In some embodiments, the microbial compositions include vitamins and/or metabolites thereof, minerals, urea, trace elements, emulsifiers, aromatizing products, binders, colorants, odorants, thickening agents, antibiotics, and the like. In some embodiments, the microbial compositions include one or more of an ionophore; vaccine, antibiotic; antihelmintic; virucide; nematicide; amino acids such as methionine, glutamine, valine, glycine, cysteine, homocysteine, aspartic acid, and arginine; fish oil; oregano; carnitine, pantoate, pantothenate, aspartate, and biologically active molecules such as enzymes.

In some embodiments, the vitamins include vitamin B5, B1, B2, B3, B6, B9, B12, H, C, A, D, E, or K; and combinations thereof. In some embodiments, the microbial compositions include microbes that synthesize vitamin B5, B1, B2, B3, B6, B9, B12, H, C, A, D, E, and/or K. In some embodiments, the microbial compositions include microbes that synthesize vitamin B5. In some embodiments, the metabolites of vitamin B5, B1, B2, B3, B6, B9, B12, H, C, A, D, E, or K are contemplated as one or more components of a microbial composition of the present disclosure. In one embodiment, pantothenate is a component of a microbial composition of the present disclosure. In one embodiment, a component of a microbial composition of the present disclosure includes one or more precursors utilized by mammalian or microbial biosynthesis of vitamins.

In some embodiments, the microbial compositions of the present disclosure are solid. Where solid compositions are used, it may be desired to include one or more carrier materials including, but not limited to: mineral earths such as silicas, talc, kaolin, limestone, chalk, clay, dolomite, diatomaceous earth; calcium sulfate; magnesium sulfate; magnesium oxide; zeolites, calcium carbonate; magnesium carbonate; trehalose; chitosan; shellac; albumins; starch; skim milk powder; sweet whey powder; maltodextrin; lactose; inulin; dextrose; and products of vegetable origin such as cereal meals, tree bark meal, wood meal, and nutshell meal.

In some embodiments, the microbial compositions of the present disclosure are liquid. In further embodiments, the liquid comprises a solvent that may include water or an alcohol or a saline or carbohydrate solution, and other animal-safe solvents. In some embodiments, the microbial compositions of the present disclosure include binders such as animal-safe polymers, carboxymethylcellulose, starch, polyvinyl alcohol, and the like.

In some embodiments, the microbial compositions of the present disclosure comprise thickening agents such as silica, clay, natural extracts of seeds or seaweed, synthetic derivatives of cellulose, guar gum, locust bean gum, alginates, and methylcelluloses. In some embodiments, the microbial compositions comprise anti-settling agents such as modified starches, polyvinyl alcohol, xanthan gum, and the like.

In some embodiments, the microbial compositions of the present disclosure comprise colorants including organic chromophores classified as nitroso; nitro; azo, including monoazo, bisazo and polyazo; acridine, anthraquinone, azine, diphenylmethane, indamine, indophenol, methine, oxazine, phthalocyanine, thiazine, thiazole, triarylmethane, xanthene. In some embodiments, the microbial compositions of the present disclosure comprise trace nutrients such as salts of iron, manganese, boron, copper, cobalt, molybdenum and zinc. In some embodiments, the microbial compositions comprise dyes, both natural and artificial. In some embodiments, the dye is green in color.

In some embodiments, the microbial compositions of the present disclosure comprise an animal-safe virucide, parasiticide, bacteriocide, fungicide, or nematicide.

In some embodiments, microbial compositions of the present disclosure comprise saccharides (e.g., monosaccharides, disaccharides, trisaccharides, polysaccharides, oligosaccharides, and the like), polymeric saccharides, lipids, polymeric lipids, lipopolysaccharides, proteins, polymeric proteins, lipoproteins, nucleic acids, nucleic acid polymers, silica, inorganic salts and combinations thereof. In a further embodiment, microbial compositions comprise polymers of agar, agarose, gelrite, gellan gum, and the like. In some embodiments, microbial compositions comprise plastic capsules, emulsions (e.g., water and oil), membranes, and artificial membranes. In some embodiments, emulsions or linked polymer solutions may comprise microbial compositions of the present disclosure. See Harel and Bennett (U.S. Pat. No. 8,460,726 B2).

In some embodiments, microbial compositions of the present disclosure comprise one or more exygen scavengers, denitrifies, nitrifiers, heavy metal chelators, and/or dechlorinators; and combinations thereof. In one embodiment, the one or more exygen scavengers, denitrifiers, nitrifiers, heavy metal chelators, and/or dechlorinators are not chemically active once the microbial compositions are mixed with food and/or water to be administered to the animal. In one embodiment, the one or more oxygen scavengers, denitrifiers, nitrifiers, heavy metal chelators, and/or dechlorinators are not chemically active when administered to the animal.

In some embodiments, microbial compositions of the present disclosure occur in a solid form (e.g., dispersed lyophilized spores) or a liquid form (microbes interspersed in a storage medium). In some embodiments, microbial compositions of the present disclosure are added in dry form to a liquid to a liquid to form a suspension immediately prior to administration In some embodiments, microbial compositions of the present disclosure comprise one or more preservatives. The preservatives may be in liquid or gas formulations. The preservatives may be selected from one or more of monosaccharide, disaccharide, trisaccharide, polysaccharide, acetic acid, ascorbic acid, calcium ascorbate, erythorbic acid, iso-ascorbic acid, erythrobic acid, potassium nitrate, sodium ascorbate, sodium erythorbate, sodium iso-ascorbate, sodium nitrate, sodium nitrite, nitrogen, benzoic acid, calcium sorbate, ethyl lauroyl arginate, methyl-p-hydroxy benzoate, methyl paraben, potassium acetate, potassium benzoiate, potassium bisulphite, potassium diacetate, potassium lactate, potassium metabisulphite, potassium sorbate, propyl-p-hydroxy benzoate, propyl paraben, sodium acetate, sodium benzoate, sodium bisulphite, sodium nitrite, sodium diacetate, sodium lactate, sodium metabisulphite, sodium salt of methyl-p-hydroxy benzoic acid, sodium salt of propyl-p-hydroxy benzoic acid, sodium sulphate, sodium sulfite, sodium dithionite, sulphurous acid, calcium propionate, dimethyl dicarbonate, natamycin, potassium sorbate, potassium bisulfite, potassium metabisulfite, propionic acid, sodium diacetate, sodium propionate, sodium sorbate, sorbic acid, ascorbic acid, ascorbyl palmitate, ascorbyl stearate, butylated hydro-xyanisole, butylated hydroxytoluene (BHT), butylated hydroxyl anisole (BHA), citric acid, citric acid esters of mono- and/or diglycerides, L-cysteine, L-cysteine hydrochloride, gum guaiacum, gum guaiac, lecithin, lecithin citrate, monoglyceride citrate, monoisopropyl citrate, propyl gallate, sodium metabisulphite, tartaric acid, tertiary butyl hydroquinone, stannous chloride, thiodipropionic acid, dilauryl thiodipropionate, distearyl thiodipropionate, ethoxyquin, sulfur dioxide, formic acid, or tocopherol(s).

In some embodiments, microbial compositions of the present disclosure comprise one or more oxygen scavengers, denitrifiers, nitrifiers, heavy metal chelators, and/or dechlorinators; and combinations thereof. In one embodiment, the one or more oxygen scavengers, denitrifiers, nitrifiers, heavy metal chelators, and/or dechlorinators are not chemically active once the microbial compositions are mixed with food and/or water to be administered to the beef cattle. In one embodiment, the one or more oxygen scavengers, denitrifiers, nitrifiers, heavy metal chelators, and/or dechlorinators are not chemically active when administered to the beef cattle.

In some embodiments, microbial compositions of the present disclosure include bacterial and/or fungal cells in spore form, vegetative cell form, and/or lysed cell form. In one embodiment, the lysed cell form acts as a mycotoxin binder, e.g. mycotoxins binding to dead cells.

In some embodiments, the microbial compositions are shelf stable in a refrigerator (35-40° F.) for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 days. In some embodiments, the microbial compositions are shelf stable in a refrigerator (35-40° F.) for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 weeks.

In some embodiments, the microbial compositions are shelf stable at room temperature (68-72° F.) or between 50-77° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 days. In some embodiments, the microbial compositions are shelf stable at room temperature (68-72° F.) or between 50-77° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 weeks.

In some embodiments, the microbial compositions are shelf stable at −23-35° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 days. In some embodiments, the microbial compositions are shelf stable at −23-35° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 weeks.

In some embodiments, the microbial compositions are shelf stable at 77-100° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 days. In some embodiments, the microbial compositions are shelf stable at 77-100° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 weeks.

In some embodiments, the microbial compositions are shelf stable at 101-213° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 days. In some embodiments, the microbial compositions are shelf stable at 101-213° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 weeks.

In some embodiments, the microbial compositions of the present disclosure are shelf stable at refrigeration temperatures (35-40° F.), at room temperature (68-72° F.), between 50-77° F., between −23-35° F., between 70-100° F., or between 101-213° F. for a period of about 1 to 100, about 1 to 95, about 1 to 90, about 1 to 85, about 1 to 80, about 1 to 75, about 1 to 70, about 1 to 65, about 1 to 60, about 1 to 55, about 1 to 50, about 1 to 45, about 1 to 40, about 1 to 35, about 1 to 30, about 1 to 25, about 1 to 20, about 1 to 15, about 1 to 10, about 1 to 5, about 5 to 100, about 5 to 95, about 5 to 90, about 5 to 85, about 5 to 80, about 5 to 75, about 5 to 70, about 5 to 65, about 5 to 60, about 5 to 55, about 5 to 50, about 5 to 45, about 5 to 40, about 5 to 35, about 5 to 30, about 5 to 25, about 5 to 20, about 5 to 15, about 5 to 10, about 10 to 100, about 10 to 95, about 10 to 90, about 10 to 85, about 10 to 80, about 10 to 75, about 10 to 70, about 10 to 65, about 10 to 60, about 10 to 55, about 10 to 50, about 10 to 45, about 10 to 40, about 10 to 35, about 10 to 30, about 10 to 25, about 10 to 20, about 10 to 15, about 15 to 100, about 15 to 95, about 15 to 90, about 15 to 85, about 15 to 80, about 15 to 75, about 15 to 70, about 15 to 65, about 15 to 60, about 15 to 55, about 15 to 50, about 15 to 45, about 15 to 40, about 15 to 35, about 15 to 30, about 15 to 25, about 15 to 20, about 20 to 100, about 20 to 95, about 20 to 90, about 20 to 85, about 20 to 80, about 20 to 75, about 20 to 70, about 20 to 65, about 20 to 60, about 20 to 55, about 20 to 50, about 20 to 45, about 20 to 40, about 20 to 35, about 20 to 30, about 20 to 25, about 25 to 100, about 25 to 95, about 25 to 90, about 25 to 85, about 25 to 80, about 25 to 75, about 25 to 70, about 25 to 65, about 25 to 60, about 25 to 55, about 25 to 50, about 25 to 45, about 25 to 40, about 25 to 35, about 25 to 30, about 30 to 100, about 30 to 95, about 30 to 90, about 30 to 85, about 30 to 80, about 30 to 75, about 30 to 70, about 30 to 65, about 30 to 60, about 30 to 55, about 30 to 50, about 30 to 45, about 30 to 40, about 30 to 35, about 35 to 100, about 35 to 95, about 35 to 90, about 35 to 85, about 35 to 80, about 35 to 75, about 35 to 70, about 35 to 65, about 35 to 60, about 35 to 55, about 35 to 50, about 35 to 45, about 35 to 40, about 40 to 100, about 40 to 95, about 40 to 90, about 40 to 85, about 40 to 80, about 40 to 75, about 40 to 70, about 40 to 65, about 40 to 60, about 40 to 55, about 40 to 50, about 40 to 45, about 45 to 100, about 45 to 95, about 45 to 90, about 45 to 85, about 45 to 80, about 45 to 75, about 45 to 70, about 45 to 65, about 45 to 60, about 45 to 55, about 45 to 50, about 50 to 100, about 50 to 95, about 50 to 90, about 50 to 85, about 50 to 80, about 50 to 75, about 50 to 70, about 50 to 65, about 50 to 60, about 50 to 55, about 55 to 100, about 55 to 95, about 55 to 90, about 55 to 85, about 55 to 80, about 55 to 75, about 55 to 70, about 55 to 65, about 55 to 60, about 60 to 100, about 60 to 95, about 60 to 90, about 60 to 85, about 60 to 80, about 60 to 75, about 60 to 70, about 60 to 65, about 65 to 100, about 65 to 95, about 65 to 90, about 65 to 85, about 65 to 80, about 65 to 75, about 65 to 70, about 70 to 100, about 70 to 95, about 70 to 90, about 70 to 85, about 70 to 80, about 70 to 75, about 75 to 100, about 75 to 95, about 75 to 90, about 75 to 85, about 75 to 80, about 80 to 100, about 80 to 95, about 80 to 90, about 80 to 85, about 85 to 100, about 85 to 95, about 85 to 90, about 90 to 100, about 90 to 95, or 95 to 100 weeks In some embodiments, the microbial compositions of the present disclosure are shelf stable at refrigeration temperatures (35-40° F.), at room temperature (68-72° F.), between 50-77° F., between −23-35° F., between 70-100° F., or between 101-213° F. for a period of 1 to 100, 1 to 95, 1 to 90, 1 to 85, 1 to 80, 1 to 75, 1 to 70, 1 to 65, 1 to 60, 1 to 55, 1 to 50, 1 to 45, 1 to 40, 1 to 35, 1 to 30, 1 to 25, 1 to 20, 1 to 15, 1 to 10, 1 to 5, 5 to 100, 5 to 95, 5 to 90, 5 to 85, 5 to 80, 5 to 75, 5 to 70, 5 to 65, 5 to 60, 5 to 55, 5 to 50, 5 to 45, 5 to 40, 5 to 35, 5 to 30, 5 to 25, 5 to 20, 5 to 15, 5 to 10, 10 to 100, 10 to 95, 10 to 90, 10 to 85, 10 to 80, 10 to 75, 10 to 70, 10 to 65, 10 to 60, 10 to 55, 10 to 50, 10 to 45, 10 to 40, 10 to 35, 10 to 30, 10 to 25, 10 to 20, 10 to 15, 15 to 100, 15 to 95, 15 to 90, 15 to 85, 15 to 80, 15 to 75, 15 to 70, 15 to 65, 15 to 60, 15 to 55, 15 to 50, 15 to 45, 15 to 40, 15 to 35, 15 to 30, 15 to 25, 15 to 20, 20 to 100, 20 to 95, 20 to 90, 20 to 85, 20 to 80, 20 to 75, 20 to 70, 20 to 65, 20 to 60, 20 to 55, 20 to 50, 20 to 45, 20 to 40, 20 to 35, 20 to 30, 20 to 25, 25 to 100, 25 to 95, 25 to 90, 25 to 85, 25 to 80, 25 to 75, 25 to 70, 25 to 65, 25 to 60, 25 to 55, 25 to 50, 25 to 45, 25 to 40, 25 to 35, 25 to 30, 30 to 100, 30 to 95, 30 to 90, 30 to 85, 30 to 80, 30 to 75, 30 to 70, 30 to 65, 30 to 60, 30 to 55, 30 to 50, 30 to 45, 30 to 40, 30 to 35, 35 to 100, 35 to 95, 35 to 90, 35 to 85, 35 to 80, 35 to 75, 35 to 70, 35 to 65, 35 to 60, 35 to 55, 35 to 50, 35 to 45, 35 to 40, 40 to 100, 40 to 95, 40 to 90, 40 to 85, 40 to 80, 40 to 75, 40 to 70, 40 to 65, 40 to 60, 40 to 55, 40 to 50, 40 to 45, 45 to 100, 45 to 95, 45 to 90, 45 to 85, 45 to 80, 45 to 75, 45 to 70, 45 to 65, 45 to 60, 45 to 55, 45 to 50, 50 to 100, 50 to 95, 50 to 90, 50 to 85, 50 to 80, 50 to 75, 50 to 70, 50 to 65, 50 to 60, 50 to 55, 55 to 100, 55 to 95, 55 to 90, 55 to 85, 55 to 80, 55 to 75, 55 to 70, 55 to 65, 55 to 60, 60 to 100, 60 to 95, 60 to 90, 60 to 85, 60 to 80, 60 to 75, 60 to 70, 60 to 65, 65 to 100, 65 to 95, 65 to 90, 65 to 85, 65 to 80, 65 to 75, 65 to 70, 70 to 100, 70 to 95, 70 to 90, 70 to 85, 70 to 80, 70 to 75, 75 to 100, 75 to 95, 75 to 90, 75 to 85, 75 to 80, 80 to 100, 80 to 95, 80 to 90, 80 to 85, 85 to 100, 85 to 95, 85 to 90, 90 to 100, 90 to 95, or 95 to 100 weeks.

In some embodiments, the microbial compositions of the present disclosure are shelf stable at refrigeration temperatures (35-40° F.), at room temperature (68-72° F.), between 50-77° F., between −23-35° F., between 70-100° F., or between 101-213° F. for a period of about 1 to 36, about 1 to 34, about 1 to 32, about 1 to 30, about 1 to 28, about 1 to 26, about 1 to 24, about 1 to 22, about 1 to 20, about 1 to 18, about 1 to 16, about 1 to 14, about 1 to 12, about 1 to 10, about 1 to 8, about 1 to 6, about 1 one 4, about 1 to 2, about 4 to 36, about 4 to 34, about 4 to 32, about 4 to 30, about 4 to 28, about 4 to 26, about 4 to 24, about 4 to 22, about 4 to 20, about 4 to 18, about 4 to 16, about 4 to 14, about 4 to 12, about 4 to 10, about 4 to 8, about 4 to 6, about 6 to 36, about 6 to 34, about 6 to 32, about 6 to 30, about 6 to 28, about 6 to 26, about 6 to 24, about 6 to 22, about 6 to 20, about 6 to 18, about 6 to 16, about 6 to 14, about 6 to 12, about 6 to 10, about 6 to 8, about 8 to 36, about 8 to 34, about 8 to 32, about 8 to 30, about 8 to 28, about 8 to 26, about 8 to 24, about 8 to 22, about 8 to 20, about 8 to 18, about 8 to 16, about 8 to 14, about 8 to 12, about 8 to 10, about 10 to 36, about 10 to 34, about 10 to 32, about 10 to 30, about 10 to 28, about 10 to 26, about 10 to 24, about 10 to 22, about 10 to 20, about 10 to 18, about 10 to 16, about 10 to 14, about 10 to 12, about 12 to 36, about 12 to 34, about 12 to 32, about 12 to 30, about 12 to 28, about 12 to 26, about 12 to 24, about 12 to 22, about 12 to 20, about 12 to 18, about 12 to 16, about 12 to 14, about 14 to 36, about 14 to 34, about 14 to 32, about 14 to 30, about 14 to 28, about 14 to 26, about 14 to 24, about 14 to 22, about 14 to 20, about 14 to 18, about 14 to 16, about 16 to 36, about 16 to 34, about 16 to 32, about 16 to 30, about 16 to 28, about 16 to 26, about 16 to 24, about 16 to 22, about 16 to 20, about 16 to 18, about 18 to 36, about 18 to 34, about 18 to 32, about 18 to 30, about 18 to 28, about 18 to 26, about 18 to 24, about 18 to 22, about 18 to 20, about 20 to 36, about 20 to 34, about 20 to 32, about 20 to 30, about 20 to 28, about 20 to 26, about 20 to 24, about 20 to 22, about 22 to 36, about 22 to 34, about 22 to 32, about 22 to 30, about 22 to 28, about 22 to 26, about 22 to 24, about 24 to 36, about 24 to 34, about 24 to 32, about 24 to 30, about 24 to 28, about 24 to 26, about 26 to 36, about 26 to 34, about 26 to 32, about 26 to 30, about 26 to 28, about 28 to 36, about 28 to 34, about 28 to 32, about 28 to 30, about 30 to 36, about 30 to 34, about 30 to 32, about 32 to 36, about 32 to 34, or about 34 to 36 months.

In some embodiments, the microbial compositions of the present disclosure are shelf stable at refrigeration temperatures (35-40° F.), at room temperature (68-72° F.), between 50-77° F., between −23-35° F., between 70-100° F., or between 101-213° F. for a period of 1 to 36 1 to 34 1 to 32 1 to 30 1 to 28 1 to 26 1 to 24 1 to 22 1 to 20 1 to 18 1 to 16 1 to 14 1 to 12 1 to 10 1 to 8 1 to 6 1 one 4 1 to 2 4 to 36 4 to 34 4 to 32 4 to 30 4 to 28 4 to 26 4 to 24 4 to 22 4 to 20 4 to 18 4 to 16 4 to 14 4 to 12 4 to 10 4 to 8 4 to 6 6 to 36 6 to 34 6 to 32 6 to 30 6 to 28 6 to 26 6 to 24 6 to 22 6 to 20 6 to 18 6 to 16 6 to 14 6 to 12 6 to 10 6 to 8 8 to 36 8 to 34 8 to 32 8 to 30 8 to 28 8 to 26 8 to 24 8 to 22 8 to 20 8 to 18 8 to 16 8 to 14 8 to 12 8 to 10 10 to 36 10 to 34 10 to 32 10 to 30 10 to 28 10 to 26 10 to 24 10 to 22 10 to 20 10 to 18 10 to 16 10 to 14 10 to 12 12 to 36 12 to 34 12 to 32 12 to 30 12 to 28 12 to 26 12 to 24 12 to 22 12 to 20 12 to 18 12 to 16 12 to 14 14 to 36 14 to 34 14 to 32 14 to 30 14 to 28 14 to 26 14 to 24 14 to 22 14 to 20 14 to 18 14 to 16 16 to 36 16 to 34 16 to 32 16 to 30 16 to 28 16 to 26 16 to 24 16 to 22 16 to 20 16 to 18 18 to 36 18 to 34 18 to 32 18 to 30 18 to 28 18 to 26 18 to 24 18 to 22 18 to 20 20 to 36 20 to 34 20 to 32 20 to 30 20 to 28 20 to 26 20 to 24 20 to 22 22 to 36 22 to 34 22 to 32 22 to 30 22 to 28 22 to 26 22 to 24 24 to 36 24 to 34 24 to 32 24 to 30 24 to 28 24 to 26 26 to 36 26 to 34 26 to 32 26 to 30 26 to 28 28 to 36 28 to 34 28 to 32 28 to 30 30 to 36 30 to 34 30 to 32 32 to 36 32 to 34, or about 34 to 36.

In some embodiments, the microbial compositions of the present disclosure are shelf stable at any of the disclosed temperatures and/or temperature ranges and spans of time at a relative humidity of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, or 98%.

In some embodiments, the microbial composition of the present disclosure possesses a water activity ($a_w$) of less than 0.750, 0.700, 0.650, 0.600, 0.550, 0.500, 0.475, 0.450, 0.425, 0.400, 0.375, 0.350, 0.325, 0.300, 0.275, 0.250, 0.225, 0.200, 0.190, 0.180, 0.170, 0.160, 0.150, 0.140, 0.130, 0.120, 0.110, 0.100, 0.095, 0.090, 0.085, 0.080, 0.075, 0.070, 0.065, 0.060, 0.055, 0.050, 0.045, 0.040, 0.035, 0.030, 0.025, 0.020, 0.015, 0.010, or 0.005.

In some embodiments, the microbial composition of the present disclosure possesses a water activity ($a_w$) of less than about 0.750, about 0.700, about 0.650, about 0.600, about 0.550, about 0.500, about 0.475, about 0.450, about 0.425, about 0.400, about 0.375, about 0.350, about 0.325, about 0.300, about 0.275, about 0.250, about 0.225, about 0.200, about 0.190, about 0.180, about 0.170, about 0.160, about 0.150, about 0.140, about 0.130, about 0.120, about 0.110, about 0.100, about 0.095, about 0.090, about 0.085, about 0.080, about 0.075, about 0.070, about 0.065, about 0.060, about 0.055, about 0.050, about 0.045, about 0.040, about 0.035, about 0.030, about 0.025, about 0.020, about 0.015, about 0.010, or about 0.005.

The water activity values are determined by the method of Saturated Aqueous Solutions (Multon, "Techniques d'Analyse E De Controle Dans Les Industries Agroalimentaires" APRIA (1981)) or by direct measurement using a viable Robotronic BT hygrometer or other hygrometer or hygroscope.

In some embodiments, the microbial composition comprises at least two different microbes, and wherein the at least two microbes are present in the composition at a ratio of 1:2, 1:3, 1:3, 1:5, 1:6, 1:7, 1:8, 1:9, 1:10, 1:11, 1:12, 1:13, 1:14, 1:15, 1:16, 1:17, 1:18, 1:19, 1:20, 1:21, 1:22, 1:23, 1:24, 1:25, 1:26, 1:27, 1:28, 1:29, 1:30, 1:40, 1:50, 1:60, 1:100, 1:125, 1:150, 1:175, or 1:200 or the inverse thereof. In some embodiments, the microbial composition comprises at least three different microbes, and wherein the three microbes are present in the composition at a ratio of 1:2:1, 1:1:2, 2:2:1, 1:3:1, 1:1:3, 3:1:1, 3:3:1, 1:5:1, 1:1:5, 5:1:1, 5:5:1, or 1:5:5.

Encapsulation Compositions

In some embodiments, the microbes or microbial compositions of the disclosure are encapsulated in an encapsulating composition. An encapsulating composition protects the microbes from external stressors prior to entering the gastrointestinal tract of beef cattle. In some embodiments, external stressors include thermal and physical stressors associated with pelleting and extrusion. In some embodiments, external stressors include chemicals present in the compositions. Encapsulating compositions further create an environment that may be beneficial to the microbes, such as minimizing the oxidative stresses of an aerobic environment on anaerobic microbes. See Kalsta et al. (U.S. Pat. No. 5,104,662A), Ford (U.S. Pat. No. 5,733,568A), and Mosbach and Nilsson (U.S. Pat. No. 4,647,536A) for encapsulation compositions of microbes, and methods of encapsulating microbes.

In one embodiment, the compositions of the present disclosure exhibit a thermal tolerance, which is used interchangeably with heat tolerance and heat resistance. In one embodiment, thermal tolerant compositions of the present disclosure are tolerant of the high temperatures associated with feed manufacturing, mixing of feed and compositions of the present disclosure, storage in high heat environments, etc. In one embodiment, thermal tolerant compositions of the present disclosure are resistant to heat-killing and denaturation of the cell wall components and the intracellular environment.

In one embodiment, the encapsulation is a reservoir-type encapsulation. In one embodiment, the encapsulation is a matrix-type encapsulation. In one embodiment, the encapsulation is a coated matrix-type encapsulation. Burgain et al. (2011. J. Food Eng. 104:467-483) discloses numerous encapsulation embodiments and techniques, all of which are incorporated by reference.

In some embodiments, the compositions of the present disclosure are encapsulated in one or more of the following: gellan gum, xanthan gum, K-Carrageenan, cellulose acetate phthalate, chitosan, starch, milk fat, whey protein, Ca-alginate, raftilose, raftiline, pectin, saccharide, glucose, maltodextrin, gum arabic, guar, seed flour, alginate, dextrins, dextrans, celluloase, gelatin, gelatin, albumin, casein, gluten, acacia gum, tragacanth, wax, paraffin, stearic acid, monodiglycerides, and diglycerides. In some embodiments, the compositions of the present disclosure are encapsulated by one or more of a polymer, carbohydrate, sugar, plastic, glass, polysaccharide, lipid, wax, oil, fatty acid, or glyceride. In one embodiment, the microbial composition is encapsulated by glucose. In one embodiment, the microbial composition is encapsulated by a glucose-containing composition. In one embodiment, formulations of the microbial composition comprise a glucose encapsulant. In one embodiment, formulations of the microbial composition comprise a glucose-encapsulated composition.

In some embodiments, the encapsulation of the compositions of the present disclosure is carried out by an extrusion, emulsification, coating, agglomeration, lyophilization, vitrification, foam drying, preservation by vaporization, vacuum-drying, or spray-drying.

In some embodiments, the encapsulated compositions of the present disclosure are vitrified. In some embodiments, encapsulation involves a process of drying a composition of the present disclosure in the presence of a substance which forms a glassy, amorphous solid state, a process known as vitrification, and in doing so encapsulates the composition. In some embodiments, the vitrified composition is protected from degradative conditions that would typically destroy or degrade microbes. Many common substances have the property of vitrification; that is, they will form a glassy solid state under certain conditions. Among these substances are several sugars, including sucrose and maltose, and other more complex compounds, such as polyvinyl pyrolidone (PVP). As any solution dries down, the molecules in the solution can either crystalize, or they can vitrify. A solute which has an extensive asymmetry may be a superior vitrifier, because of the hindrances to nucleation of crystals during drying. A substance that inhibits the crystallization of another substance may result in the combined substances forming a superior vitrification, such as raffinose in the presence of sucrose. See U.S. Pat. Nos. 5,290,765 and 9,469,835.

In some embodiments, a microbial composition is produced that is encapsulated in a vitrified substance. The vitrified composition may be created by selecting a mixture including cells; combining said mixture with sufficient quantity of one or more vitrifying solutes to protect said mixture during drying and to inhibit destructive reactions; and drying said combination by exposing said combination to a desiccant, or desiccating conditions, at a temperature above that which said combination will freeze and below that at which said vitrifying solutes achieve the vitrified state, at approximately normal atmospheric pressure, until said combination is substantially dry.

In one embodiment, the encapsulating composition comprises microcapsules having a multiplicity of liquid cores encapsulated in a solid shell material. For purposes of the disclosure, a "multiplicity" of cores is defined as two or more.

A first category of useful fusible shell materials is that of normally solid fats, including fats which are already of suitable hardness and animal or vegetable fats and oils which are hydrogenated until their melting points are sufficiently high to serve the purposes of the present disclosure. Depending on the desired process and storage temperatures and the specific material selected, a particular fat can be either a normally solid or normally liquid material. The terms "normally solid" and "normally liquid" as used herein refer to the state of a material at desired temperatures for storing the resulting microcapsules. Since fats and hydrogenated oils do not, strictly speaking, have melting points, the term "melting point" is used herein to describe the minimum temperature at which the fusible material becomes sufficiently softened or liquid to be successfully emulsified and spray cooled, thus roughly corresponding to the maximum temperature at which the shell material has sufficient integrity to prevent release of the choline cores. "Melting point" is similarly defined herein for other materials which do not have a sharp melting point.

Specific examples of fats and oils useful herein (some of which require hardening) are as follows: animal oils and fats, such as beef tallow, mutton tallow, lamb tallow, lard or pork fat, fish oil, and sperm oil; vegetable oils, such as canola oil, cottonseed oil, peanut oil, corn oil, olive oil, soybean oil, sunflower oil, safflower oil, coconut oil, palm oil, linseed oil, tung oil, and castor oil; fatty acid monoglycerides and diglycerides; free fatty acids, such as stearic acid, palmitic acid, and oleic acid; and mixtures thereof. The above listing of oils and fats is not meant to be exhaustive, but only exemplary.

Specific examples of fatty acids include linoleic acid, γ-linoleic acid, dihomo-γ-linolenic acid, arachidonic acid, docosatetraenoic acid, vaccenic acid, nervonic acid, mead acid, erucic acid, gondoic acid, elaidic acid, oleic acid, palitoleic acid, stearidonic acid, eicosapentaenoic acid, valeric acid, caproic acid, enanthic acid, caprylic acid, pelargonic acid, capric acid, undecylic acid, lauric acid, tridecylic acid, myristic acid, pentadecylic acid, palmitic acid, margaric acid, stearic acid, nonadecyclic acid, arachidic acid, heneicosylic acid, behenic acid, tricosylic acid, lignoceric acid, pentacosylic acid, cerotic acid, heptacosylic acid, montanic acid, nonacosylic acid, melissic acid, henatriacontylic acid, lacceroic acid, psyllic acid, geddic acid, ceroplastic acid, hexatriacontylic acid, heptatriacontanoic acid, and octatriacontanoic acid.

Another category of fusible materials useful as encapsulating shell materials is that of waxes. Representative waxes contemplated for use herein are as follows: animal waxes, such as beeswax, lanolin, shell wax, and Chinese insect wax; vegetable waxes, such as carnauba, candelilla, bayberry, and sugar cane; mineral waxes, such as paraffin, microcrystalline petroleum, ozocerite, ceresin, and montan; synthetic waxes, such as low molecular weight polyolefin (e.g., CARBOWAX), and polyol ether-esters (e.g., sorbitol); Fischer-Tropsch process synthetic waxes; and mixtures thereof. Water-soluble waxes, such as CARBOWAX and sorbitol, are not contemplated herein if the core is aqueous.

Still other fusible compounds useful herein are fusible natural resins, such as rosin, balsam, shellac, and mixtures thereof.

In some embodiments, the microbes or microbial composition is embedded in a wax, such as the waxes described in the present disclosure.

In some embodiments, the microbes or microbial composition is embedded in wax balls. In some embodiments, the microbes or microbial composition is already encapsulated prior to being embedded in wax balls. In some embodiments, the wax balls are 10 microbes, 20 microns, 30 microns, 40 microns, 50 microns, 60 microns, 70 microns, 80 microns, 90 microns, 100 microns, 150 microns, 200 microns, 250 microns, 300 microns, 350 microns, 400 microns, 450 microns, 500 microns, 550 microns, 600 microns, 650 microns, 700 microns, 750 microns, 800 microns, 850 microns, 900 microns, 950 microns, or 1,000 microns.

In some embodiments, the wax balls are about 10 microbes, about 20 microns, about 30 microns, about 40 microns, about 50 microns, about 60 microns, about 70 microns, about 80 microns, about 90 microns, about 100 microns, about 150 microns, about 200 microns, about 250 microns, about 300 microns, about 350 microns, about 400 microns, about 450 microns, about 500 microns, about 550 microns, about 600 microns, about 650 microns, about 700 microns, about 750 microns, about 800 microns, about 850 microns, about 900 microns, about 950 microns, or about 1,000 microns.

In some embodiments, the wax balls are between 10-20 microns, 10-30 microns, 10-40 microns, 10-50 microns, 10-60 microns, 10-70 microns, 10-80 microns, 10-90 microns, 10-100 microns, 10-250 microns, 10-500 microns, 10-750 microns, 10-1,000 microns, 20-30 microns, 20-40 microns, 20-50 microns, 20-60 microns, 20-70 microns, 20-80 microns, 20-90 microns, 20-100 microns, 20-250 microns, 20-500 microns, 20-750 microns, 20-1,000 microns, 30-40 microns, 30-50 microns, 30-60 microns, 30-70 microns, 30-80 microns, 30-90 microns, 30-100 microns, 30-250 microns, 30-500 microns, 30-750 microns, 30-1,000 microns, 40-50 microns, 40-60 microns, 40-70 microns, 40-80 microns, 40-90 microns, 40-100 microns, 40-250 microns, 40-500 microns, 40-750 microns, 40-1,000 microns, 50-60 microns, 50-70 microns, 50-80 microns, 50-90 microns, 50-100 microns, 50-250 microns, 50-500 microns, 50-750 microns, 50-1,000 microns, 60-70 microns, 60-80 microns, 60-90 microns, 60-100 microns, 60-250 microns, 60-500 microns, 60-750 microns, 60-1,000 microns, 70-80 microns, 70-90 microns, 70-100 microns, 70-250 microns, 70-500 microns, 70-750 microns, 70-1,000 microns, 80-90 microns, 80-100 microns, 80-250 microns, 80-500 microns, 80-500 microns, 80-750 microns, 80-1,000 microns, 90-100 microns, 90-250 microns, 90-500 microns, 90-750 microns, 90-1,000 microns, 100-250 microns, 100-500 microns, 100-750 microns, 100-1,000 microns, 250-500 microns, 250-750 microns, 250-1,000 microns, 500-750 microns, 500-1,000 microns, or 750-1,000 microns.

In some embodiments, the wax balls are between about 10-20 microns, about 10-30 microns, about 10-40 microns, about 10-50 microns, about 10-60 microns, about 10-70 microns, about 10-80 microns, about 10-90 microns, about 10-100 microns, about 10-250 microns, about 10-500 microns, about 10-750 microns, about 10-1,000 microns, about 20-30 microns, about 20-40 microns, about 20-50 microns, about 20-60 microns, about 20-70 microns, about 20-80 microns, about 20-90 microns, about 20-100 microns, about 20-250 microns, about 20-500 microns, about 20-750 microns, about 20-1,000 microns, about 30-40 microns, about 30-50 microns, about 30-60 microns, about 30-70 microns, about 30-80 microns, about 30-90 microns, about 30-100 microns, about 30-250 microns, about 30-500 microns, about 30-750 microns, about 30-1,000 microns, about 40-50 microns, about 40-60 microns, about 40-70 microns, about 40-80 microns, about 40-90 microns, about 40-100 microns, about 40-250 microns, about 40-500 microns, about 40-750 microns, about 40-1,000 microns, about 50-60 microns, about 50-70 microns, about 50-80 microns, about 50-90 microns, about 50-100 microns, about 50-250 microns, about 50-500 microns, about 50-750 microns, about 50-1,000 microns, about 60-70 microns, about 60-80 microns, about 60-90 microns, about 60-100 microns, about 60-250 microns, about 60-500 microns, about 60-750 microns, about 60-1,000 microns, about 70-80 microns about 70-90 microns, about 70-90 microns, about 70-100 microns, about 70-250 microns, about 70-500 microns, about 70-750 microns, about 70-1,000 microns, about 80-90 microns, about 80-100 microns, about 80-250 microns, about 80-500 microns, about 80-500 microns, about 80-750 microns, about 80-1,000 microns, about 90-100 microns, about 90-250 microns, about 90-500 microns, about 90-750 microns, about 90-1,000 microns, about 100-250 microns, about 100-500 microns, about 100-750 microns, about 100-1,000 microns, about 250-500 microns, about 250-750 microns, about 250-1,000 microns, about 500-750 microns, about 500-1,000 microns, or about 750-1,000 microns.

Various adjunct materials are contemplated for incorporation in fusible materials according to the present disclosure. For example, antioxidants, light stabilizers, dyes and lakes, flavors, essential oils, anti-caking agents, fillers, pH stabilizers, sugars (monosaccharides, disaccharides, trisaccharides, and polysaccharides) and the like can be incorporated in the fusible material in amounts which do not diminish its utility for the present disclosure.

The core material contemplated herein constitutes from about 0.1% to about 50%, about 1% to about 35%. or about 5% to about 30% by weight of the microcapsules. In some embodiments, the core material contemplated herein constitutes no more than about 30% by weight of the microcapsules. In some embodiments, the core material contemplated herein constitutes about 5% by weight of the microcapsules. The core material is contemplated as either a liquid or solid at contemplated storage temperatures of the microcapsules.

The cores may include other additives well-known in the pharmaceutical art, including edible sugars, such as sucrose, glucose, maltose, fructose, lactose, monosaccharides, disaccharides, trisaccharides, and polysaccharides, and mixtures thereof; artificial sweeteners, such as aspartame, saccharin, cyclamate salts, and mixtures thereof; edible acids, such as acetic acid (vinegar), citric acid, ascorbic acid, tartaric acid, and mixtures thereof; edible starches, such as corn starch; hydrolyzed vegetable protein; water-soluble vitamins, such as Vitamin C; water-soluble medicaments; water-soluble nutritional materials, such as ferrous sulfate; flavors; salts; monosodium glutamate; antimicrobial agents, such as sorbic acid; antimycotic agents, such as potassium sorbate, sorbic acid, sodium benzoate, and benzoic acid; food grade pigments and dyes; and mixtures thereof. Other potentially useful supplemental core materials will be apparent to those of ordinary skill in the art.

Emulsifying agents may be employed to assist in the formation of stable emulsions. Representative emulsifying agents include glyceryl monostearate, polysorbate esters, ethoxylated mono- and diglycerides, and mixtures thereof.

For ease of processing, and particularly to enable the successful formation of a reasonably stable emulsion, the viscosities of the core material and the shell material should be similar at the temperature at which the emulsion is formed. In particular, the ratio of the viscosity of the shell to the viscosity of the core, expressed in centipoise or comparable units, and both measured at the temperature of the emulsion, should be from about 22:1 to about 1:1, desirably from about 8:1 to about 1:1, and preferably from about 3:1 to about 1:1. A ratio of 1:1 would be ideal, but a viscosity ratio within the recited ranges is useful.

Encapsulating compositions are not limited to microcapsule compositions as disclosed above. In some embodiments encapsulating compositions encapsulate the microbial compositions in an adhesive polymer that can be natural or synthetic without toxic effect. In some embodiments, the encapsulating composition may be a matrix selected from sugar matrix, gelatin matrix, polymer matrix, silica matrix, starch matrix, foam matrix, glass/glassy matrix etc. See Pirzio et al. (U.S. Pat. No. 7,488,503). In some embodiments, the encapsulating composition may be selected from polyvinyl acetates; polyvinyl acetate copolymers; ethylene vinyl acetate (EVA) copolymers; polyvinyl alcohols; polyvinyl alcohol copolymers; celluloses, including ethylcelluloses, methylcelluloses, hydroxymethylcelluloses, hydroxypropylcelluloses and carboxymethylcellulose; polyvinylpyrolidones; polysaccharides, including starch, modified starch, dextrins, maltodextrins, alginate and chitosans; monosaccharides; fats; fatty acids, including oils; proteins, including gelatin and zeins; gum arabics; shellacs; vinylidene chloride and vinylidene chloride copolymers; calcium lignosulfonates; acrylic copolymers; polyvinylacrylates; polyethylene oxide; acrylamide polymers and copolymers; polyhydroxyethyl acrylate, methylacrylamide monomers; and polychloroprene.

In some embodiments, the encapsulating compositions comprise at least one layer of encapsulation. In some embodiments, the encapsulating compositions comprise at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, or at least 20 layers of encapsulation/encapsulants.

In some embodiments, the encapsulating compositions comprise at least two layers of encapsulation. In some embodiments, each layer of encapsulation confers a different characteristic to the composition. In some embodiments, no two consecutive layers confer the same characteristic. In some embodiments, at least one layer of the at least two layers of encapsulation confers thermostability, shelf stability, ultraviolet resistance, moisture resistance, hydrophobicity, hydrophilicity, lipophobicity, lipophilicity, pH stability, acid resistance, and base resistance.

In some embodiments, the encapsulating compositions comprise two layers of encapsulation; the first layer confers thermostability and/or shelf stability, and the second layer provides pH resistance.

In some embodiments, the encapsulating layers confer a timed release of the microbial composition held in the center of the encapsulating layers. In some embodiments, the greater the number of layers confers a greater amount of time before the microbial composition is exposed, post administration.

In some embodiments, the encapsulating shell of the present disclosure can be up to 10 μm, 20 μm, 30 μm, 40 μm, 50 μm, 60 μm, 70 μm, 80 μm, 90 μm, 100 μm, 110 μm, 120 μm, 130 μm, 140 μm, 150 μm, 160 μm, 170 μm, 180 μm, 190 μm, 200 μm, 210 μm, 220 μm, 230 μm, 240 μm, 250 μm, 260 μm, 270 μm, 280 μm, 290 μm, 300 μm, 310 μm, 320 μm, 330 μm, 340 μm, 350 μm, 360 μm, 370 μm, 380 μm, 390 μm, 400 μm, 410 μm, 420 μm, 430 μm, 440 μm, 450 μm, 460 μm, 470 μm, 480 μm, 490 μm, 500 μm, 510 μm, 520 μm, 530 μm, 540 μm, 550 μm, 560 μm, 570 μm, 580 μm, 590 μm, 600 μm, 610 μm, 620 μm, 630 μm, 640 μm, 650 μm, 660 μm, 670 μm, 680 μm, 690 μm, 700 μm, 710 μm, 720 μm, 730 μm, 740 μm, 750 μm, 760 μm, 770 μm, 780 μm, 790 μm, 800 μm, 810 μm, 820 μm, 830 μm, 840 μm, 850 μm, 860 μm, 870 μm, 880 μm, 890 μm, 900 μm, 910 μm, 920 μm, 930 μm, 940 μm, 950 μm, 960 μm, 970 μm, 980 μm, 990 μm, 1000 μm, 1010 μm, 1020 μm, 1030 μm, 1040 μm, 1050 μm, 1060 μm, 1070 μm, 1080 μm, 1090 μm, 1100 μm, 1110 μm, 1120 μm, 1130 μm, 1140 μm, 1150 μm, 1160 μm, 1170 μm, 1180 μm, 1190 μm, 1200 μm, 1210 μm, 1220 μm, 1230 μm, 1240 μm, 1250 μm, 1260 μm, 1270 μm, 1280 μm, 1290 μm, 1300 μm, 1310 μm, 1320 μm, 1330 μm, 1340 μm, 1350 μm, 1360 μm, 1370 μm, 1380 μm, 1390 μm, 1400 μm, 1410 μm, 1420 μm, 1430 μm, 1440 μm, 1450 μm, 1460 μm, 1470 μm, 1480 μm, 1490 μm, 1500 μm, 1510 μm, 1520 μm, 1530 μm, 1540 μm, 1550 μm, 1560 μm, 1570 μm, 1580 μm, 1590 μm, 1600 μm, 1610 μm, 1620 μm, 1630 μm, 1640 μm, 1650 μm, 1660 μm, 1670 μm, 1680 μm, 1690 μm, 1700 μm, 1710 μm, 1720 μm, 1730 μm, 1740 μm, 1750 μm, 1760 μm, 1770 μm, 1780 μm, 1790 μm, 1800 μm, 1810 μm, 1820 μm, 1830 μm, 1840 μm, 1850 μm, 1860 μm, 1870 μm, 1880 μm, 1890 μm, 1900 μm, 1910 μm, 1920 μm, 1930 μm, 1940 μm, 1950 μm, 1960 μm, 1970 μm, 1980 μm, 1990 μm, 2000 μm, 2010 μm, 2020 μm, 2030 μm, 2040 μm, 2050 μm, 2060 μm, 2070 μm, 2080 μm, 2090 μm, 2100 μm, 2110 μm, 2120 μm, 2130 μm, 2140 μm, 2150 μm, 2160 μm, 2170 μm, 2180 μm, 2190 μm, 2200 μm, 2210 μm, 2220 μm, 2230 μm, 2240 μm, 2250 μm, 2260 μm, 2270 μm, 2280 μm, 2290 μm, 2300 μm, 2310 μm, 2320 μm, 2330 μm, 2340 μm, 2350 μm, 2360 μm, 2370 μm, 2380 μm, 2390 μm, 2400 μm, 2410 μm, 2420 μm, 2430 μm, 2440 μm, 2450 μm, 2460 μm, 2470 μm, 2480 μm, 2490 μm, 2500 μm, 2510 μm, 2520 μm, 2530 μm, 2540 μm, 2550 μm, 2560 μm, 2570 μm, 2580 μm, 2590 μm, 2600 μm, 2610 μm, 2620 μm, 2630 μm, 2640 μm, 2650 μm, 2660 μm, 2670 μm, 2680 μm, 2690 μm, 2700 μm, 2710 μm, 2720 μm, 2730 μm, 2740 μm, 2750 μm, 2760 μm, 2770 μm, 2780 μm, 2790 μm, 2800 μm, 2810 μm, 2820 μm, 2830 μm, 2840 μm, 2850 μm, 2860 μm, 2870 μm, 2880 μm, 2890 μm, 2900 μm, 2910 μm, 2920 μm, 2930 μm, 2940 μm, 2950 μm, 2960 μm, 2970 μm, 2980 μm, 2990 μm, or 3000 μm thick.

In some embodiments, the encapsulation composition of the present disclosure possesses a water activity ($a_w$) of less than 0.750, 0.700, 0.650, 0.600, 0.550, 0.500, 0.475, 0.450, 0.425, 0.400, 0.375, 0.350, 0.325, 0.300, 0.275, 0.250, 0.225, 0.200, 0.190, 0.180, 0.170, 0.160, 0.150, 0.140, 0.130, 0.120, 0.110, 0.100, 0.095, 0.090, 0.085, 0.080, 0.075, 0.070, 0.065, 0.060, 0.055, 0.050, 0.045, 0.040, 0.035, 0.030, 0.025, 0.020, 0.015, 0.010, or 0.005.

In some embodiments, the encapsulation composition of the present disclosure possesses a water activity ($a_w$) of less than about 0.750, about 0.700, about 0.650, about 0.600, about 0.550, about 0.500, about 0.475, about 0.450, about 0.425, about 0.400, about 0.375, about 0.350, about 0.325, about 0.300, about 0.275, about 0.250, about 0.225, about 0.200, about 0.190, about 0.180, about 0.170, about 0.160, about 0.150, about 0.140, about 0.130, about 0.120, about 0.110, about 0.100, about 0.095, about 0.090, about 0.085, about 0.080, about 0.075, about 0.070, about 0.065, about 0.060, about 0.055, about 0.050, about 0.045, about 0.040, about 0.035, about 0.030, about 0.025, about 0.020, about 0.015, about 0.010, or about 0.005.

In one embodiment, the microbe(s) are first dried by spray dry, lyophilization, or foam drying along with excipients that may include one or more sugars, sugar alcohols, disaccharides, trisaccharides, polysaccharides, salts, amino acids, amino acid salts, or polymers.

In some embodiments, the microbes or compositions comprising the microbes are milled to a size of 10 microns, 20 microns, 30 microns, 40 microns, 50 microns, 60 microns, 70 microns, 80 microns, 90 microns, 100 microns, 150 microns, 200 microns, 250 microns, 300 microns, 350 microns, 400 microns, 450 microns, 500 microns, 550 microns, 600 microns, 650 microns, 700 microns, 750 microns, 800 microns, 850 microns, 900 microns, 950 microns, or 1,000 microns.

In some embodiments, the microbes or compositions comprising the microbes are milled to a size of about 10 microbes, about 20 microns, about 30 microns, about 40 microns, about 50 microns, about 60 microns, about 70 microns, about 80 microns, about 90 microns, about 100 microns, about 150 microns, about 200 microns, about 250 microns, about 300 microns, about 350 microns, about 400 microns, about 450 microns, about 500 microns, about 550 microns, about 600 microns, about 650 microns, about 700 microns, about 750 microns, about 800 microns, about 850 microns, about 900 microns, about 950 microns, or about 1,000 microns.

In some embodiments, the microbes or compositions comprising the microbes are milled to a size of between 10-20 microns, 10-30 microns, 10-40 microns, 10-50 microns, 10-60 microns, 10-70 microns, 10-80 microns, 10-90 microns, 10-100 microns, 10-250 microns, 10-500 microns, 10-750 microns, 10-1,000 microns, 20-30 microns, 20-40 microns, 20-50 microns, 20-60 microns, 20-70 microns, 20-80 microns, 20-90 microns, 20-100 microns, 20-250 microns, 20-500 microns, 20-750 microns, 20-1,000 microns, 30-40 microns, 30-50 microns, 30-60 microns, 30-70 microns, 30-80 microns, 30-90 microns, 30-100 microns, 30-250 microns, 30-500 microns, 30-750 microns, 30-1,000 microns, 40-50 microns, 40-60 microns, 40-70 microns, 40-80 microns, 40-90 microns, 40-100 microns, 40-250 microns, 40-500 microns, 40-750 microns, 40-1,000 microns, 50-60 microns, 50-70 microns, 50-80 microns, 50-90 microns, 50-100 microns, 50-250 microns, 50-500 microns, 50-750 microns, 50-1,000 microns, 60-70 microns, 60-80 microns, 60-90 microns, 60-100 microns, 60-250 microns, 60-500 microns, 60-750 microns, 60-1,000 microns, 70-80 microns 70-90 microns, 70-90 microns, 70-100 microns, 70-250 microns, 70-500 microns, 70-750 microns, 70-1,000 microns, 80-90 microns, 80-100 microns, 80-250 microns, 80-500 microns, 80-500 microns, 80-750 microns, 80-1,000 microns, 90-100 microns, 90-250 microns, 90-500 microns, 90-750 microns, 90-1,000 microns, 100-250 microns, 100-500 microns, 100-750 microns, 100-1,000 microns, 250-500 microns, 250-750 microns, 250-1,000 microns, 500-750 microns, 500-1,000 microns, or 750-1,000 microns.

In some embodiments, the microbes or compositions comprising the microbes are milled to a size of between about 10-20 microns, about 10-30 microns, about 10-40 microns, about 10-50 microns, about 10-60 microns, about 10-70 microns, about 10-80 microns, about 10-90 microns, about 10-100 microns, about 10-250 microns, about 10-500 microns, about 10-750 microns, about 10-1,000 microns, about 20-30 microns, about 20-40 microns, about 20-50 microns, about 20-60 microns, about 20-70 microns, about 20-80 microns, about 20-90 microns, about 20-100 microns, about 20-250 microns, about 20-500 microns, about 20-750 microns, about 20-1,000 microns, about 30-40 microns, about 30-50 microns, about 30-60 microns, about 30-70 microns, about 30-80 microns, about 30-90 microns, about 30-100 microns, about 30-250 microns, about 30-500 microns, about 30-750 microns, about 30-1,000 microns, about 40-50 microns, about 40-60 microns, about 40-70 microns, about 40-80 microns, about 40-90 microns, about 40-100 microns, about 40-250 microns, about 40-500 microns, about 40-750 microns, about 40-1,000 microns, about 50-60 microns, about 50-70 microns, about 50-80 microns, about 50-90 microns, about 50-100 microns, about 50-250 microns, about 50-500 microns, about 50-750 microns, about 50-1,000 microns, about 60-70 microns, about 60-80 microns, about 60-90 microns, about 60-100 microns, about 60-250 microns, about 60-500 microns, about 60-750 microns, about 60-1,000 microns, about 70-80 microns about 70-90 microns, about 70-90 microns, about 70-100 microns, about 70-250 microns, about 70-500 microns, about 70-750 microns, about 70-1,000 microns, about 80-90 microns, about 80-100 microns, about 80-250 microns, about 80-500 microns, about 80-500 microns, about 80-750 microns, about 80-1,000 microns, about 90-100 microns, about 90-250 microns, about 90-500 microns, about 90-750 microns, about 90-1,000 microns, about 100-250 microns, about 100-500 microns, about 100-750 microns, about 100-1,000 microns, about 250-500 microns, about 250-750 microns, about 250-1,000 microns, about 500-750 microns, about 500-1,000 microns, or about 750-1,000 microns.

In some embodiments, the microbes or compositions comprising the microbes are combined with a wax, fat, oil, fatty acid, or fatty alcohol, and spray congealed into beads of about 10 microbes, about 20 microns, about 30 microns, about 40 microns, about 50 microns, about 60 microns, about 70 microns, about 80 microns, about 90 microns, about 100 microns, about 150 microns, about 200 microns, about 250 microns, about 300 microns, about 350 microns, about 400 microns, about 450 microns, about 500 microns, about 550 microns, about 600 microns, about 650 microns, about 700 microns, about 750 microns, about 800 microns, about 850 microns, about 900 microns, about 950 microns, or about 1,000 microns.

In some embodiments, the microbes or compositions comprising the microbes are combined with a wax, fat, oil, fatty acid, or fatty alcohol, and spray congealed into beads of between 10-20 microns, 10-30 microns, 10-40 microns, 10-50 microns, 10-60 microns, 10-70 microns, 10-80 microns, 10-90 microns, 10-100 microns, 10-250 microns, 10-500 microns, 10-750 microns, 10-1,000 microns, 20-30 microns, 20-40 microns, 20-50 microns, 20-60 microns, 20-70 microns, 20-80 microns, 20-90 microns, 20-100 microns, 20-250 microns, 20-500 microns, 20-750 microns, 20-1,000 microns, 30-40 microns, 30-50 microns, 30-60 microns, 30-70 microns, 30-80 microns, 30-90 microns, 30-100 microns, 30-250 microns, 30-500 microns, 30-750 microns, 30-1,000 microns, 40-50 microns, 40-60 microns, 40-70 microns, 40-80 microns, 40-90 microns, 40-100 microns, 40-250 microns, 40-500 microns, 40-750 microns, 40-1,000 microns, 50-60 microns, 50-70 microns, 50-80 microns, 50-90 microns, 50-100 microns, 50-250 microns, 50-500 microns, 50-750 microns, 50-1,000 microns, 60-70 microns, 60-80 microns, 60-90 microns, 60-100 microns, 60-250 microns, 60-500 microns, 60-750 microns, 60-1,000 microns, 70-80 microns 70-90 microns, 70-90 microns, 70-100 microns, 70-250 microns, 70-500 microns, 70-750 microns, 70-1,000 microns, 80-90 microns, 80-100 microns, 80-250 microns, 80-500 microns, 80-500 microns, 80-750 microns, 80-1,000 microns, 90-100 microns, 90-250 microns, 90-500 microns, 90-750 microns, 90-1,000 microns, 100-250 microns, 100-500 microns, 100-750 microns, 100-1,000 microns, 250-500 microns, 250-750 microns, 250-1,000 microns, 500-750 microns, 500-1,000 microns, or 750-1,000 microns.

In some embodiments, the microbes or compositions comprising the microbes are combined with a wax, fat, oil, fatty acid, or fatty alcohol, and spray congealed into beads of between about 10-20 microns, about 10-30 microns, about 10-40 microns, about 10-50 microns, about 10-60 microns, about 10-70 microns, about 10-80 microns, about 10-90 microns, about 10-100 microns, about 10-250 microns, about 10-500 microns, about 10-750 microns, about 10-1,000 microns, about 20-30 microns, about 20-40 microns, about 20-50 microns, about 20-60 microns, about 20-70 microns, about 20-80 microns, about 20-90 microns, about 20-100 microns, about 20-250 microns, about 20-500 microns, about 20-750 microns, about 20-1,000 microns, about 30-40 microns, about 30-50 microns, about 30-60 microns, about 30-70 microns, about 30-80 microns, about 30-90 microns, about 30-100 microns, about 30-250 microns, about 30-500 microns, about 30-750 microns, about 30-1,000 microns, about 40-50 microns, about 40-60 microns, about 40-70 microns, about 40-80 microns, about 40-90 microns, about 40-100 microns, about 40-250 microns, about 40-500 microns, about 40-750 microns, about 40-1,000 microns, about 50-60 microns, about 50-70 microns, about 50-80 microns, about 50-90 microns, about 50-100 microns, about 50-250 microns, about 50-500 microns, about 50-750 microns, about 50-1,000 microns, about 60-70 microns, about 60-80 microns, about 60-90 microns, about 60-100 microns, about 60-250 microns, about 60-500 microns, about 60-750 microns, about 60-1,000 microns, about 70-80 microns about 70-90 microns, about 70-90 microns, about 70-100 microns, about 70-250 microns, about 70-500 microns, about 70-750 microns, about 70-1,000 microns, about 80-90 microns, about 80-100 microns, about 80-250 microns, about 80-500 microns, about 80-500 microns, about 80-750 microns, about 80-1,000 microns, about 90-100 microns, about 90-250 microns, about 90-500 microns, about 90-750 microns, about 90-1,000 microns, about 100-250 microns, about 100-500 microns, about 100-750 microns, about 100-1,000 microns, about 250-500 microns, about 250-750 microns, about 250-1,000 microns, about 500-750 microns, about 500-1,000 microns, or about 750-1,000 microns.

In some embodiments, the microbes or compositions comprising the microbes are combined with a wax, fat, oil, fatty acid, or fatty alcohol as well as a water-soluble polymer, salt, polysaccharide, sugar, polypeptide, protein, or sugar alcohol and spray congealed into beads, the size of which are described herein. In some embodiments, the water-soluble polymer, salt, polysaccharide, sugar, or sugar alcohol serves as a disintegrant. In some embodiments, the disintegrant forms pores once the beads are dispersed in the rumen of the animal.

In some embodiments, the composition of the water-soluble polymer, salt, polysaccharide, sugar, polypeptide, protein, or sugar alcohol is modified such that the disintegrant dissolves within 1, 5, 10, 15, 20, 25, 30, 35, 40, 45, 50, 55, 60 minutes of being administered. In some embodiments, the composition of the water-soluble polymer, salt, polysaccharide, sugar, polypeptide, protein, or sugar alcohol is modified such that the disintegrant dissolves within about 1, about 5, about 10, about 15, about 20, about 25, about 30, about 35, about 40, about 45, about 50, about 55, or about 60 minutes of being administered.

In some embodiments, the composition of the water-soluble polymer, salt, polysaccharide, sugar, polypeptide, protein, or sugar alcohol is modified such that the disintegrant dissolves within 1, 1.5, 2, 2.5, 3, 3.5, 4, 4.5, 5, 5.5, 6, 6.5, 7, 7.5, 8, 8.5, 9, 9.5, 10, 10.5, 11, 11.5, or 12 hours of being administered. In some embodiments, the composition of the water-soluble polymer, salt, polysaccharide, sugar, polypeptide, protein, or sugar alcohol is modified such that the disintegrant dissolves within about 1, about 1.5, about 2, about 2.5, about 3, about 3.5, about 4, about 4.5, about 5, about 5.5, about 6, about 6.5, about 7, about 7.5, about 8, about 8.5, about 9, about 9.5, about 10, about 10.5, about 11, about 11.5, or about 12 hours of being administered.

In some embodiments, the composition of the water-soluble polymer, salt, polysaccharide, sugar, polypeptide, protein, or sugar alcohol is modified such that the disintegrant dissolves at a temperature of at least 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50° C. In some embodiments, the composition of the water-soluble polymer, salt, polysaccharide, sugar, polypeptide, protein, or sugar alcohol is modified such that the disintegrant dissolves at a temperature of at least about 10, least about 11, least about 12, least about 13, least about 14, least about 15, least about 16, least about 17, least about 18, least about 19, least about 20, least about 21, least about 22, least about 23, least about 24, least about 25, least about 26, least about 27, least about 28, least about 29, least about 30, least about 31, least about 32, least about 33, least about 34, about 35, about 36, about 37, about 38, about 39, about 40, about 41, about 42, about 43, about 44, least about 45, least about 46, least about 47, least about 48, least about 49, or least about 50° C.

In some embodiments, the composition of the water-soluble polymer, salt, polysaccharide, sugar, polypeptide, protein, or sugar alcohol is modified such that the disintegrant dissolves at a pH of at least 3.8, 3.9, 4. 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.2, 6.3, 6.4, 6.5, 6.6, 6.7, 6.8, 6.9, 7.0, 7.1, 7.2, 7.3, 7.4, 7.5, 7.6, 7.7, 7.8, 7.9, 8.0, 8.1, 8.2, 8.3, 8.4, 8.5, 8.6, 8.7, 8.8, 8.9, 9.0, 9.1, 9.2, 9.3, 9.4, 9.5, 9.6, 9.7, 9.8, 9.9 or 10.0. In some embodiments, the composition of the water-soluble polymer, salt, polysaccharide, sugar, polypeptide, protein, or sugar alcohol is modified such that the disintegrant dissolves at a pH of at least about 3.8, least about 3.9, least about 4. least about 4.1, least about 4.2, least about 4.3, least about 4.4, least about 4.5, least about 4.6, least about 4.7, least about 4.8, least about 4.9, least about 5.0, least about 5.1, least about 5.2, least about 5.3, least about 5.4, least about 5.5, least about 5.6, least about 5.7, least about 5.8, least about 5.9, least about 6.0, least about 6.2, least about 6.3, least about 6.4, least about 6.5, least about 6.6, least about 6.7, least about 6.8, least about 6.9, least about 7.0, least about 7.1, least about 7.2, least about 7.3, least about 7.4, least about 7.5, least about 7.6, least about 7.7, least about 7.8, least about 7.9, least about 8.0, least about 8.1, least about 8.2, least about 8.3, least about 8.4, least about 8.5, least about 8.6, least about 8.7, least about 8.8, least about 8.9, least about 9.0, least about 9.1, least about 9.2, least about 9.3, least about 9.4, least about 9.5, least about 9.6, least about 9.7, least about 9.8, least about 9.9, or least about 10.0.

In some embodiments, the microbes or compositions comprising the microbes are coated with a polymer, a polysaccharide, sugar, sugar alcohol, gel, wax, fat, fatty alcohol, or fatty acid In some embodiments, the microbes or compositions comprising the microbes are coated with a polymer, a polysaccharide, sugar, sugar alcohol, gel, wax, fat, fatty alcohol, or fatty acid.

In some embodiments, the coating of the microbes or compositions comprising the microbes is modified such that the coating dissolves within 1, 5, 10, 15, 20, 25, 30, 35, 40, 45, 50, 55, 60 minutes of being administered. In some embodiments, the coating of the microbes or compositions comprising the microbes is modified such that the coating dissolves within about 1, about 5, about 10, about 15, about 20, about 25, about 30, about 35, about 40, about 45, about 50, about 55, or about 60 minutes of being administered.

In some embodiments, the coating of the microbes or compositions comprising the microbes is modified such that the coating dissolves within 1, 1.5, 2, 2.5, 3, 3.5, 4, 4.5, 5, 5.5, 6, 6.5, 7, 7.5, 8, 8.5, 9, 9.5, 10, 10.5, 11, 11.5, or 12 hours of being administered. In some embodiments, the coating of the microbes or compositions comprising the microbes is modified such that the coating dissolves within about 1, about 1.5, about 2, about 2.5, about 3, about 3.5, about 4, about 4.5, about 5, about 5.5, about 6, about 6.5, about 7, about 7.5, about 8, about 8.5, about 9, about 9.5, about 10, about 10.5, about 11, about 11.5, or about 12 hours of being administered.

In some embodiments, the coating of the microbes or compositions comprising the microbes is modified such that the coating dissolves at a temperature of at least 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50° C. In some embodiments, the coating of the microbes or compositions comprising the microbes is modified such that the coating dissolves at a temperature of at least about 10, least about 11, least about 12, least about 13, least about 14, least about 15, least about 16, least about 17, least about 18, least about 19, least about 20, least about 21, least about 22, least about 23, least about 24, least about 25, least about 26, least about 27, least about 28, least about 29, least about 30, least about 31, least about 32, least about 33, least about 34, about 35, about 36, about 37, about 38, about 39, about 40, about 41, about 42, about 43, about 44, least about 45, least about 46, least about 47, least about 48, least about 49, or least about 50° C.

In some embodiments, the coating of the microbes or compositions comprising the microbes is modified such that the coating dissolves at a pH of at least 3.8, 3.9, 4. 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.2, 6.3, 6.4, 6.5, 6.6, 6.7, 6.8, 6.9, 7.0, 7.1, 7.2, 7.3, 7.4, 7.5, 7.6, 7.7, 7.8, 7.9, 8.0, 8.1, 8.2, 8.3, 8.4, 8.5, 8.6, 8.7, 8.8, 8.9, 9.0, 9.1, 9.2, 9.3, 9.4, 9.5, 9.6, 9.7, 9.8, 9.9 or 10.0. In some embodiments, the coating of the microbes or compositions comprising the microbes is modified such that the coating dissolves at a pH of at least about 3.8, least about 3.9, least about 4. least about 4.1, least about 4.2, least about 4.3, least about 4.4, least about 4.5, least about 4.6, least about 4.7, least about 4.8, least about 4.9, least about 5.0, least about 5.1, least about 5.2, least about 5.3, least about 5.4, least about 5.5, least about 5.6, least about 5.7, least about 5.8, least about 5.9, least about 6.0, least about 6.2, least about 6.3, least about 6.4, least about 6.5, least about 6.6, least about 6.7, least about 6.8, least about 6.9, least about 7.0, least about 7.1, least about 7.2, least about 7.3, least about 7.4, least about 7.5, least about 7.6, least about 7.7, least about 7.8, least about 7.9, least about 8.0, least about 8.1, least about 8.2, least about 8.3, least about 8.4, least about 8.5, least about 8.6, least about 8.7, least about 8.8, least about 8.9, least about 9.0, least about 9.1, least about 9.2, least about 9.3, least about 9.4, least about 9.5, least about 9.6, least about 9.7, least about 9.8, least about 9.9, or least about 10.0.

Animal Feed

In some embodiments, compositions of the present disclosure are mixed with animal feed. In some embodiments, animal feed may be present in various forms such as pellets, capsules, granulated, powdered, mash, liquid, semi-liquid, or mixed rations(s).

In some embodiments, compositions of the present disclosure are mixed into the premix at the feed mill (e.g., Carghill or Western Millin), alone as a standalone premix, and/or alongside other feed additives such as MONENSIN, vitamins, etc. In one embodiment, compositions of the present disclosure are mixed into the feed itself. In one embodiment, the compositions of the present disclosure are mixed into the feed at the feed mill.

In some embodiments, feed of the present disclosure may be supplemented with water, premix or premixes, forage, beans (e.g., whole, cracked, or ground), grains (e.g., whole, cracked, or ground), bean- or grain-based oils, bean- or grain-based meals, bean- or grain-based haylage or silage, bean- or grain-based syrups, fatty acids, sugar alcohols (e.g., polyhydric alcohols), commercially available formula feeds, oyster shells and those of other bivalves, and mixtures thereof.

In some embodiments, forage encompasses hay, haylage, and silage. In some embodiments, hays include grass hays (e.g., sudangrass, orchardgrass, or the like), alfalfa hay, and clover hay. In some embodiments, haylages include grass haylages, sorghum haylage, and alfalfa haylage. In some embodiments, silages include maize, oat, wheat, alfalfa, clover, and the like.

In some embodiments, premix or premixes may be utilized in the feed. Premixes may comprise micro-ingredients such as vitamins, minerals, amino acids; chemical preservatives; pharmaceutical compositions such as antibiotics, ionophores, and other medicaments; fermentation products, and other ingredients. In some embodiments, premixes are blended into the feed.

In some embodiments, the feed may include feed concentrates such as soybean hulls, soybean oils, sugar beet pulp, molasses, high protein soybean meal, ground corn, shelled corn, cornflakes, wheat midds, distiller grain, cottonseed hulls, rumen-bypass protein, rumen-bypass fat, and grease. See Luhman (U.S. Publication US20150216817A1), Anderson et al. (U.S. Pat. No. 3,484,243), Porter and Luhman (U.S. Pat. No. 9,179,694B2), Iritani et al. (U.S. Pat. No. 6,090,416), Axelrod et al. (U.S. Publication US20060127530A1), and Katsumi et al. (U.S. Pat. No. 5,741,508) for animal feed and animal feed supplements capable of use in the present compositions and methods.

In some embodiments, feed occurs as a compound, which includes, in a mixed composition capable of meeting the basic dietary needs, the feed itself, vitamins, minerals, amino acids, and other necessary components. Compound feed may further comprise premixes.

In some embodiments, microbial compositions of the present disclosure may be mixed with animal feed, premix, and/or compound feed. Individual components of the animal feed may be mixed with the microbial compositions prior to feeding to beef cattle. The microbial compositions of the present disclosure may be applied into or on a premix, into or on a feed, and/or into or on a compound feed.

In some embodiments, microbial compositions of the present disclosure may be mixed with animal feed, premix, and/or compound feed at various stages of animal adaptation to the step-up or finishing diet.

In some embodiments, microbial compositions of the present disclosure are mixed with feed and microingredients. Microingredients include liquid fat blends, glycerin, rumensin, monensin, vitamins, tylan, optaflex, melengesterol acetate, minerals, and amino acids. In some embodiments, the mixing of feed, microbial compositions of the present disclosure, and microingredients is performed at the feedlot.

In some embodiments, cattle begin a step up or a starting ration. As used herein, a "step-up diet" or "starting ration" is a diet fed to feedlot cattle as a transition to the high grain content of the finishing diet. In some embodiments, the step-up diet may involve one or more step-up diets that ease the cattle into the transition to the finishing diet. In some embodiments, the step-up diet is formulated to slowly increase the amount of high energy feed in the diet while mitigating gastrointestinal distress and the effects of rapid onset acidosis. In some embodiments, the cattle are fed a single type of step-up diet. In some embodiments, the cattle are fed multiple varieties of step-up diets, increasing the amount of high energy feed with each iteration of the step up diet variety. In some embodiments, the cattle are fed at least one step up diet, wherein the subsequent diets are different from each of those step up diets that follow. In some embodiments, the cattle are fed at least two different step up diets. In some embodiments, the cattle are fed at least three different step up diets.

As used herein, a "finishing diet" is a concentrated high-energy diet (often high-grain) fed to cattle on a feedlot to rapidly bring the cattle up to get them to market weight by the time the cattle are rendered. In some embodiments, the finishing diet may result in liver disease, liver abscesses, and/or acidosis.

In some embodiments, the microbial compositions of the present disclosure are mixed with step-up diets. In some embodiments, the microbial compositions of the present disclosure are mixed with finishing diets.

Administration of Microbial Compositions

In some embodiments, the microbial compositions of the present disclosure are administered to cattle via the oral route. In some embodiments the microbial compositions are administered via a direct injection route into the gastrointestinal tract. In further embodiments, the direct injection administration delivers the microbial compositions directly to the rumen. In some embodiments, the microbial compositions of the present disclosure are administered to animals anally. In further embodiments, anal administration is in the form of an inserted suppository.

In some embodiments, the microbial composition is administered in a dose volume comprising a total of, or at least, 1 ml, 2 ml, 3 ml, 4 ml, 5 ml, 6 ml, 7 ml, 8 ml, 9 ml, 10 ml, 11 ml, 12 ml, 13 ml, 14 ml, 15 ml, 16 ml, 17 ml, 18 ml, 19 ml, 20 ml, 21 ml, 22 ml, 23 ml, 24 ml, 25 ml, 26 ml, 27 ml, 28 ml, 29 ml, 30 ml, 31 ml, 32 ml, 33 ml, 34 ml, 35 ml, 36 ml, 37 ml, 38 ml, 39 ml, 40 ml, 41 m, 42 ml, 43 ml, 44 ml, 45 ml, 46 ml, 47 ml, 48 ml, 49 ml, 50 ml, 60 ml, 70 ml, 80 ml, 90 ml, 100 ml, 200 ml, 300 ml, 400 ml, 500 ml, 600 ml, 700 ml, 800 ml, 900 ml, or 1,000 ml.

In some embodiments, the microbial composition is administered in a dose comprising a total of, or at least $10^{18}$, $10^{17}$, $10^{16}$, $10^{15}$, $10^{14}$, $10^{13}$, $10^{12}$, $10^{11}$, $10^{10}$, $10^9$, $10^8$, $10^7$, $10^6$, $10^5$, $10^4$, $10^3$, or $10^2$ microbial cells.

In some embodiments, the microbial compositions are mixed with feed, and the administration occurs through the ingestion of the microbial compositions along with the feed. In some embodiments, the dose of the microbial composition is administered such that there exists $10^2$ to $10^{12}$, $10^3$ to $10^{12}$, $10^4$ to $10^{12}$, $10^5$ to $10^{12}$, $10^6$ to $10^{12}$, $10^7$ to $10^{12}$, $10^8$ to $10^{12}$, $10^9$ to $10^{12}$, $10^{10}$ to $10^{12}$, $10^{11}$ to $10^{12}$, $10^2$ to $10^{11}$, $10^3$ to $10^{11}$, $10^4$ to $10^{11}$, $10^5$ to $10^{11}$, $10^6$ to $10^{11}$, $10^7$ to $10^{11}$, $10^8$ to $10^{11}$, $10^9$ to $10^{11}$, $10^{10}$ to $10^{11}$, $10^2$ to $10^{10}$, $10^3$ to $10^{10}$, $10^4$ to $10^{10}$, $10^5$ to $10^{10}$, $10^6$ to $10^{10}$, $10^7$ to $10^{10}$, $10^8$ to $10^{10}$, $10^9$ to $10^{10}$, $10^2$ to $10^9$, $10^3$ to $10^9$, $10^4$ to $10^9$, $10^5$ to $10^9$, $10^6$ to $10^9$, $10^7$ to $10^9$, $10^8$ to $10^9$, $10^2$ to $10^8$, $10^2$ to $10^8$, $10^4$ to $10^8$, $10^5$ to $10^8$, $10^6$ to $10^8$, $10^7$ to $10^8$, $10^2$ to $10^7$, $10^3$ to $10^5$, $10^4$ to $10^5$, $10^2$ to $10^4$, $10^3$ to $10^4$, $10^2$ to $10^3$, $10^{12}$, $10^{11}$, $10^{10}$, $10^9$, $10^8$, $10^7$, $10^6$, $10^5$, $10^4$, $10^3$, or $10^2$ total microbial cells per gram or milliliter of the composition.

In some embodiments, the administered dose of the microbial composition comprises $10^2$ to $10^{18}$, $10^3$ to $10^{18}$, $10^4$ to $10^{18}$, $10^5$ to $10^{18}$, $10^6$ to $10^{18}$, $10^7$ to $10^{18}$, $10^8$ to $10^{18}$, $10^9$ to $10^{18}$, $10^{10}$ to $10^{18}$, $10^{11}$ to $10^{18}$, $10^{12}$ to $10^{18}$, $10^{13}$ to $10^{18}$, $10^{14}$ to $10^{18}$, $10^{15}$ to $10^{18}$, $10^{16}$ to $10^{18}$, $10^{17}$ to $10^{18}$, $10^2$ to $10^{12}$, $10^3$ to $10^{12}$, $10^4$ to $10^{12}$, $10^5$ to $10^{12}$, $10^6$ to $10^{12}$, $10^7$ to $10^{12}$, $10^8$ to $10^{12}$, $10^9$ to $10^{12}$, $10^{10}$ to $10^{12}$, $10^{11}$ to $10^{12}$, $10^2$ to $10^{11}$, $10^3$ to $10^{11}$, $10^4$ to $10^{11}$, $10^5$ to $10^{11}$, $10^6$ to $10^{11}$, $10^7$ to $10^{11}$, $10^8$ to $10^{11}$, $10^9$ to $10^{11}$, $10^{10}$ to $10^{11}$, $10^2$ to $10^{10}$, $10^3$ to $10^{10}$, $10^4$ to $10^{11}$, $10^5$ to $10^{10}$, $10^6$ to $10^{10}$, $10^7$ to $10^{10}$, $10^8$ to $10^{10}$, $10^9$ to $10^{10}$, $10^2$ to $10^9$, $10^3$ to $10^9$, $10^4$ to $10^9$, $10^5$ to $10^9$, $10^6$ to $10^9$, $10^7$ to $10^9$, $10^8$ to $10^9$, $10^2$ to $10^8$, $10^3$ to $10^8$, $10^4$ to $10^8$, $10^5$ to $10^8$, $10^6$ to $10^8$, $10^7$ to $10^8$, $10^2$ to $10^7$, $10^3$ to $10^7$, $10^4$ to $10^7$, $10^5$ to $10^7$, $10^6$ to $10^7$, $10^2$ to $10^6$, $10^3$ to $10^6$, $10^4$ to $10^6$, $10^5$ to $10^6$, $10^2$ to $10^5$, $10^3$ to $10^5$, $10^4$ to $10^5$, $10^2$ to $10^4$, $10^3$ to $10^4$, $10^2$ to $10^3$, $10^{18}$, $10^{17}$, $10^{16}$, $10^{15}$, $10^{14}$, $10^{13}$, $10^{12}$, $10^{11}$, $10^{10}$, $10^9$, $10^8$, $10^7$, $10^6$, $10^5$, $10^4$, $10^3$, or $10^2$ total microbial cells.

In some embodiments, the composition is administered 1 or more times per day. In some aspects, the composition is administered with food each time the animal is fed. In some embodiments, the composition is administered 1 to 10, 1 to 9, 1 to 8, 1 to 7, 1 to 6, 1 to 5, 1 to 4, 1 to 3, 1 to 2, 2 to 10, 2 to 9, 2 to 8, 2 to 7, 2 to 6, 2 to 5, 2 to 4, 2 to 3, 3 to 10, 3 to 9, 3 to 8, 3 to 7, 3 to 6, 3 to 5, 3 to 4, 4 to 10, 4 to 9, 4 to 8, 4 to 7, 4 to 6, 4 to 5, 5 to 10, 5 to 9, 5 to 8, 5 to 7, 5 to 6, 6 to 10, 6 to 9, 6 to 8, 6 to 7, 7 to 10, 7 to 9, 7 to 8, 8 to 10, 8 to 9, 9 to 10, 1, 2, 3, 4, 5, 6, 7, 8, 9, or 10 times per day.

In some embodiments, the microbial composition is administered 1 to 10, 1 to 9, 1 to 8, 1 to 7, 1 to 6, 1 to 5, 1 to 4, 1 to 3, 1 to 2, 2 to 10, 2 to 9, 2 to 8, 2 to 7, 2 to 6, 2 to 5, 2 to 4, 2 to 3, 3 to 10, 3 to 9, 3 to 8, 3 to 7, 3 to 6, 3 to 5, 3 to 4, 4 to 10, 4 to 9, 4 to 8, 4 to 7, 4 to 6, 4 to 5, 5 to 10, 5 to 9, 5 to 8, 5 to 7, 5 to 6, 6 to 10, 6 to 9, 6 to 8, 6 to 7, 7 to 10, 7 to 9, 7 to 8, 8 to 10, 8 to 9, 9 to 10, 1, 2, 3, 4, 5, 6, 7, 8, 9, or 10 times per week.

In some embodiments, the microbial composition is administered 1 to 10, 1 to 9, 1 to 8, 1 to 7, 1 to 6, 1 to 5, 1 to 4, 1 to 3, 1 to 2, 2 to 10, 2 to 9, 2 to 8, 2 to 7, 2 to 6, 2 to 5, 2 to 4, 2 to 3, 3 to 10, 3 to 9, 3 to 8, 3 to 7, 3 to 6, 3 to 5, 3 to 4, 4 to 10, 4 to 9, 4 to 8, 4 to 7, 4 to 6, 4 to 5, 5 to 10, 5 to 9, 5 to 8, 5 to 7, 5 to 6, 6 to 10, 6 to 9, 6 to 8, 6 to 7, 7 to 10, 7 to 9, 7 to 8, 8 to 10, 8 to 9, 9 to 10, 1, 2, 3, 4, 5, 6, 7, 8, 9, or 10 times per month.

In some embodiments, the microbial composition is administered 1 to 10, 1 to 9, 1 to 8, 1 to 7, 1 to 6, 1 to 5, 1 to 4, 1 to 3, 1 to 2, 2 to 10, 2 to 9, 2 to 8, 2 to 7, 2 to 6, 2 to 5, 2 to 4, 2 to 3, 3 to 10, 3 to 9, 3 to 8, 3 to 7, 3 to 6, 3 to 5, 3 to 4, 4 to 10, 4 to 9, 4 to 8, 4 to 7, 4 to 6, 4 to 5, 5 to 10, 5 to 9, 5 to 8, 5 to 7, 5 to 6, 6 to 10, 6 to 9, 6 to 8, 6 to 7, 7 to 10, 7 to 9, 7 to 8, 8 to 10, 8 to 9, 9 to 10, 1, 2, 3, 4, 5, 6, 7, 8, 9, or 10 times per year.

In some embodiments, the microbial composition is administered to animals throughout the entire time they are on the feedlot. In some embodiments, the microbial composition is administered to animals only during a portion of time while they are on the feedlot. In some embodiments, the microbial composition is administered only during the grower phase. In some embodiments, the microbial composition is administered only during the time when animals are in the receiving pen. In some embodiments, the microbial composition is administered only when the animals are receiving vaccinations and/or treatments. In some embodiments, the microbial composition is administered only when the animals are on a step up diet or when being adapted to a high grain diet. In some embodiments, the microbial composition is administered only when the animals are on a finisher diet or a high grain diet.

In some embodiments, the microbial composition is administered during the grower phase, when animals are in the receiving pen, when animals are receiving vaccinations and/or treatments, when animals are being adapted to a high grain diet or are on a step up diet, and/or when the animals are on a finisher diet or a high grain diet.

In some embodiments, an animal entering the feed lot receives at least one microbial composition prior to entering the feed lot. In some embodiments, an animal on the feed lot receives a microbial composition that is different from the first at least one microbial composition. In further embodiments, an animal on the feed lot receives a microbial composition that is different from the first and second at least one microbial composition.

In some embodiments, the type of diet fed to the animal corresponds with the type of microbial composition administered to the animal. In some embodiments, a grazing or grass/hay-fed animal will receive a first microbial composition. In further embodiments, the same animal fed a different diet will receive a second microbial composition, wherein the first microbial composition is different from the second microbial composition. In some embodiments, the same animal fed yet a different diet will receive a third microbial composition, wherein the first microbial composition is different from the second and third microbial compositions. In some embodiments, the same animal fed yet a different diet will receive a fourth microbial composition, wherein the first microbial composition is different from the second, third, and fourth microbial compositions. In some embodiments, the same animal fed yet a different diet will receive a fifth microbial composition, wherein the first microbial composition is different from the second, third, fourth, and fifth microbial compositions.

In some embodiments, the feed can be uniformly coated with one or more layers of the microbes and/or microbial compositions disclosed herein, using conventional methods of mixing, spraying, or a combination thereof through the use of treatment application equipment that is specifically designed and manufactured to accurately, safely, and efficiently apply coatings. Such equipment uses various types of coating technology such as rotary coaters, drum coaters, fluidized bed techniques, spouted beds, rotary mists, or a combination thereof. Liquid treatments such as those of the present disclosure can be applied via either a spinning "atomizer" disk or a spray nozzle, which evenly distributes the microbial composition onto the feed as it moves though the spray pattern. In some aspects, the feed is then mixed or tumbled for an additional period of time to achieve additional treatment distribution and drying.

In some embodiments, the feed coats of the present disclosure can be up to 10 μm, 20 μm, 30 μm, 40 μm, 50 μm, 60 μm, 70 μm, 80 μm, 90 μm, 100 μm, 110 μm, 120 μm, 130 μm, 140 μm, 150 μm, 160 μm, 170 μm, 180 μm, 190 μm, 200 μm, 210 μm, 220 μm, 230 μm, 240 μm, 250 μm, 260 μm, 270 μm, 280 μm, 290 μm, 300 μm, 310 μm, 320 μm, 330 μm, 340 μm, 350 μm, 360 μm, 370 μm, 380 μm, 390 μm, 400 μm, 410 μm, 420 μm, 430 μm, 440 μm, 450 μm, 460 μm, 470 μm, 480 μm, 490 μm, 500 μm, 510 μm, 520 μm, 530 μm, 540 μm, 550 μm, 560 μm, 570 μm, 580 μm, 590 μm, 600 μm, 610 μm, 620 μm, 630 μm, 640 μm, 650 μm, 660 μm, 670 μm, 680 μm, 690 μm, 700 μm, 710 μm, 720 μm, 730 μm, 740 μm, 750 μm, 760 μm, 770 μm, 780 μm, 790 μm, 800 μm, 810 μm, 820 μm, 830 μm, 840 μm, 850 μm, 860 μm, 870 μm, 880 μm, 890 μm, 900 μm, 910 μm, 920 μm, 930 μm, 940 μm, 950 μm, 960 μm, 970 μm, 980 μm, 990 μm, 1000 μm, 1010 μm, 1020 μm, 1030 μm, 1040 μm, 1050 μm, 1060 μm, 1070 μm, 1080 μm, 1090 μm, 1100 μm, 1110 μm, 1120 μm, 1130 μm, 1140 μm, 1150 μm, 1160 μm, 1170 μm, 1180 μm, 1190 μm, 1200 μm, 1210 μm, 1220 μm, 1230 μm, 1240 μm, 1250 μm, 1260 μm, 1270 μm, 1280 μm, 1290 μm, 1300 μm, 1310 μm, 1320 μm, 1330 μm, 1340 μm, 1350 μm, 1360 μm, 1370 μm, 1380 μm, 1390 μm, 1400 μm, 1410 μm, 1420 μm, 1430 μm, 1440 μm, 1450 μm, 1460 μm, 1470 μm, 1480 μm, 1490 μm, 1500 μm, 1510 μm, 1520 μm, 1530 μm, 1540 μm, 1550 μm, 1560 μm, 1570 μm, 1580 μm, 1590 μm, 1600 μm, 1610 μm, 1620 μm, 1630 μm, 1640 μm, 1650 μm, 1660 μm, 1670 μm, 1680 μm, 1690 μm, 1700 μm, 1710 μm, 1720 μm, 1730 μm, 1740 μm, 1750 μm, 1760 μm, 1770 μm, 1780 μm, 1790 μm, 1800 μm, 1810 μm, 1820 μm, 1830 μm, 1840 μm, 1850 μm, 1860 μm, 1870 μm, 1880 μm, 1890 μm, 1900 μm, 1910 μm, 1920 μm, 1930 μm, 1940 μm, 1950 μm, 1960 μm, 1970 μm, 1980 μm, 1990 μm, 2000 μm, 2010 μm, 2020 μm, 2030 μm, 2040 μm, 2050 μm, 2060 μm, 2070 μm, 2080 μm, 2090 μm, 2100 μm, 2110 μm, 2120 μm, 2130 μm, 2140 μm, 2150 μm, 2160 μm, 2170 μm, 2180 μm, 2190 μm, 2200 μm, 2210 μm, 2220 μm, 2230 μm, 2240 μm, 2250 μm, 2260 μm, 2270 μm, 2280 μm, 2290 μm, 2300 μm, 2310 μm, 2320 μm, 2330 μm, 2340 μm, 2350 μm, 2360 μm, 2370 μm, 2380 μm, 2390 μm, 2400 μm, 2410 μm, 2420 μm, 2430 μm, 2440 μm, 2450 μm, 2460 μm, 2470 μm, 2480 μm, 2490 μm, 2500 μm, 2510 μm, 2520 μm, 2530 μm, 2540 μm, 2550 μm, 2560 μm, 2570 μm, 2580 μm, 2590 μm, 2600 μm, 2610 μm, 2620 μm, 2630 μm, 2640 μm, 2650 μm, 2660 μm, 2670 μm, 2680 μm, 2690 μm, 2700 μm, 2710 μm, 2720 μm, 2730 μm, 2740 μm, 2750 μm, 2760 μm, 2770 μm, 2780 μm, 2790 μm, 2800 μm, 2810 μm, 2820 μm, 2830 μm, 2840 μm, 2850 μm, 2860 μm, 2870 μm, 2880 μm, 2890 μm, 2900 μm, 2910 μm, 2920 μm, 2930 μm, 2940 μm, 2950 μm, 2960 μm, 2970 μm, 2980 μm, 2990 μm, or 3000 μm thick.

In some embodiments, the microbial cells can be coated freely onto any number of compositions or they can be formulated in a liquid or solid composition before being coated onto a composition. For example, a solid composition comprising the microorganisms can be prepared by mixing a solid carrier with a suspension of the spores until the solid carriers are impregnated with the spore or cell suspension. This mixture can then be dried to obtain the desired particles.

In some other embodiments, it is contemplated that the solid or liquid microbial compositions of the present disclosure further contain functional agents e.g., activated carbon, minerals, vitamins, and other agents capable of improving the quality of the products or a combination thereof.

Methods of coating and compositions in use of said methods that are known in the art can be particularly useful when they are modified by the addition of one of the embodiments of the present disclosure. Such coating methods and apparatus for their application are disclosed in, for example: U.S. Pat. Nos. 8,097,245 and 7,998,502; and PCT Pat. App. Pub. Nos. WO 2008/076975, WO 2010/138522, WO 2011/094469, WO 2010/111347, and WO 2010/111565 each of which is incorporated by reference herein.

In some embodiments, the microbes or microbial compositions of the present disclosure exhibit a synergistic effect, on one or more of the traits described herein, in the presence of one or more of the microbes or microbial compositions coming into contact with one another. The synergistic effect obtained by the taught methods can be quantified, for example, according to Colby's formula (i.e., $(E)=X+Y-(X*Y/100)$). See Colby, R. S., "Calculating Synergistic and Antagonistic Responses of Herbicide Combinations," 1967. Weeds. Vol. 15, pp. 20-22, incorporated herein by reference in its entirety. Thus, "synergistic" is intended to reflect an outcome/parameter/effect that has been increased by more than an additive amount.

In some embodiments, the microbes or microbial compositions of the present disclosure may be administered via bolus. In one embodiment, a bolus (e.g., capsule containing the composition) is inserted into a bolus gun, and the bolus gun is inserted into the buccal cavity and/or esophagas of the animal, followed by the release/injection of the bolus into the animal's digestive tract. In one embodiment, the bolus gun/applicator is a BOVIKALC bolus gun/applicator. In another embodiment, the bolus gun/applicator is a QUADRICAL gun/applicator.

In some embodiments, the microbes or microbial compositions of the present disclosure may be administered via drench. In one embodiment, the drench is an oral drench. A drench administration comprises utilizing a drench kit/applicator/syringe that injects/releases a liquid comprising the microbes or microbial compositions into the buccal cavity and/or esophagus of the animal.

In some embodiments, the microbes or microbial compositions of the present disclosure may be administered in a time-released fashion. The composition may be coated in a chemical composition, or may be contained in a mechanical device or capsule that releases the microbes or microbial compositions over a period of time instead all at once. In one embodiment, the microbes or microbial compositions are administered to an animal in a time-release capsule. In one embodiment, the composition may be coated in a chemical composition, or may be contained in a mechanical device or capsule that releases the microbes or microbial compositions all at once a period of time hours post ingestion.

In some embodiments, one microbe composition is administered one or more times when the animals are on a step up diet, and a different microbe composition is administered one or more times when the animals are on a finishing diet. In some embodiments, one microbe composition is administered one or more times when the animals are on a step up diet, a different microbe composition is administered one or more times when the animals are on the first thirty days of the finishing diet, and yet a different microbe composition is administered one or more times when the animals have been on the finishing diet for greater than thirty days.

In some embodiments, one microbe composition is administered one or more times while the animals exhibit signs of acidosis, and different microbe composition is administered one or more times once the signs of acidosis have abated. In some embodiments, a microbe composition is administered to animals that do not exhibit signs of acidosis, and a different microbe composition is administered if the animals exhibit signs of acidosis.

In some embodiments, the microbes or microbial compositions are administered in a time-released fashion between 1 to 5, 1 to 10, 1 to 15, 1 to 20, 1 to 24, 1 to 25, 1 to 30, 1 to 35, 1 to 40, 1 to 45, 1 to 50, 1 to 55, 1 to 60, 1 to 65, 1 to 70, 1 to 75, 1 to 80, 1 to 85, 1 to 90, 1 to 95, or 1 to 100 hours.

In some embodiments, the microbes or microbial compositions are administered in a time-released fashion between 1 to 2, 1 to 3, 1 to 4, 1 to 5, 1 to 6, 1 to 7, 1 to 8, 1 to 9, 1 to 10, 1 to 11, 1 to 12, 1 to 13, 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 29, or 1 to 30 days.

Microorganisms

As used herein the term "microorganism" should be taken broadly. It includes, but is not limited to, the two prokaryotic domains, Bacteria and Archaea, as well as eukaryotic fungi, protozoa, and viruses.

By way of example, the microorganisms may include species of the genera of: *Fibrobacter, Saccharofermentans, Bacillus, Spirochaeta, Bacteroides, Lachnospiracea incertae sedis, Clostridium* XLVa, *Ruminococcus, Butyricimonas, Olsenella, Acidaminococcus, Parabacteroides, Clostridum sensu stricto, Oribacterium, Pseudoflavonifractor, Treponema, Rhodobacter, Fluviicola, Succiniclasticum, Solobacterium, Veillonella, Cellulosimicrobium, Cupriavidus, Megasphaera, Succinivibrio, Oscillibacter, Pseudomonas, Corynebacterium, Adlercreutzia, Dorea, Roseburia, Anaerovibrio, Sporosarcina, Streptomyces, Syntrophococcus, Butyrivibrio, Lachnobacterium, Pyramidobacter, Coprococcus, Ruminobacter, Thermobifidia, Papillibacter, Aquimarina, Propioniciclava, Staphylococcus, Mogibacterium, Pseudobutyrivibrio, Asteroleplasma, Turicibacter, Aggregatibacter, Brevundimonas, Phascolarctobacterium,* and *Sphingobium.*

In certain embodiments, the microorganism is unculturable. This should be taken to mean that the microorganism is not known to be culturable or is difficult to culture using methods known to one skilled in the art.

In one embodiment, the microbes are obtained from animals (e.g., mammals, reptiles, birds, and the like), soil (e.g., rhizosphere), air, water (e.g., marine, freshwater, wastewater sludge), sediment, oil, plants (e.g., roots, leaves, stems), agricultural products, and extreme environments (e.g., acid mine drainage or hydrothermal systems). In a further embodiment, microbes obtained from marine or freshwater environments such as an ocean, river, or lake. In a further embodiment, the microbes can be from the surface of the body of water, or any depth of the body of water (e.g., a deep sea sample).

The microorganisms of the disclosure may be isolated in substantially pure or mixed cultures. They may be concentrated, diluted, or provided in the natural concentrations in which they are found in the source material. For example, microorganisms from saline sediments may be isolated for use in this disclosure by suspending the sediment in fresh water and allowing the sediment to fall to the bottom. The water containing the bulk of the microorganisms may be removed by decantation after a suitable period of settling and either administered to the GI tract of beef cattle, or concentrated by filtering or centrifugation, diluted to an appropriate concentration and administered to the GI tract of beef cattle with the bulk of the salt removed. By way of further example, microorganisms from mineralized or toxic sources may be similarly treated to recover the microbes for application to beef cattle to minimize the potential for damage to the animal.

In another embodiment, the microorganisms are used in a crude form, in which they are not isolated from the source material in which they naturally reside. For example, the microorganisms are provided in combination with the source material in which they reside; for example, fecal matter, rumen content, rumen fluid, or other composition found in the gastrointestinal tract. In this embodiment, the source material may include one or more species of microorganisms.

In some embodiments, a mixed population of microorganisms is used in the methods of the disclosure.

In embodiments of the disclosure where the microorganisms are isolated from a source material (for example, the material in which they naturally reside), any one or a combination of a number of standard techniques which will be readily known to skilled persons may be used. However, by way of example, these in general employ processes by which a solid or liquid culture of a single microorganism can be obtained in a substantially pure form, usually by physical separation on the surface of a solid microbial growth medium or by volumetric dilutive isolation into a liquid microbial growth medium. These processes may include isolation from dry material, liquid suspension, slurries or homogenates in which the material is spread in a thin layer over an appropriate solid gel growth medium, or serial dilutions of the material made into a sterile medium and inoculated into liquid or solid culture media.

While not essential, in one embodiment, the material containing the microorganisms may be pre-treated prior to the isolation process in order to either multiply all microorganisms in the material, remove certain microorganisms in the material, and/or shift the distribution of microorganisms in the material. Microorganisms can then be isolated from the enriched materials as disclosed above.

In certain embodiments, as mentioned herein before, the microorganism(s) may be used in crude form and need not be isolated from an animal or a media. For example, feces, or growth media which includes the microorganisms identified to be of benefit to increased feed efficiency may be obtained and used as a crude source of microorganisms for the next round of the method or as a crude source of microorganisms at the conclusion of the method. For example, fresh feces could be obtained and optionally processed.

Microbiome Shift and Abundance of Microbes

In some embodiments, the microbiome of beef cattle, including the rumen microbiome comprises a diverse arrive of microbes with a wide variety of metabolic capabilities. The microbiome is influenced by a range of factors including diet, variations in animal metabolism, and breed, among others. Most cattle diets are plant-based and rich in complex polysaccharides that enrich the gastrointestinal microbial community for microbes capable of breaking down specific polymeric components in the diet such as cellulose, hemicellulose, lignin, etc. The end products of primary degradation sustain a chain of microbes that ultimately produce a range of organic acids together with hydrogen and carbon dioxide. Because of the complex and interlinked nature of the microbiome, changing the diet and thus substrates for primary degradation may have a cascading effect on gut microbial metabolism, with changes in both the organic acid profiles and the methane levels produced, thus impacting the quality and quantity of animal production and or the products produced by the animal. See Menezes et al. (2011. *FEMS Microbiol. Ecol.* 78(2):256-265.)

In some aspects, the present disclosure is drawn to administering microbial compositions described herein to modulate or shift the microbiome of beef cattle.

In some embodiments, the microbiome is shifted through the administration of one or more microbes to one or more sections of the gastrointestinal tract. In some embodiments, the microbiome is shifted through the administration of one or more microbes to the rumen. In further embodiments, the one or more microbes are those selected from Table 1 and/or Table 2. In some embodiments, the microbiome shift or modulation includes a decrease or loss of specific microbes that were present prior to the administration of one or more microbes of the present disclosure. In some embodiments, the microbiome shift or modulation includes an increase in microbes that were present prior to the administration of one or more microbes of the present disclosure. In some embodiments, the microbiome shift or modulation includes a gain of one or more microbes that were not present prior to the administration of one or more microbes of the present disclosure. In a further embodiment, the gain of one or more microbes is a microbe that was not specifically included in the administered microbial composition.

In some embodiments, the administration of microbes of the present disclosure results in a sustained modulation of the microbiome such that the administered microbes are present in the microbiome for a period of at least 1 to 10, 1 to 9, 1 to 8, 1 to 7, 1 to 6, 1 to 5, 1 to 4, 1 to 3, 1 to 2, 2 to 10, 2 to 9, 2 to 8, 2 to 7, 2 to 6, 2 to 5, 2 to 4, 2 to 3, 3 to 10, 3 to 9, 3 to 8, 3 to 7, 3 to 6, 3 to 5, 3 to 4, 4 to 10, 4 to 9, 4 to 8, 4 to 7, 4 to 6, 4 to 5, 5 to 10, 5 to 9, 5 to 8, 5 to 7, 5 to 6, 6 to 10, 6 to 9, 6 to 8, 6 to 7, 7 to 10, 7 to 9, 7 to 8, 8 to 10, 8 to 9, 9 to 10, 1, 2, 3, 4, 5, 6, 7, 8, 9, or 10 days.

In some embodiments, the administration of microbes of the present disclosure results in a sustained modulation of the microbiome such that the administered microbes are present in the microbiome for a period of at least 1 to 10, 1 to 9, 1 to 8, 1 to 7, 1 to 6, 1 to 5, 1 to 4, 1 to 3, 1 to 2, 2 to 10, 2 to 9, 2 to 8, 2 to 7, 2 to 6, 2 to 5, 2 to 4, 2 to 3, 3 to 10, 3 to 9, 3 to 8, 3 to 7, 3 to 6, 3 to 5, 3 to 4, 4 to 10, 4 to 9, 4 to 8, 4 to 7, 4 to 6, 4 to 5, 5 to 10, 5 to 9, 5 to 8, 5 to 7, 5 to 6, 6 to 10, 6 to 9, 6 to 8, 6 to 7, 7 to 10, 7 to 9, 7 to 8, 8 to 10, 8 to 9, 9 to 10, 1, 2, 3, 4, 5, 6, 7, 8, 9, or 10 weeks.

In some embodiments, the administration of microbes of the present disclosure results in a sustained modulation of the microbiome such that the administered microbes are present in the microbiome for a period of at least 1 to 10, 1 to 9, 1 to 8, 1 to 7, 1 to 6, 1 to 5, 1 to 4, 1 to 3, 1 to 2, 2 to 10, 2 to 9, 2 to 8, 2 to 7, 2 to 6, 2 to 5, 2 to 4, 2 to 3, 3 to 10, 3 to 9, 3 to 8, 3 to 7, 3 to 6, 3 to 5, 3 to 4, 4 to 10, 4 to 9, 4 to 8, 4 to 7, 4 to 6, 4 to 5, 5 to 10, 5 to 9, 5 to 8, 5 to 7, 5 to 6, 6 to 10, 6 to 9, 6 to 8, 6 to 7, 7 to 10, 7 to 9, 7 to 8, 8 to 10, 8 to 9, 9 to 10, 1, 2, 3, 4, 5, 6, 7, 8, 9, 10, 11, or 12 months.

In some embodiments, the presence of the administered microbes are detected by sampling the gastrointestinal tract and using primers to amplify the 16S or 18S rDNA sequences, or the ITS rDNA sequences of the administered microbes. In some embodiments, the administered microbes are one or more of those selected from Table 1 and/or Table 2. In some embodiments, the administered microbes are one or more of those comprising rDNA sequences selected from SEQ ID NO: 1-5993.

In some embodiments, the microbiome of beef cattle is measured by amplifying polynucleotides collected from gastrointestinal samples, wherein the polynucleotides may be 16S or 18S rDNA fragments, or ITS rDNA fragments of microbial rDNA. In one embodiment, the microbiome is fingerprinted by a method of denaturing gradient gel electrophoresis (DGGE) wherein the amplified rDNA fragments are sorted by where they denature, and form a unique banding pattern in a gel that may be used for comparing the microbiome of the same beef cattle over time or the microbiomes of multiple. In another embodiment, the microbiome is fingerprinted by a method of terminal restriction fragment length polymorphism (T-RFLP), wherein labelled PCR fragments are digested using a restriction enzyme and then sorted by size. In a further embodiment, the data collected from the T-RFLP method is evaluated by nonmetric multidimensional scaling (nMDS) ordination and PERMANOVA statistics identify differences in microbiomes, thus allowing for the identification and measurement of shifts in the microbiome. See also Shanks et al. (2011. *Appl. Environ. Microbiol.* 77(9):2992-3001), Petri et al. (2013. *PLOS one.* 8(12):e83424), and Menezes et al. (2011. *FEMS Microbiol. Ecol.* 78(2):256-265.)

In some embodiments, administration of one or more microbial compositions results in a shift in the microbiome that increases the number and/or type of carbon dioxide fixing microbes. In some embodiments, administration of one or more microbial composition results in a shift in the microbiome that increases the number and/or type of carbon dioxide fixing microbes by at least 0.5%, at least 1%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, at least 200%, at least 300%, at least 400%, at least 500%, at least 600%, or at least 700%. In some embodiments, administration of one or more microbial composition results in a shift in the microbiome that increases the number and/or type of carbon dioxide fixing microbes by at least about 0.5%, at least about 1%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 100%, at least about 200%, at least about 300%, at least about 400%, at least about 500%, at least about 600%, or at least about 700%.

In some embodiments, administration of one or more microbial compositions results in a shift in the microbiome that decreases the number and/or type of methanogenic microbes. In some embodiments, administration of one or more microbial composition results in a shift in the microbiome that reduces the number and/or type of methanogenic microbes by at least 0.5%, at least 1%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95%. In some embodiments, administration of one or more microbial composition results in a shift in the microbiome that decreases the number and/or type of methanogenic microbes by at least about 0.5%, at least about 1%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, or at least about 95%.

In some embodiments, administration of one or more microbial compositions results in a shift in the microbiome that decreases the number and/or type of lactate producing microbes. In some embodiments, administration of one or more microbial composition results in a shift in the microbiome that reduces the number and/or type of lactate producing microbes by at least 0.5%, at least 1%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95%. In some embodiments, administration of one or more microbial composition results in a shift in the microbiome that decreases the number and/or type of lactate producing microbes by at least about 0.5%, at least about 1%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, or at least about 95%.

In some embodiments, administration of one or more microbial compositions results in a shift in the microbiome that increases the number and/or type of lactate degrading microbes. In some embodiments, administration of one or more microbial composition results in a shift in the microbiome that increases the number and/or type of lactate degrading microbes by at least 0.5%, at least 1%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, at least 200%, at least 300%, at least 400%, at least 500%, at least 600%, or at least 700%. In some embodiments, administration of one or more microbial composition results in a shift in the microbiome that increases the number and/or type of lactate degrading microbes by at least about 0.5%, at least about 1%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 100%, at least about 200%, at least about 300%, at least about 400%, at least about 500%, at least about 600%, or at least about 700%.

In some embodiments, administration of one or more microbial compositions results in a shift in the microbiome that increases the number and/or type of volatile fatty acid (VFA)-producing microbes. In some embodiments, the VFAs include acetate, butyrate, propionate, isobutyrate, isovalerate, and valerate. In some embodiments, administration of one or more microbial composition results in a shift in the microbiome that increases the number and/or type of VFA-producing microbes by at least 0.5%, at least 1%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, at least 200%, at least 300%, at least 400%, at least 500%, at least 600%, or at least 700%. In some embodiments, administration of one or more microbial composition results in a shift in the microbiome that increases the number and/or type of VFA-producing microbes by at least about 0.5%, at least about 1%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 100%, at least about 200%, at least about 300%, at least about 400%, at least about 500%, at least about 600%, or at least about 700%.

In some embodiments, administration of one or more microbial compositions results in a shift in the microbiome that increases the number and/or type of microbes that are utilized as protein sources for the animal. In some embodiments, administration of one or more microbial composition results in a shift in the microbiome that increases the number and/or type of microbes that are utilized as protein sources for the animal by at least 0.5%, at least 1%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, at least 200%, at least 300%, at least 400%, at least 500%, at least 600%, or at least 700%. In some embodiments, administration of one or more microbial composition results in a shift in the microbiome that increases the number and/or type of microbes that are utilized as protein sources for the animal by at least about 0.5%, at least about 1%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 100%, at least about 200%, at least about 300%, at least about 400%, at least about 500%, at least about 600%, or at least about 700%.

In some embodiments, administration of one or more microbial compositions results in a shift in the microbiome that increases the number and/or type of vitamin synthesizing microbes. In some embodiments, administration of one or more microbial composition results in a shift in the microbiome that increases the number and/or type of vitamin synthesizing microbes by at least 0.5%, at least 1%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, at least 200%, at least 300%, at least 400%, at least 500%, at least 600%, or at least 700%. In some embodiments, administration of one or more microbial composition results in a shift in the microbiome that increases the number and/or type of vitamin synthesizing microbes by at least about 0.5%, at least about 1%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 100%, at least about 200%, at least about 300%, at least about 400%, at least about 500%, at least about 600%, or at least about 700%.

In some embodiments, administration of one or more microbial compositions results in a shift in the microbiome that reduces the overall alpha diversity of the microbial community. In some embodiments, administration of one or more microbial composition results in a shift in the microbiome that reduces the overall alpha diversity of the microbial community by at least 0.5%, at least 1%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, at least 200%, at least 300%, at least 400%, at least 500%, at least 600%, or at least 700%. In some embodiments, administration of one or more microbial composition results in a shift in the microbiome that reduces the overall alpha diversity of the microbial community by at least about 0.5%, at least about 1%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 100%, at least about 200%, at least about 300%, at least about 400%, at least about 500%, at least about 600%, or at least about 700%.

In some embodiments, the administration of microbes of the present disclosure results in a modulation or shift of the microbiome which further results in a desired phenotype or improved trait.

Cattle Microbial Compositional Diversity

Bovine in a commercial settings have been found to exhibit a high degree of animal-to-animal variability in terms of the microbial diversity of the rumen. The increased variability of the microbial compositions of the rumen may lead to a lower ability to reach a stable microbial composition. Lower variability in turn results in a considerable difference in health, weight, and other attributes that affect commercial viability of the animal. See Shabat S K B et al. (ISME J 10:2958-2972.)

In some embodiments, the administration of one or more microbes and/or bioensembles of the present disclosure during feed transition in beef cattle decreases the variability of the rumen microbiome in cattle and further establishes a stable rumen microbiome.

In some embodiments, the variability of the rumen microbiome is measured as the total number of species present in the rumen at one or more locations.

In some embodiments, the administration of one or more microbes and/or bioensembles of the present disclosure reduces the amount of time required for the rumen microbiome to reach a stabilized state.

In some embodiments, the administration of one or more microbes and/or bioensembles of the present disclosure results in beef cattle of the present disclosure reaching a stabilized state of the rumen microbiome; a reduction in the variability of the rumen microbiome.

In some embodiments, the stabilized state of the rumen microbiome is reached when the rumen microbiome of beef cattle contains about 10, about 20, about, 30, about 40, about 50, about 60, about 70, about 80, about 90, about 100, about 120, about 130, about 140, about 150, about 160, about 170, about 180, about 190, about 200, about 250, about 300, about 400, about 500, about 600, about 700, about 800, about 900, about 1,000, about 1,500, about 2,000, about 2,500, about 3,000, about 3,500, about 4,000, about 4,500, about 5,000, about 5,500, about 6,000, about 6,500, about 7,000, about 7,500, about 8,000, about 8,500, about 9,000, about 9,500, or about 10,000 different species.

In some embodiments, the stabilized state of the rumen microbiome is reached when the rumen microbiome of beef cattle contains between about 10 to about 50, about 10 to about 100, about 50 to about 100, about 50 to about 200, about 100 to about 150, about 100 to about 200, about 100 to about 400, about 200 to about 500, about 200 to about 700, about 400 to about 800, about 500 to about 1,000, about 500 to about 2,000, about 1,000 to about 2,000, about 1,000 to about 5,000, about 5,000 to about 7,000, about 5,000 to about 10,000, or about 8,000 to about 10,000 different species.

In some embodiments, at least 5%, at least 10%, at least 20%, at least 30%, at least 40%, at least 50%, at least 60%, at least 70%, at least 80%, at least 90%, or at least 95% of the beef cattle in a feed transition reach a stabilized state after administration of one or more microbes and/or bioensembles of the present disclosure.

MIC Scoring

According to the methods provided herein, a sample is processed to detect the presence of one or more microorganism types in the sample (FIG. 1, 1001; FIG. 2, 2001). The absolute number of one or more microorganism organism type in the sample is determined (FIG. 1, 1002; FIG. 2, 2002). The determination of the presence of the one or more organism types and the absolute number of at least one organism type can be conducted in parallel or serially. For example, in the case of a sample comprising a microbial community comprising bacteria (i.e., one microorganism type) and fungi (i.e., a second microorganism type), the user in one embodiment detects the presence of one or both of the organism types in the sample (FIG. 1, 1001; FIG. 2, 2001). The user, in a further embodiment, determines the absolute number of at least one organism type in the sample—in the case of this example, the number of bacteria, fungi or combination thereof, in the sample (FIG. 1, 1002; FIG. 2, 2002).

In one embodiment, the sample, or a portion thereof is subjected to flow cytometry (FC) analysis to detect the presence and/or number of one or more microorganism types (FIG. 1, 1001, 1002; FIG. 2, 2001, 2002). In one flow cytometer embodiment, individual microbial cells pass through an illumination zone, at a rate of at least about $300 * s^{-1}$, or at least about $500 * s^{-1}$, or at least about $1000 * s^{-1}$. However, one of ordinary skill in the art will recognize that this rate can vary depending on the type of instrument is employed. Detectors which are gated electronically measure the magnitude of a pulse representing the extent of light scattered. The magnitudes of these pulses are sorted electronically into "bins" or "channels," permitting the display of histograms of the number of cells possessing a certain quantitative property (e.g., cell staining property, diameter, cell membrane) versus the channel number. Such analysis allows for the determination of the number of cells in each "bin" which in embodiments described herein is an "microorganism type" bin, e.g., a bacteria, fungi, nematode, protozoan, archaea, algae, dinoflagellate, virus, viroid, etc.

In one embodiment, a sample is stained with one or more fluorescent dyes wherein a fluorescent dye is specific to a particular microorganism type, to enable detection via a flow cytometer or some other detection and quantification method that harnesses fluorescence, such as fluorescence microscopy. The method can provide quantification of the number of cells and/or cell volume of a given organism type in a sample. In a further embodiment, as described herein, flow cytometry is harnessed to determine the presence and quantity of a unique first marker and/or unique second marker of the organism type, such as enzyme expression, cell surface protein expression, etc. Two- or three-variable histograms or contour plots of, for example, light scattering versus fluorescence from a cell membrane stain (versus fluorescence from a protein stain or DNA stain) may also be generated, and thus an impression may be gained of the distribution of a variety of properties of interest among the cells in the population as a whole. A number of displays of such multiparameter flow cytometric data are in common use and are amenable for use with the methods described herein.

In one embodiment of processing the sample to detect the presence and number of one or more microorganism types, a microscopy assay is employed (FIG. 1, 1001, 1002). In one embodiment, the microscopy is optical microscopy, where visible light and a system of lenses are used to magnify images of small samples. Digital images can be captured by a charge-couple device (CCD) camera. Other microscopic techniques include, but are not limited to, scanning electron microscopy and transmission electron microscopy. Microorganism types are visualized and quantified according to the aspects provided herein.

In another embodiment of the disclosure, in order to detect the presence and number of one or more microorganism types, each sample, or a portion thereof is subjected to fluorescence microscopy. Different fluorescent dyes can be used to directly stain cells in samples and to quantify total cell counts using an epifluorescence microscope as well as flow cytometry, described above. Useful dyes to quantify microorganisms include but are not limited to acridine orange (AO), 4,6-di-amino-2 phenylindole (DAPI) and 5-cyano-2,3 Dytolyl Tetrazolium Chloride (CTC). Viable cells can be estimated by a viability staining method such as the LIVE/DEAD® Bacterial Viability Kit (Bac-Light™) which contains two nucleic acid stains: the green-fluorescent SYTO 9™ dye penetrates all membranes and the red-fluorescent propidium iodide (PI) dye penetrates cells with damaged membranes. Therefore, cells with compromised membranes will stain red, whereas cells with undamaged membranes will stain green. Fluorescent in situ hybridization (FISH) extends epifluorescence microscopy, allowing for the fast detection and enumeration of specific organisms. FISH uses fluorescent labelled oligonucleotides probes (usually 15-25 basepairs) which bind specifically to organism DNA in the sample, allowing the visualization of the cells using an epifluorescence or confocal laser scanning microscope (CLSM). Catalyzed reporter deposition fluorescence in situ hybridization (CARD-FISH) improves upon the FISH method by using oligonucleotide probes labelled with a horse radish peroxidase (HRP) to amplify the intensity of the signal obtained from the microorganisms being studied. FISH can be combined with other techniques to characterize microorganism communities. One combined technique is high affinity peptide nucleic acid (PNA)-FISH, where the probe has an enhanced capability to penetrate through the Extracellular Polymeric Substance (EPS) matrix. Another example is LIVE/DEAD-FISH which combines the cell viability kit with FISH and has been used to assess the efficiency of disinfection in drinking water distribution systems.

In another embodiment, each sample, or a portion thereof is subjected to Raman micro-spectroscopy in order to determine the presence of a microorganism type and the absolute number of at least one microorganism type (FIG. 1, 1001-1002; FIG. 2, 2001-2002). Raman micro-spectroscopy is a non-destructive and label-free technology capable of detecting and measuring a single cell Raman spectrum (SCRS). A typical SCRS provides an intrinsic biochemical "fingerprint" of a single cell. A SCRS contains rich information of the biomolecules within it, including nucleic acids, proteins, carbohydrates and lipids, which enables characterization of different cell species, physiological changes and cell phenotypes. Raman microscopy examines the scattering of laser light by the chemical bonds of different cell biomarkers. A SCRS is a sum of the spectra of all the biomolecules in one single cell, indicating a cell's phenotypic profile. Cellular phenotypes, as a consequence of gene expression, usually reflect genotypes. Thus, under identical growth conditions, different microorganism types give distinct SCRS corresponding to differences in their genotypes and can thus be identified by their Raman spectra.

In yet another embodiment, the sample, or a portion thereof is subjected to centrifugation in order to determine the presence of a microorganism type and the number of at least one microorganism type (FIG. 1, 1001-1002; FIG. 2, 2001-2002). This process sediments a heterogeneous mixture by using the centrifugal force created by a centrifuge. More dense components of the mixture migrate away from the axis of the centrifuge, while less dense components of the mixture migrate towards the axis. Centrifugation can allow fractionation of samples into cytoplasmic, membrane and extracellular portions. It can also be used to determine localization information for biological molecules of interest. Additionally, centrifugation can be used to fractionate total microbial community DNA. Different prokaryotic groups differ in their guanine-plus-cytosine (G+C) content of DNA, so density-gradient centrifugation based on G+C content is a method to differentiate organism types and the number of cells associated with each type. The technique generates a fractionated profile of the entire community DNA and indicates abundance of DNA as a function of G+C content. The total community DNA is physically separated into highly purified fractions, each representing a different G+C content that can be analyzed by additional molecular techniques such as denaturing gradient gel electrophoresis (DGGE)/amplified ribosomal DNA restriction analysis (ARDRA) (see discussion herein) to assess total microbial community diversity and the presence/quantity of one or more microorganism types.

In another embodiment, the sample, or a portion thereof is subjected to staining in order to determine the presence of a microorganism type and the number of at least one microorganism type (FIG. 1, 1001-1002; FIG. 2, 2001-2002). Stains and dyes can be used to visualize biological tissues, cells or organelles within cells. Staining can be used in conjunction with microscopy, flow cytometry or gel electrophoresis to visualize or mark cells or biological molecules that are unique to different microorganism types. In vivo staining is the process of dyeing living tissues, whereas in vitro staining involves dyeing cells or structures that have been removed from their biological context. Examples of specific staining techniques for use with the methods described herein include, but are not limited to: gram staining to determine gram status of bacteria, endospore staining to identify the presence of endospores, Ziehl-Neelsen staining, haematoxylin and eosin staining to examine thin sections of tissue, papanicolaou staining to examine cell samples from various bodily secretions, periodic acid-Schiff staining of carbohydrates, Masson's trichome employing a three-color staining protocol to distinguish cells from the surrounding connective tissue, Romanowsky stains (or common variants that include Wright's stain, Jenner's stain, May-Grunwald stain, Leishman stain and Giemsa stain) to examine blood or bone marrow samples, silver staining to reveal proteins and DNA, Sudan staining for lipids and Conklin's staining to detect true endospores. Common biological stains include acridine orange for cell cycle determination; bismarck brown for acid mucins; carmine for glycogen; carmine alum for nuclei; Coomassie blue for proteins; Cresyl violet for the acidic components of the neuronal cytoplasm; Crystal violet for cell walls; DAPI for nuclei; eosin for cytoplasmic material, cell membranes, some extracellular structures and red blood cells; ethidium bromide for DNA; acid fuchsine for collagen, smooth muscle or mitochondria; haematoxylin for nuclei; Hoechst stains for DNA; iodine for starch; malachite green for bacteria in the Gimenez staining technique and for spores; methyl green for chromatin; methylene blue for animal cells; neutral red for Nissl substance; Nile blue for nuclei; Nile red for lipohilic entities; osmium tetroxide for lipids; rhodamine is used in fluorescence microscopy; safranin for nuclei. Stains are also used in transmission electron microscopy to enhance contrast and include phosphotungstic acid, osmium tetroxide, ruthenium tetroxide, ammonium molybdate, cadmium iodide, carbohydrazide, ferric chloride, hexamine, indium trichloride, lanthanum nitrate, lead acetate, lead citrate, lead(II) nitrate, periodic acid, phosphomolybdic acid, potassium ferricyanide, potassium ferrocyanide, ruthenium red, silver nitrate, silver proteinate, sodium chloroaurate, thallium nitrate, thiosemicarbazide, uranyl acetate, uranyl nitrate, and vanadyl sulfate.

In another embodiment, the sample, or a portion thereof is subjected to mass spectrometry (MS) in order to determine the presence of a microorganism type and the number of at least one microorganism type (FIG. 1, 1001-1002; FIG. 2, 2001-2002). MS, as discussed below, can also be used to detect the presence and expression of one or more unique markers in a sample (FIG. 1, 1003-1004; FIG. 2, 2003-2004). MS is used for example, to detect the presence and quantity of protein and/or peptide markers unique to microorganism types and therefore to provide an assessment of the number of the respective microorganism type in the sample. Quantification can be either with stable isotope labelling or label-free. De novo sequencing of peptides can also occur directly from MS/MS spectra or sequence tagging (produce a short tag that can be matched against a database). MS can also reveal post-translational modifications of proteins and identify metabolites. MS can be used in conjunction with chromatographic and other separation techniques (such as gas chromatography, liquid chromatography, capillary electrophoresis, ion mobility) to enhance mass resolution and determination.

In another embodiment, the sample, or a portion thereof is subjected to lipid analysis in order to determine the presence of a microorganism type and the number of at least one microorganism type (FIG. 1, 1001-1002; FIG. 2, 2001-2002). Fatty acids are present in a relatively constant proportion of the cell biomass, and signature fatty acids exist in microbial cells that can differentiate microorganism types within a community. In one embodiment, fatty acids are extracted by saponification followed by derivatization to give the respective fatty acid methyl esters (FAMEs), which are then analyzed by gas chromatography. The FAME profile in one embodiment is then compared to a reference FAME database to identify the fatty acids and their corresponding microbial signatures by multivariate statistical analyses.

In the aspects of the methods provided herein, the number of unique first makers in the sample, or portion thereof (e.g., sample aliquot) is measured, as well as the abundance of each of the unique first markers (FIG. 1, 1003; FIG. 2, 2003). A unique marker is a marker of a microorganism strain. It should be understood by one of ordinary skill in the art that depending on the unique marker being probed for and measured, the entire sample need not be analyzed. For example, if the unique marker is unique to bacterial strains, then the fungal portion of the sample need not be analyzed. As described above, in some embodiments, measuring the absolute abundance of one or more organism types in a sample comprises separating the sample by organism type, e.g., via flow cytometry.

Any marker that is unique to an organism strain can be employed herein. For example, markers can include, but are not limited to, small subunit ribosomal RNA genes (16S/18S rDNA), large subunit ribosomal RNA genes (23S/25S/28S rDNA), intercalary 5.8S gene, cytochrome c oxidase, beta-tubulin, elongation factor, RNA polymerase and internal transcribed spacer (ITS).

Ribosomal RNA genes (rDNA), especially the small subunit ribosomal RNA genes, i.e., 18S rRNA genes (18S rDNA) in the case of eukaryotes and 16S rRNA (16S rDNA) in the case of prokaryotes, have been the predominant target for the assessment of organism types and strains in a microbial community. However, the large subunit ribosomal RNA genes, 28S rDNAs, have been also targeted. rDNAs are suitable for taxonomic identification because: (i) they are ubiquitous in all known organisms; (ii) they possess both conserved and variable regions; (iii) there is an exponentially expanding database of their sequences available for comparison. In community analysis of samples, the conserved regions serve as annealing sites for the corresponding universal PCR and/or sequencing primers, whereas the variable regions can be used for phylogenetic differentiation. In addition, the high copy number of rDNA in the cells facilitates detection from environmental samples.

The internal transcribed spacer (ITS), located between the 18S rDNA and 28S rDNA, has also been targeted. The ITS is transcribed but spliced away before assembly of the ribosomes. The ITS region is composed of two highly variable spacers, ITS1 and ITS2, and the intercalary 5.8S gene. This rDNA operon occurs in multiple copies in genomes. Because the ITS region does not code for ribosome components, it is highly variable.

In one embodiment, the unique RNA marker can be an mRNA marker, an siRNA marker or a ribosomal RNA marker.

Protein-coding functional genes can also be used herein as a unique first marker. Such markers include but are not limited to: the recombinase A gene family (bacterial RecA, archaea RadA and RadB, eukaryotic Rad51 and Rad57, phage UvsX); RNA polymerase β subunit (RpoB) gene, which is responsible for transcription initiation and elongation; chaperonins. Candidate marker genes have also been identified for bacteria plus archaea: ribosomal protein S2 (rpsB), ribosomal protein S10 (rpsJ), ribosomal protein L1 (rplA), translation elongation factor EF-2, translation initiation factor IF-2, metalloendopeptidase, ribosomal protein L22, ffh signal recognition particle protein, ribosomal protein L4/L1e (rplD), ribosomal protein L2 (rplB), ribosomal protein S9 (rpsI), ribosomal protein L3 (rplC), phenylalanyl-tRNA synthetase beta subunit, ribosomal protein L14b/L23e (rplN), ribosomal protein S5, ribosomal protein S19 (rpsS), ribosomal protein S7, ribosomal protein L16/L10E (rplP), ribosomal protein S13 (rpsM), phenylalanyl-tRNA synthetase a subunit, ribosomal protein L15, ribosomal protein L25/L23, ribosomal protein L6 (rplF), ribosomal protein L11 (rplK), ribosomal protein L5 (rplE), ribosomal protein S12/S23, ribosomal protein L29, ribosomal protein S3 (rpsC), ribosomal protein S11 (rpsK), ribosomal protein L10, ribosomal protein S8, tRNA pseudouridine synthase B, ribosomal protein L18P/L5E, ribosomal protein S15P/S13e, Porphobilinogen deaminase, ribosomal protein S17, ribosomal protein L13 (rplM), phosphoribosylformylglycinamidine cyclo-ligase (rpsE), ribonuclease HII and ribosomal protein L24. Other candidate marker genes for bacteria include: transcription elongation protein NusA (nusA), rpoB DNA-directed RNA polymerase subunit beta (rpoB), GTP-binding protein EngA, rpoC DNA-directed RNA polymerase subunit beta', priA primosome assembly protein, transcription-repair coupling factor, CTP synthase (pyrG), secY preprotein translocase subunit SecY, GTP-binding protein Obg/CgtA, DNA polymerase I, rpsF 30S ribosomal protein S6, poA DNA-directed RNA polymerase subunit alpha, peptide chain release factor 1, rplI 50S ribosomal protein L9, polyribonucleotide nucleotidyltransferase, tsf elongation factor Ts (tsf), rplQ 50S ribosomal protein L17, tRNA (guanine-N(1)-)-methyltransferase (rplS), rplY probable 50S ribosomal protein L25, DNA repair protein RadA, glucose-inhibited division protein A, ribosome-binding factor A, DNA mismatch repair protein MutL, smpB SsrA-binding protein (smpB), N-acetylglucosaminyl transferase, S-adenosyl-methyltransferase MraW, UDP-N-acetylmuramoylalanine-D-glutamate ligase, rplS 50S ribosomal protein L19, rplT 50S ribosomal protein L20 (rplT), ruvA Holliday junction DNA helicase, ruvB Holliday junction DNA helicase B, serS seryl-tRNA synthetase, rplU 50S ribosomal protein L21, rpsR 30S ribosomal protein 518, DNA mismatch repair protein MutS, rpsT 30S ribosomal protein S20, DNA repair protein RecN, frr ribosome recycling factor (frr), recombination protein RecR, protein of unknown function UPF0054, miaA tRNA isopentenyltransferase, GTP-binding protein YchF, chromosomal replication initiator protein DnaA, dephospho-CoA kinase, 16S rRNA processing protein RimM, ATP-cone domain protein, 1-deoxy-D-xylulose 5-phosphate reductoisomerase, 2C-methyl-D-erythritol 2,4-cyclodiphosphate synthase, fatty acid/phospholipid synthesis protein PlsX, tRNA(Ile)-lysidine synthetase, dnaG DNA primase (dnaG), ruvC Holliday junction resolvase, rpsP 30S ribosomal protein 516, Recombinase A recA, riboflavin biosynthesis protein RibF, glycyl-tRNA synthetase beta subunit, trmU tRNA (5-methylaminomethyl-2-thiouridylate)-methyltransferase, rpmI 50S ribosomal protein L35, hemE uroporphyrinogen decarboxylase, Rod shape-determining protein, rpmA 50S ribosomal protein L27 (rpmA), peptidyl-tRNA hydrolase, translation initiation factor IF-3 (infC), UDP-N-acetylmuramyl-tripeptide synthetase, rpmF 50S ribosomal protein L32, rplL 50S ribosomal protein L7/L12 (rplL), leuS leucyl-tRNA synthetase, ligA NAD-dependent DNA ligase, cell division protein FtsA, GTP-binding protein TypA, ATP-dependent Clp protease, ATP-binding subunit ClpX, DNA replication and repair protein RecF and UDP-N-acetylenolpyruvoylglucosamine reductase.

Phospholipid fatty acids (PLFAs) may also be used as unique first markers according to the methods described herein. Because PLFAs are rapidly synthesized during microbial growth, are not found in storage molecules and degrade rapidly during cell death, it provides an accurate census of the current living community. All cells contain fatty acids (FAs) that can be extracted and esterified to form fatty acid methyl esters (FAMEs). When the FAMEs are analyzed using gas chromatography-mass spectrometry, the resulting profile constitutes a 'fingerprint' of the microorganisms in the sample. The chemical compositions of membranes for organisms in the domains Bacteria and Eukarya are comprised of fatty acids linked to the glycerol by an ester-type bond (phospholipid fatty acids (PLFAs)). In contrast, the membrane lipids of Archaea are composed of long and branched hydrocarbons that are joined to glycerol by an ether-type bond (phospholipid ether lipids (PLELs)). This is one of the most widely used non-genetic criteria to distinguish the three domains. In this context, the phospholipids derived from microbial cell membranes, characterized by different acyl chains, are excellent signature molecules, because such lipid structural diversity can be linked to specific microbial taxa.

As provided herein, in order to determine whether an organism strain is active, the level of expression of one or more unique second markers, which can be the same or different as the first marker, is measured (FIG. 1, 1004; FIG. 2, 2004). Unique first markers are described above. The unique second marker is a marker of microorganism activity. For example, in one embodiment, the mRNA or protein expression of any of the first markers described above is considered a unique second marker for the purposes of this disclosure.

In one embodiment, if the level of expression of the second marker is above a threshold level (e.g., a control level) or at a threshold level, the microorganism is considered to be active (FIG. 1, 1005; FIG. 2, 2005). Activity is determined in one embodiment, if the level of expression of the second marker is altered by at least about 5%, at least about 10%, at least about 15%, at least about 20%, at least about 25%, or at least about 30%, as compared to a threshold level, which in some embodiments, is a control level.

Second unique markers are measured, in one embodiment, at the protein, RNA or metabolite level. A unique second marker is the same or different as the first unique marker.

As provided above, a number of unique first markers and unique second markers can be detected according to the methods described herein. Moreover, the detection and quantification of a unique first marker is carried out according to methods known to those of ordinary skill in the art (FIG. 1, 1003-1004, FIG. 2, 2003-2004).

Nucleic acid sequencing (e.g., gDNA, cDNA, rRNA, mRNA) in one embodiment is used to determine absolute cell count of a unique first marker and/or unique second marker. Sequencing platforms include, but are not limited to, Sanger sequencing and high-throughput sequencing methods available from Roche/454 Life Sciences, Illumina/Solexa, Pacific Biosciences, Ion Torrent and Nanopore. The sequencing can be amplicon sequencing of particular DNA or RNA sequences or whole metagenome/transcriptome shotgun sequencing.

Traditional Sanger sequencing (Sanger et al. (1977) DNA sequencing with chain-terminating inhibitors. Proc Natl. Acad. Sci. USA, 74, pp. 5463-5467, incorporated by reference herein in its entirety) relies on the selective incorporation of chain-terminating dideoxynucleotides by DNA polymerase during in vitro DNA replication and is amenable for use with the methods described herein.

In another embodiment, the sample, or a portion thereof is subjected to extraction of nucleic acids, amplification of DNA of interest (such as the rRNA gene) with suitable primers and the construction of clone libraries using sequencing vectors. Selected clones are then sequenced by Sanger sequencing and the nucleotide sequence of the DNA of interest is retrieved, allowing calculation of the number of unique microorganism strains in a sample.

454 pyrosequencing from Roche/454 Life Sciences yields long reads and can be harnessed in the methods described herein (Margulies et al. (2005) Nature, 437, pp. 376-380; U.S. Pat. Nos. 6,274,320; 6,258,568; 6,210,891, each of which is herein incorporated in its entirety for all purposes). Nucleic acid to be sequenced (e.g., amplicons or nebulized genomic/metagenomic DNA) have specific adapters affixed on either end by PCR or by ligation. The DNA with adapters is fixed to tiny beads (ideally, one bead will have one DNA fragment) that are suspended in a water-in-oil emulsion. An emulsion PCR step is then performed to make multiple copies of each DNA fragment, resulting in a set of beads in which each bead contains many cloned copies of the same DNA fragment. Each bead is then placed into a well of a fiber-optic chip that also contains enzymes necessary for the sequencing-by-synthesis reactions. The addition of bases (such as A, C, G, or T) trigger pyrophosphate release, which produces flashes of light that are recorded to infer the sequence of the DNA fragments in each well. About 1 million reads per run with reads up to 1,000 bases in length can be achieved. Paired-end sequencing can be done, which produces pairs of reads, each of which begins at one end of a given DNA fragment. A molecular barcode can be created and placed between the adapter sequence and the sequence of interest in multiplex reactions, allowing each sequence to be assigned to a sample bioinformatically.

Illumina/Solexa sequencing produces average read lengths of about 25 basepairs (bp) to about 300 bp (Bennett et al. (2005) Pharmacogenomics, 6:373-382; Lange et al. (2014). BMC Genomics 15, p. 63; Fadrosh et al. (2014) Microbiome 2, p. 6; Caporaso et al. (2012) ISME J, 6, p. 1621-1624; Bentley et al. (2008) Accurate whole human genome sequencing using reversible terminator chemistry. Nature, 456:53-59). This sequencing technology is also sequencing-by-synthesis but employs reversible dye terminators and a flow cell with a field of oligos attached. DNA fragments to be sequenced have specific adapters on either end and are washed over a flow cell filled with specific oligonucleotides that hybridize to the ends of the fragments. Each fragment is then replicated to make a cluster of identical fragments. Reversible dye-terminator nucleotides are then washed over the flow cell and given time to attach. The excess nucleotides are washed away, the flow cell is imaged, and the reversible terminators can be removed so that the process can repeat and nucleotides can continue to be added in subsequent cycles. Paired-end reads that are 300 bases in length each can be achieved. An Illumina platform can produce 4 billion fragments in a paired-end fashion with 125 bases for each read in a single run. Barcodes can also be used for sample multiplexing, but indexing primers are used.

The SOLiD (Sequencing by Oligonucleotide Ligation and Detection, Life Technologies) process is a "sequencing-by-ligation" approach, and can be used with the methods described herein for detecting the presence and abundance of a first marker and/or a second marker (FIG. 1, 1003-1004; FIG. 2, 2003-2004) (Peckham et al. SOLiD™ Sequencing and 2-Base Encoding. San Diego, Calif.: American Society of Human Genetics, 2007; Mitra et al. (2013) Analysis of the intestinal microbiota using SOLiD 16S rRNA gene sequencing and SOLiD shotgun sequencing. BMC Genomics, 14(Suppl 5): S16; Mardis (2008) Next-generation DNA sequencing methods. Annu Rev Genomics Hum Genet, 9:387-402; each incorporated by reference herein in its entirety). A library of DNA fragments is prepared from the sample to be sequenced, and are used to prepare clonal bead populations, where only one species of fragment will be present on the surface of each magnetic bead. The fragments attached to the magnetic beads will have a universal P1 adapter sequence so that the starting sequence of every fragment is both known and identical. Primers hybridize to the P1 adapter sequence within the library template. A set of four fluorescently labelled di-base probes compete for ligation to the sequencing primer. Specificity of the di-base probe is achieved by interrogating every 1st and 2nd base in each ligation reaction. Multiple cycles of ligation, detection and cleavage are performed with the number of cycles determining the eventual read length. The SOLiD platform can produce up to 3 billion reads per run with reads that are 75 bases long. Paired-end sequencing is available and can be used herein, but with the second read in the pair being only 35 bases long. Multiplexing of samples is possible through a system akin to the one used by Illumina, with a separate indexing run.

The Ion Torrent system, like 454 sequencing, is amenable for use with the methods described herein for detecting the presence and abundance of a first marker and/or a second marker (FIG. 1, 1003-1004; FIG. 2, 2003-2004). It uses a plate of microwells containing beads to which DNA fragments are attached. It differs from all of the other systems, however, in the manner in which base incorporation is detected. When a base is added to a growing DNA strand, a proton is released, which slightly alters the surrounding pH. Microdetectors sensitive to pH are associated with the wells on the plate, and they record when these changes occur. The different bases (A, C, G, T) are washed sequentially through the wells, allowing the sequence from each well to be inferred. The Ion Proton platform can produce up to 50 million reads per run that have read lengths of 200 bases. The Personal Genome Machine platform has longer reads at 400 bases. Bidirectional sequencing is available. Multiplexing is possible through the standard in-line molecular barcode sequencing.

Pacific Biosciences (PacBio) SMRT sequencing uses a single-molecule, real-time sequencing approach and in one embodiment, is used with the methods described herein for detecting the presence and abundance of a first marker and/or a second marker (FIG. 1, 1003-1004; FIG. 2, 2003-2004). The PacBio sequencing system involves no amplification step, setting it apart from the other major next-generation sequencing systems. In one embodiment, the sequencing is performed on a chip containing many zero-mode waveguide (ZMW) detectors. DNA polymerases are attached to the ZMW detectors and phospholinked dye-labeled nucleotide incorporation is imaged in real time as DNA strands are synthesized. The PacBio system yields very long read lengths (averaging around 4,600 bases) and a very high number of reads per run (about 47,000). The typical "paired-end" approach is not used with PacBio, since reads are typically long enough that fragments, through CCS, can be covered multiple times without having to sequence from each end independently. Multiplexing with PacBio does not involve an independent read, but rather follows the standard "in-line" barcoding model.

In one embodiment, where the first unique marker is the ITS genomic region, automated ribosomal intergenic spacer analysis (ARISA) is used in one embodiment to determine the number and identity of microorganism strains in a sample (FIG. 1, 1003, FIG. 2, 2003) (Ranjard et al. (2003). Environmental Microbiology 5, pp. 1111-1120, incorporated by reference in its entirety for all purposes). The ITS region has significant heterogeneity in both length and nucleotide sequence. The use of a fluorescence-labeled forward primer and an automatic DNA sequencer permits high resolution of separation and high throughput. The inclusion of an internal standard in each sample provides accuracy in sizing general fragments.

In another embodiment, fragment length polymorphism (RFLP) of PCR-amplified rDNA fragments, otherwise known as amplified ribosomal DNA restriction analysis (ARDRA), is used to characterize unique first markers and the abundance of the same in samples (FIG. 1, 1003, FIG. 2, 2003) (for additional detail, see Massol-Deya et al. (1995). Mol. Microb. Ecol. Manual. 3.3.2, pp. 1-18, the entirety of which is herein incorporated by reference for all purposes). rDNA fragments are generated by PCR using general primers, digested with restriction enzymes, electrophoresed in agarose or acrylamide gels, and stained with ethidium bromide or silver nitrate.

One fingerprinting technique used in detecting the presence and abundance of a unique first marker is single-stranded-conformation polymorphism (SSCP) (see Lee et al. (1996). Appl Environ Microbiol 62, pp. 3112-3120; Scheinert et al. (1996). J. Microbiol. Methods 26, pp. 103-117; Schwieger and Tebbe (1998). Appl. Environ. Microbiol. 64, pp. 4870-4876, each of which is incorporated by reference herein in its entirety). In this technique, DNA fragments such as PCR products obtained with primers specific for the 16S rRNA gene, are denatured and directly electrophoresed on a non-denaturing gel. Separation is based on differences in size and in the folded conformation of single-stranded DNA, which influences the electrophoretic mobility. Reannealing of DNA strands during electrophoresis can be prevented by a number of strategies, including the use of one phosphorylated primer in the PCR followed by specific digestion of the phosphorylated strands with lambda exonuclease and the use of one biotinylated primer to perform magnetic separation of one single strand after denaturation. To assess the identity of the predominant populations in a given microbial composition, in one embodiment, bands are excised and sequenced, or SSCP-patterns can be hybridized with specific probes. Electrophoretic conditions, such as gel matrix, temperature, and addition of glycerol to the gel, can influence the separation.

In addition to sequencing based methods, other methods for quantifying expression (e.g., gene, protein expression) of a second marker are amenable for use with the methods provided herein for determining the level of expression of one or more second markers (FIG. 1, 1004; FIG. 2, 2004). For example, quantitative RT-PCR, microarray analysis, linear amplification techniques such as nucleic acid sequence based amplification (NASBA) are all amenable for use with the methods described herein, and can be carried out according to methods known to those of ordinary skill in the art.

In another embodiment, the sample, or a portion thereof is subjected to a quantitative polymerase chain reaction (PCR) for detecting the presence and abundance of a first marker and/or a second marker (FIG. 1, 1003-1004; FIG. 2, 2003-2004). Specific microorganism strains activity is measured by reverse transcription of transcribed ribosomal and/or messenger RNA (rRNA and mRNA) into complementary DNA (cDNA), followed by PCR (RT-PCR).

In another embodiment, the sample, or a portion thereof is subjected to PCR-based fingerprinting techniques to detect the presence and abundance of a first marker and/or a second marker (FIG. 1, 1003-1004; FIG. 2, 2003-2004). PCR products can be separated by electrophoresis based on the nucleotide composition. Sequence variation among the different DNA molecules influences the melting behavior, and therefore molecules with different sequences will stop migrating at different positions in the gel. Thus electrophoretic profiles can be defined by the position and the relative intensity of different bands or peaks and can be translated to numerical data for calculation of diversity indices. Bands can also be excised from the gel and subsequently sequenced to reveal the phylogenetic affiliation of the community members. Electrophoresis methods can include, but are not limited to: denaturing gradient gel electrophoresis (DGGE), temperature gradient gel electrophoresis (TGGE), single-stranded-conformation polymorphism (SSCP), restriction fragment length polymorphism analysis (RFLP) or amplified ribosomal DNA restriction analysis (ARDRA), terminal restriction fragment length polymorphism analysis (T-RFLP), automated ribosomal intergenic spacer analysis (ARISA), randomly amplified polymorphic DNA (RAPD), DNA amplification fingerprinting (DAF) and Bb-PEG electrophoresis.

In another embodiment, the sample, or a portion thereof is subjected to a chip-based platform such as microarray or microfluidics to determine the abundance of a unique first marker and/or presence/abundance of a unique second marker (FIG. 1, 1003-1004, FIG. 2, 2003-2004). The PCR products are amplified from total DNA in the sample and directly hybridized to known molecular probes affixed to microarrays. After the fluorescently labeled PCR amplicons are hybridized to the probes, positive signals are scored by the use of confocal laser scanning microscopy. The microarray technique allows samples to be rapidly evaluated with replication, which is a significant advantage in microbial community analyses. In general the hybridization signal intensity on microarrays can be directly proportional to the abundance of the target organism. The universal high-density 16S microarray (e.g., PHYLOCHIP) contains about 30,000 probes of 16SrRNA gene targeted to several cultured microbial species and "candidate divisions". These probes target all 121 demarcated prokaryotic orders and allow simultaneous detection of 8,741 bacterial and archaeal taxa. Another microarray in use for profiling microbial communities is the Functional Gene Array (FGA). Unlike PHYLOCHIPs, FGAs are designed primarily to detect specific metabolic groups of bacteria. Thus, FGA not only reveal the community structure, but they also shed light on the in situ community metabolic potential. FGA contain probes from genes with known biological functions, so they are useful in linking microbial community composition to ecosystem functions. An FGA termed GEOCHIP contains >24,000 probes from all known metabolic genes involved in various biogeochemical, ecological, and environmental processes such as ammonia oxidation, methane oxidation, and nitrogen fixation.

A protein expression assay, in one embodiment, is used with the methods described herein for determining the level of expression of one or more second markers (FIG. 1, 1004; FIG. 2, 2004). For example, in one embodiment, mass spectrometry or an immunoassay such as an enzyme-linked immunosorbant assay (ELISA) is utilized to quantify the level of expression of one or more unique second markers, wherein the one or more unique second markers is a protein.

In one embodiment, the sample, or a portion thereof is subjected to Bromodeoxyuridine (BrdU) incorporation to determine the level of a second unique marker (FIG. 1, 1004; FIG. 2, 2004). BrdU, a synthetic nucleoside analog of thymidine, can be incorporated into newly synthesized DNA of replicating cells. Antibodies specific for BRdU can then be used for detection of the base analog. Thus BrdU incorporation identifies cells that are actively replicating their DNA, a measure of activity of a microorganism according to one embodiment of the methods described herein. BrdU incorporation can be used in combination with FISH to provide the identity and activity of targeted cells.

In one embodiment, the sample, or a portion thereof is subjected to microautoradiography (MAR) combined with FISH to determine the level of a second unique marker (FIG. 1, 1004; FIG. 2, 2004). MAR-FISH is based on the incorporation of radioactive substrate into cells, detection of the active cells using autoradiography and identification of the cells using FISH. The detection and identification of active cells at single-cell resolution is performed with a microscope. MAR-FISH provides information on total cells, probe targeted cells and the percentage of cells that incorporate a given radiolabelled substance. The method provides an assessment of the in situ function of targeted microorganisms and is an effective approach to study the in vivo physiology of microorganisms. A technique developed for quantification of cell-specific substrate uptake in combination with MAR-FISH is known as quantitative MAR (QMAR).

In one embodiment, the sample, or a portion thereof is subjected to stable isotope Raman spectroscopy combined with FISH (Raman-FISH) to determine the level of a second unique marker (FIG. 1, 1004; FIG. 2, 2004). This technique combines stable isotope probing, Raman spectroscopy and FISH to link metabolic processes with particular organisms. The proportion of stable isotope incorporation by cells affects the light scatter, resulting in measurable peak shifts for labelled cellular components, including protein and mRNA components. Raman spectroscopy can be used to identify whether a cell synthesizes compounds including, but not limited to: oil (such as alkanes), lipids (such as triacylglycerols (TAG)), specific proteins (such as heme proteins, metalloproteins), cytochrome (such as P450, cytochrome c), chlorophyll, chromophores (such as pigments for light harvesting carotenoids and rhodopsins), organic polymers (such as polyhydroxyalkanoates (PHA), polyhydroxybutyrate (PHB)), hopanoids, steroids, starch, sulfide, sulfate and secondary metabolites (such as vitamin B12).

In one embodiment, the sample, or a portion thereof is subjected to DNA/RNA stable isotope probing (SIP) to determine the level of a second unique marker (FIG. 1, 1004; FIG. 2, 2004). SIP enables determination of the microbial diversity associated with specific metabolic pathways and has been generally applied to study microorganisms involved in the utilization of carbon and nitrogen compounds. The substrate of interest is labelled with stable isotopes (such as $^{13}C$ or $^{15}N$) and added to the sample. Only microorganisms able to metabolize the substrate will incorporate it into their cells. Subsequently, $^{13}C$-DNA and $^{15}N$-DNA can be isolated by density gradient centrifugation and used for metagenomic analysis. RNA-based SIP can be a responsive biomarker for use in SIP studies, since RNA itself is a reflection of cellular activity.

In one embodiment, the sample, or a portion thereof is subjected to isotope array to determine the level of a second unique marker (FIG. 1, 1004; FIG. 2, 2004). Isotope arrays allow for functional and phylogenetic screening of active microbial communities in a high-throughput fashion. The technique uses a combination of SIP for monitoring the substrate uptake profiles and microarray technology for determining the taxonomic identities of active microbial communities. Samples are incubated with a $^{14}C$-labeled substrate, which during the course of growth becomes incorporated into microbial biomass. The $^{14}C$-labeled rRNA is separated from unlabeled rRNA and then labeled with fluorochromes. Fluorescent labeled rRNA is hybridized to a phylogenetic microarray followed by scanning for radioactive and fluorescent signals. The technique thus allows simultaneous study of microbial community composition and specific substrate consumption by metabolically active microorganisms of complex microbial communities.

In one embodiment, the sample, or a portion thereof is subjected to a metabolomics assay to determine the level of a second unique marker (FIG. 1, 1004; FIG. 2, 2004). Metabolomics studies the metabolome which represents the collection of all metabolites, the end products of cellular processes, in a biological cell, tissue, organ or organism. This methodology can be used to monitor the presence of microorganisms and/or microbial mediated processes since it allows associating specific metabolite profiles with different microorganisms. Profiles of intracellular and extracellular metabolites associated with microbial activity can be obtained using techniques such as gas chromatography-mass spectrometry (GC-MS). The complex mixture of a metabolomic sample can be separated by such techniques as gas chromatography, high performance liquid chromatography and capillary electrophoresis. Detection of metabolites can be by mass spectrometry, nuclear magnetic resonance (NMR) spectroscopy, ion-mobility spectrometry, electrochemical detection (coupled to HPLC) and radiolabel (when combined with thin-layer chromatography).

According to the embodiments described herein, the presence and respective number of one or more active microorganism strains in a sample are determined (FIG. 1, 1006; FIG. 2, 2006). For example, strain identity information obtained from assaying the number and presence of first markers is analyzed to determine how many occurrences of a unique first marker are present, thereby representing a unique microorganism strain (e.g., by counting the number of sequence reads in a sequencing assay). This value can be represented in one embodiment as a percentage of total sequence reads of the first maker to give a percentage of unique microorganism strains of a particular microorganism type. In a further embodiment, this percentage is multiplied by the number of microorganism types (obtained at step 1002 or 2002, see FIG. 1 and FIG. 2) to give the absolute abundance of the one or more microorganism strains in a sample and a given volume.

The one or more microorganism strains are considered active, as described above, if the level of second unique marker expression is at a threshold level, higher than a threshold value, e.g., higher than at least about 5%, at least about 10%, at least about 20% or at least about 30% over a control level.

In another aspect of the disclosure, a method for determining the absolute abundance of one or more microorganism strains is determined in a plurality of samples (FIG. 2, see in particular, 2007). For a microorganism strain to be classified as active, it need only be active in one of the samples. The samples can be taken over multiple time points from the same source, or can be from different environmental sources (e.g., different animals).

The absolute abundance values over samples are used in one embodiment to relate the one or more active microorganism strains, with an environmental parameter (FIG. 2, 2008). In one embodiment, the environmental parameter is the presence of a second active microorganism strain. Relating the one or more active microorganism strains to the environmental parameter, in one embodiment, is carried out by determining the co-occurrence of the strain and parameter by correlation or by network analysis.

In one embodiment, determining the co-occurrence of one or more active microorganism strains with an environmental parameter comprises a network and/or cluster analysis method to measure connectivity of strains or a strain with an environmental parameter within a network, wherein the network is a collection of two or more samples that share a common or similar environmental parameter. In another embodiment, the network and/or cluster analysis method may be applied to determining the co-occurrence of two or more active microorganism strains in a sample (FIG. 2, 2008). In another embodiment, the network analysis comprises nonparametric approaches including mutual information to establish connectivity between variables. In another embodiment, the network analysis comprises linkage analysis, modularity analysis, robustness measures, betweenness measures, connectivity measures, transitivity measures, centrality measures or a combination thereof (FIG. 2, 2009). In another embodiment, the cluster analysis method comprises building a connectivity model, subspace model, distribution model, density model, or a centroid model and/or using community detection algorithms such as the Louvain, Bron-Kerbosch, Girvan-Newman, Clauset-Newman-Moore, Pons-Latapy, and Wakita-Tsurumi algorithms (FIG. 2, 2010).

In one embodiment, the cluster analysis method is a heuristic method based on modularity optimization. In a further embodiment, the cluster analysis method is the Louvain method (See, e.g., the method described by Blondel et al. (2008) Fast unfolding of communities in large networks. Journal of Statistical Mechanics: Theory and Experiment, Volume 2008, October 2008, incorporated by reference herein in its entirety for all purposes).

In another embodiment, the network analysis comprises predictive modeling of network through link mining and prediction, collective classification, link-based clustering, relational similarity, or a combination thereof. In another embodiment, the network analysis comprises differential equation based modeling of populations. In another embodiment, the network analysis comprises Lotka-Volterra modeling.

In one embodiment, relating the one or more active microorganism strains to an environmental parameter (e.g., determining the co-occurrence) in the sample comprises creating matrices populated with linkages denoting environmental parameter and microorganism strain associations.

In one embodiment, the multiple sample data obtained at step 2007 (e.g., over two or more samples which can be collected at two or more time points where each time point corresponds to an individual sample) is compiled. In a further embodiment, the number of cells of each of the one or more microorganism strains in each sample is stored in an association matrix (which can be in some embodiments, an abundance matrix). In one embodiment, the association matrix is used to identify associations between active microorganism strains in a specific time point sample using rule mining approaches weighted with association (e.g., abundance) data. Filters are applied in one embodiment to remove insignificant rules.

In one embodiment, the absolute abundance of one or more, or two or more active microorganism strains is related to one or more environmental parameters (FIG. 2, 2008), e.g., via co-occurrence determination. Environmental parameters are chosen by the user depending on the sample(s) to be analyzed and are not restricted by the methods described herein. The environmental parameter can be a parameter of the sample itself, e.g., pH, temperature, amount of protein in the sample. Alternatively, the environmental parameter is a parameter that affects a change in the identity of a microbial community (i.e., where the "identity" of a microbial community is characterized by the type of microorganism strains and/or number of particular microorganism strains in a community), or is affected by a change in the identity of a microbial community. For example, an environmental parameter in one embodiment, is the food intake of an animal. In one embodiment, the environmental parameter is the presence, activity and/or abundance of a second microorganism strain in the microbial community, present in the same sample.

In some embodiments described herein, an environmental parameter is referred to as a metadata parameter.

Other examples of metadata parameters include but are not limited to genetic information from the host from which the sample was obtained (e.g., DNA mutation information), sample pH, sample temperature, expression of a particular protein or mRNA, nutrient conditions (e.g., level and/or identity of one or more nutrients) of the surrounding environment/ecosystem), susceptibility or resistance to disease, onset or progression of disease, susceptibility or resistance of the sample to toxins, efficacy of xenobiotic compounds (pharmaceutical drugs), biosynthesis of natural products, or a combination thereof.

For example, according to one embodiment, microorganism strain number changes are calculated over multiple samples according to the method of FIG. 2 (i.e., at 2001-2007). Strain number changes of one or more active strains over time is compiled (e.g., one or more strains that have initially been identified as active according to step 2006), and the directionality of change is noted (i.e., negative values denoting decreases, positive values denoting increases). The number of cells over time is represented as a network, with microorganism strains representing nodes and the abundance weighted rules representing edges. Markov chains and random walks are leveraged to determine connectivity between nodes and to define clusters. Clusters in one embodiment are filtered using metadata in order to identify clusters associated with desirable metadata (FIG. 2, 2008).

In a further embodiment, microorganism strains are ranked according to importance by integrating cell number changes over time and strains present in target clusters, with the highest changes in cell number ranking the highest.

Network Analysis

Network and/or cluster analysis method in one embodiment, is used to measure connectivity of the one or more strains within a network, wherein the network is a collection of two or more samples that share a common or similar environmental parameter. In one embodiment, network analysis comprises linkage analysis, modularity analysis, robustness measures, betweenness measures, connectivity measures, transitivity measures, centrality measures or a combination thereof. In another embodiment, network analysis comprises predictive modeling of network through link mining and prediction, social network theory, collective classification, link-based clustering, relational similarity, or a combination thereof. In another embodiment, network analysis comprises differential equation based modeling of populations. In yet another embodiment, network analysis comprises Lotka-Volterra modeling.

Cluster analysis method comprises building a connectivity model, subspace model, distribution model, density model, or a centroid model.

Network and cluster based analysis, for example, to carry out method step 2008 of FIG. 2, can be carried out via a module. As used herein, a component and/or module can be, for example, any assembly, instructions and/or set of operatively-coupled electrical components, and can include, for example, a memory, a processor, electrical traces, optical connectors, software (executing in hardware) and/or the like.

Cattle Pathogen Resistance and Clearance

In some aspects, the present disclosure is drawn to administering one or more microbial compositions described herein to beef cattle to clear the gastrointestinal tract of pathogenic microbes. In some embodiments, the present disclosure is further drawn to administering microbial compositions described herein to prevent colonization of pathogenic microbes in the gastrointestinal tract. In some embodiments, the administration of microbial compositions described herein further clear pathogens from the integument and the respiratory tract of beef cattle, and/or prevent colonization of pathogens on the integument and in the respiratory tract. In some embodiments, the administration of microbial compositions described herein reduce leaky gut/intestinal permeability, levels of histamine, production of lipopolysaccharides (LPS), inflammation, ketosis, laminitis, respiratory and metabolic acidosis, rumen acidosis, bloat, abomasal dysplasia, liver abscesses, and/or incidence of liver disease.

In some embodiments, the microbial compositions of the present disclosure comprise one or more microbes that are present in the gastrointestinal tract of beef cattle at a relative abundance of less than 15%, 14%, 13%, 12%, 11%, 10%, 9%, 8%, 7%, 6%, 5%, 4%, 3%, 2%, 1%, 0.5%, 0.1%, or 0.01%.

In some embodiments, after administration of microbial compositions of the present disclosure the one or more microbes are present in the gastrointestinal tract of the beef cattle at a relative abundance of at least 0.5%, 1%, 5%, 10%, 15%, 20%, 25%, 30%, 35%, 40%, 45%, 50%, 55%, 60%, 65%, 70%, 75%, 80%, 85%, 90%, or 95%.

Pathogenic microbes of beef cattle include the following: *Clostridium perfringens, Clostridium botulinum, Salmonella typi, Salmonella typhimurium, Salmonella enterica, Salmonella pullorum, Erysipelothrix insidiosa, Campylobacter jejuni, Campylobacter coli, Campylobacter lari, Listeria monocytogenes, Streptococcus agalactiae, Streptococcus dysgalactiae, Corynebacterium bovis, Mycoplasma* sp., *Citrobacter* sp., *Enterobacter* sp., *Pseudomonas aeruginosa, Pasteurella* sp., *Bacillus cereus, Bacillus licheniformis, Streptococcus uberis, Staphylococcus aureus,* and pathogenic strains of enteropathogenic, enteroinvasive, or enterohemorrhagic *Escherichia coli, Staphylococcus aureus, Pasteurella multocida, Mannheimia haemolytica, Histophilus somni, Mycoplasma bovis,* and *Aspergillus* sp.

In some embodiments, the pathogenic microbes include viral pathogens. In some embodiments, the pathogenic microbes are pathogenic to both beef cattle and humans. In some embodiments, the pathogenic microbes are pathogenic to either beef cattle or humans.

In some embodiments, the administration of compositions of the present disclosure to beef cattle modulate the makeup of the gastrointestinal microbiome such that the administered microbes outcompete microbial pathogens present in the gastrointestinal tract. In some embodiments, the administration of compositions of the present disclosure to beef cattle harboring microbial pathogens outcompetes the pathogens and clears the beef cattle of the pathogens. In some embodiments, the administration of compositions of the present disclosure stimulate host immunity, and aids in clearance of the microbial pathogens. In some embodiments, the administration of compositions of the present disclosure introduce microbes that produce bacteriostatic and/or bactericidal components that decrease or clear the beef cattle of the microbial pathogens. (U.S. Pat. No. 8,345,010).

In some embodiments, challenging beef cattle with a microbial colonizer or microbial pathogen after administering one or more compositions of the present disclosure prevents the microbial colonizer or microbial pathogen from growing to a relative abundance of greater than 15%, 14%, 13%, 12%, 11%, 10%, 9%, 8%, 7%, 6%, 5%, 4%, 3%, 2%, 1%, 0.5%, 0.1%, or 0.01%. In further embodiments, challenging beef cattle with a microbial colonizer or microbial pathogen after administering one or more compositions of the present disclosure prevents the microbial colonizer or microbial pathogen from colonizing beef cattle.

In some embodiments, clearance of the microbial colonizer or microbial pathogen occurs in less than 25 days, less than 24 days, less than 23 days, less than 22 days, less than 21 days, less than 20 days, less than 19 days, less than 18 days, less than 17 days, less than 16 days, less than 15 days, less than 14 days, less than 13 days, less than 12 days, less than 11 days, less than 10 days, less than 9 days, less than 8 days, less than 7 days, less than 6 days, less than 5 days, less than 4 days, less than 3 days, or less than 2 days post administration of the one or more compositions of the present disclosure.

In some embodiments, clearance of the microbial colonizer or microbial pathogen occurs within 1-30 days, 1-25 days, 1-20 day, 1-15 days, 1-10 days, 1-5 days, 5-30 days, 5-25 days, 5-20 days, 5-15 days, 5-10 days, 10-30 days, 10-25 days, 10-20 days, 10-15 days, 15-30 days, 15-25 days, 15-20 days, 20-30 days, 20-25 days, or 25-30 days post administration of the one or more compositions of the present disclosure.

Improved Traits

Figure 3:
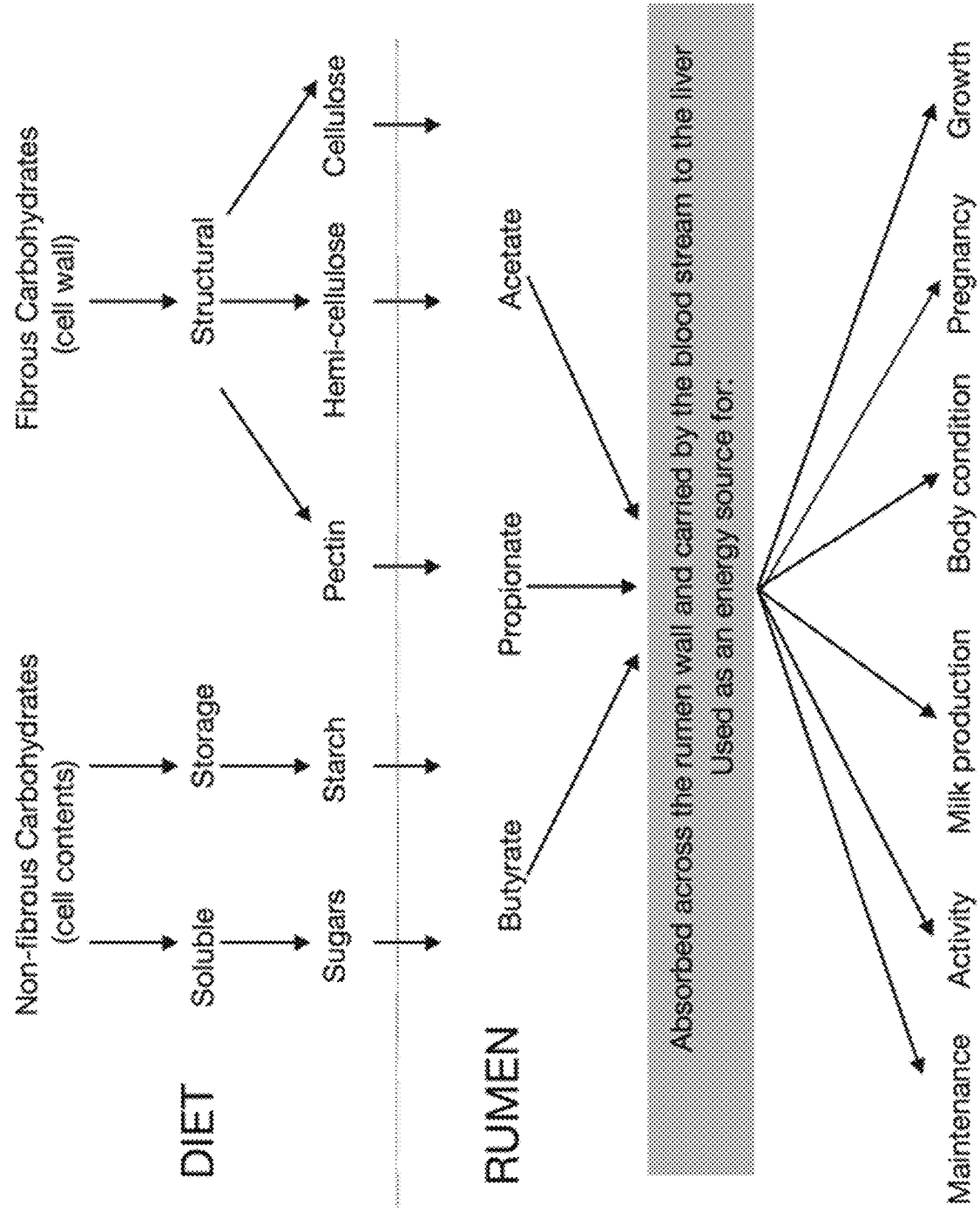
FIG. 3 depicts a diagram that exemplifies how the diet influences the production of volatile fatty acids which in turn modulate milk production, body condition, growth, etc. Reproduced from Moran, 2005. Tropical dairy farming: feeding management for small holder dairy farmers in the humic tropics (Chapter 5), Landlinks Press, 312 pp.

The rumen is a specialized stomach dedicated to the digestion of feed components in ruminants. A diverse microbial population inhabits the rumen, where their primary function revolves around converting the fibrous and non-fibrous carbohydrate components into useable sources of energy and protein (FIG. 3). Cellulose, in particular, forms up to 40% of plant biomass and is considered indigestible by mammals. It also is tightly associated with other structural carbohydrates, including hemicellulose, pectin, and lignin. The cellulolytic microbes in the rumen leverage extensive enzymatic activity in order break these molecules down into simple sugars and volatile fatty acids. This enzymatic activity is critical to the extraction of energy from feed, and more efficient degradation ultimately provides more energy to the animal. The soluble sugars found in the non-fibrous portion of the feed are also fermented into gases and volatile fatty acids such as butyrate, propionate, and acetate. Volatile fatty acids arising from the digestion of both the fibrous and non-fibrous components of feed are ultimately the main source of energy of the ruminant.

In some aspects, the present disclosure is drawn to administering microbial compositions described herein to beef cattle to improve one or more traits through the modulation of aspects of weight, musculature, digestive chemistry, efficiency of feed utilization and digestibility, fecal output, prevention of colonization of pathogenic microbes, and clearance of pathogenic microbes.

In some embodiments, the at least one improved trait is selected from the group consisting of: an increase in weight; an increase of musculature; an increase of fatty acid concentration in the gastrointestinal tract; an increase of fatty acid production in the gastrointestinal tract; an increase of fatty acid concentration in the rumen; a decrease in lactate concentration in the rumen; an improved efficiency in feed utilization and digestibility; an improved feed efficiency; an improved average daily weight gain; an increased final body weight; an improved dry matter intake; an increase in polysaccharide and lignin degradation; an increase in fat, starch, and/or protein digestion; an increase in fatty acid concentration in the rumen; pH balance in the rumen, an increase in vitamin availability; an increase in mineral availability; an increase in amino acid availability; an increase in milk production, a reduction in methane and/or nitrous oxide emissions; a reduction in manure production; an improved efficiency of nitrogen utilization; an improved efficiency of phosphorous utilization; an increased resistance to colonization of pathogenic microbes that colonize cattle; reduced mortality; increased production of antimicrobials; increased clearance of pathogenic microbes; increased resistance to colonization of pathogenic microbes that colonize cattle; increased resistance to colonization of pathogenic microbes that infect humans; and any combination thereof; reduced incidence and/or prevalence of acidosis or bloat; reduced incidence of abomasal dysplasia; reduced body temperature; reduction in the concentration of $CO_2$ (dissolved or otherwise) in the rumen; increase in $CO_2$ fixation; reduction in microbial methanogenic populations; increase in $CO_2$ fixing microbes; increasing the concentration of B vitamins in the rumen; an increase in mammalian and/or microbial synthesis of vitamins; reducing alpha diversity of the microbiome residing in the rumen; reducing histamine and LPS production; reducing leaky gut and permeability of the gastrointestinal lining; reduction in respiratory and metabolic acidosis; reduction in laminitis; reduction in ketosis; reduction of the incidence of liver disease and/or liver abscesses; reducing lactate concentrations in the rumen; increasing degradation of lactate in the rumen; increasing microbial lactate-degrading populations; wherein said increase or reduction is determined by comparing against an animal not having been administered said composition.

In some embodiments, the [$CO_2$] (dissolved or otherwise) is reduced by at least 0.5%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 30%, 35%, 40%, 45%, 50%, 55%, 60%, 65%, 70%, 75%, 80%, 85%, 90%, 95%, or 100% relative to an animal not having been administered a composition of the present disclosure.

In some embodiments, the [$CO_2$] (dissolved or otherwise) in the rumen is reduced by at least 0.5%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 30%, 35%, 40%, 45%, 50%, 55%, 60%, 65%, 70%, 75%, 80%, 85%, 90%, 95%, or 100% relative to an animal not having been administered a composition of the present disclosure.

In some embodiments, the ruminal pH is increased by at least 0.5%, 1% 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 30%, 35%, 40%, 45%, 50%, 55%, 60%, 65%, 70%, 75%, 80%, 85%, 90%, 95%, or 100% relative to an animal not having been administered a composition of the present disclosure.

In some embodiments, the ruminal pH has an increased buffering capacity by at least 0.5%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 30%, 35%, 40%, 45%, 50%, 55%, 60%, 65%, 70%, 75%, 80%, 85%, 90%, 95%, or 100% relative to an animal not having been administered a composition of the present disclosure.

In some embodiments, the [carbonic acid] is reduced by at least 0.5%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 30%, 35%, 40%, 45%, 50%, 55%, 60%, 65%, 70%, 75%, 80%, 85%, 90%, 95%, or 100% relative to an animal not having been administered a composition of the present disclosure.

In some embodiments, the [carbonic acid] in the rumen is reduced by at least 0.5%, 1%, 2%, 3%, 4%, 5%, 6%, 7%, 8%, 9%, 10%, 11%, 12%, 13%, 14%, 15%, 16%, 17%, 19%, 20%, 21%, 22%, 23%, 24%, 25%, 30%, 35%, 40%, 45%, 50%, 55%, 60%, 65%, 70%, 75%, 80%, 85%, 90%, 95%, or 100% relative to an animal not having been administered a composition of the present disclosure.

In some embodiments, the fecal output is reduced by at least 0.5%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 30%, 35%, 40%, 45%, 50%, 55%, 60%, 65%, 70%, 75%, 80%, 85%, 90%, 95%, or 100% relative to an animal not having been administered a composition of the present disclosure. In some embodiments, the fecal output is reduced by less than 0.5%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 30%, 35%, 40%, 45%, 50%, 55%, 60%, 65%, 70%, 75%, 80%, 85%, 90%, 95%, or 100% relative to an animal not having been administered a composition of the present disclosure.

In some embodiments, the incidence of liver disease or liver abscesses is reduced by at least 0.5%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 30%, 35%, 40%, 45%, 50%, 55%, 60%, 65%, 70%, 75%, 80%, 85%, 90%, 95%, or 100% relative to an animal not having been administered a composition of the present disclosure.

In some embodiments, the incidence of bloat is reduced by at least 0.5%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 30%, 35%, 40%, 45%, 50%, 55%, 60%, 65%, 70%, 75%, 80%, 85%, 90%, 95%, or 100% relative to an animal not having been administered a composition of the present disclosure.

In some embodiments, the synthesis of one or more volatile fatty acids is increased by at least 0.5%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 30%, 35%, 40%, 45%, 50%, 55%, 60%, 65%, 70%, 75%, 80%, 85%, 90%, 95%, or 100% relative to an animal not having been administered a composition of the present disclosure.

In some embodiments, the final body weight of the animals is increased by at least 0.5%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 30%, 35%, 40%, 45%, 50%, 55%, 60%, 65%, 70%, 75%, 80%, 85%, 90%, 95%, or 100% relative to an animal not having been administered a composition of the present disclosure.

In some embodiments, the rate of weight gain of the animals is increased by at least 0.5%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 30%, 35%, 40%, 45%, 50%, 55%, 60%, 65%, 70%, 75%, 80%, 85%, 90%, 95%, or 100% relative to an animal not having been administered a composition of the present disclosure.

In some embodiments, the lipopolysaccharide production in the animals is decreased by at least 0.5%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 30%, 35%, 40%, 45%, 50%, 55%, 60%, 65%, 70%, 75%, 80%, 85%, 90%, 95%, or 100% relative to an animal not having been administered a composition of the present disclosure.

In some embodiments, improving the efficiency and digestibility of animal feed is desirable. In some embodiments, increasing the degradation of lignocellulosic components from animal feed is desirable. Lignocellulosic components include lignin, cellulose, and hemicellulose.

In some embodiments, increasing the concentration of fatty acids in the gastrointestinal tract is desirable. Fatty acids include acetic acid, propionic acid, and butyric acid. In some embodiments, maintaining the pH balance in the gastrointestinal tract to prevent destruction of beneficial microbial compositions is desirable.

In some embodiments, decreasing the amount of methane and manure produced by beef cattle is desirable In some embodiments, a decrease in the amount of total manure produced is desirable. In further embodiments, a decrease in the total amount of phosphorous and/or nitrogen in the total manure produced is desirable.

In some embodiments, improving the dry matter intake is desirable. In some embodiments, improving the feed intake is desirable. In some embodiments, improving the efficiency of nitrogen utilization of the feed and/or dry matter ingested by beef cattle is desirable.

In some embodiments, the improved traits of the present disclosure are the result of the administration of the presently described microbial compositions. It is thought that the microbial compositions modulate the microbiome of beef cattle such that the biochemistry of the rumen is changed in such a way that the gastrointestinal liquid and solid substratum are more efficiently and more completely degraded into subcomponents and metabolites than the gastrointestinal tract of beef cattle not having been administered microbial compositions of the present disclosure.

In some embodiments, the increase in efficiency and the increase of degradation of the gastrointestinal substratum result in an increase in improved traits of the present disclosure.

In some embodiments, the administration of one or more compositions of the present disclosure result in an improved feed efficiency of grain intensive and/or energy intensive diets. In some embodiments, the improved feed efficiency measured as a decrease in the amount/volume of feces while maintaining or increasing the intake of the feed. In further embodiments, the grain intensive diet is that which contains 100%, 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, 75%, 74%, 73%, 72%, 71%, 70%, 69%, 68%, 67%, 65%, 64%, 63%, 62%, 61%, 60%, 59%, 58%, 57%, 56%, 55%, 54%, 53%, 52%, 51%, 50%, 49%, 48%, 47%, 46%, 45%, 44%, 43%, 42%, 41%, or 40% grains.

In some embodiments, the administration of one or more compositions of the present disclosure result in an improved feed efficiency in the presence or absence of antibiotic agents.

In some embodiments, the administration of one or more compositions of the present disclosure result in an increase in the average daily weight gain of ruminants, as compared to those not having been administered the one or more compositions.

In some embodiments, the administration of one or more compositions of the present disclosure result in an increase in the dry matter intake of ruminants, as compared to those not having been administered the one or more compositions.

In some embodiments, the administration of one or more compositions of the present disclosure result in a reduced incidence and/or prevalence of acidosis or bloat in ruminants, as compared to those not having been administered the one or more compositions.

In some embodiments, the administration of one or more compositions of the present disclosure result in a reduced body temperature in ruminants, as compared to those not having been administered the one or more compositions. In further embodiments, the reduction in temperature is at least 0.2° F., at least 0.4° F., at least 0.6° F., at least 0.8° F., at least 1° F., at least 1.2° F., at least 1.4° F., at least 1.6° F., at least 1.8° F., at least 2° F., at least 2.2° F., at least 2.4° F., at least 2.6° F., at least 2.8° F., at least 3° F., at least 3.2° F., at least 3.4° F., at least 3.6° F., at least 3.8° F., at least 4° F., at least 4.2° F., at least 4.4° F., at least 4.6° F., at least 4.8° F., at least 5° F., at least 5.2° F., at least 5.4° F., at least 5.6° F., at least 5.8° F., or at least 6° F.

In further embodiments, the reduction in temperature is at about 0.2° F., about 0.4° F., about 0.6° F., about 0.8° F., about 1° F., about 1.2° F., about 1.4° F., about 1.6° F., about 1.8° F., about 2° F., about 2.2° F., about 2.4° F., about 2.6° F., about 2.8° F., about 3° F., about 3.2° F., about 3.4° F., about 3.6° F., about 3.8° F., about 4° F., about 4.2° F., about 4.4° F., about 4.6° F., about 4.8° F., about 5° F., about 5.2° F., about 5.4° F., about 5.6° F., about 5.8° F., or about 6° F.

In some embodiments, the administration of one or more compositions of the present disclosure result in an increase in the quality grade of the resulting beef, as set forth by the USDA Beef Quality and Yield Grades. In further embodiments, the increase in the quality grade is an increase or upgrade to USDA Prime, USDA Choice, or USDA Select quality grades, as compared to those not having been administered the one or more compositions. In some embodiments, the increase in the quality grade is an increase in the amount of meat per ruminant that is labelled as USDA Prime, USDA Choice, or USDA Select.

In some embodiments, the administration of one or more compositions of the present disclosure result in an increase in the amount of marbling (intramuscular fat) in the resulting meat of the ruminants. In further embodiments, the increase in the amount of marbling is an increase in marbling grade to Prime$^+$, Prime$^°$, Prime$^-$, Choice$^+$, Choice$^°$, Choice$^-$, Select$^+$, Select$^-$, Standard$^+$, Standard$^°$, Standard$^-$, as compared to those not having been administered the one or more compositions.

In some embodiments, the administration of one of more compositions of the present disclosure result in an increase or decrease in the red color of the resulting meat from the ruminant. In some embodiments, the increase in the red color of the meat is an increase to light cherry red to slightly dark red, moderately light red to moderately dark red, moderately dark red to dark red, dark red to very dark red, as compared to those not having been administered the one or more compositions. In some embodiments, the decrease in the red color of the meat is a decrease to light cherry red, light cherry red to slightly dark red, moderately light red to moderately dark red, or moderately dark red to dark red, as compared to those not having been administered the one or more compositions.

In some embodiments, the administration of one or more compositions of the present disclosure result in an increase or decrease in the texture of the resulting meat from the ruminant. In some embodiments, the decrease in the texture is from coarse to slightly coarse, moderately fine, fine, or very fine, as compared to those not having been administered the one or more compositions. In some embodiments, the increase in the texture is very fine, fine, moderately fine, slightly coarse, or coarse.

In some embodiments, the administration of one or more compositions of the present disclosure result in an increase or decrease in the concentration and/or amount of the following volatile components which are known to modulate the flavor and/or aroma of the resulting meat from the ruminants: pentanal, hexanal, heptanal, nonanal, methional, 12-methyltridecanal, nona-2(E)-enal, deca-2(E),4(E)-dienal, butanoic acid, hexanoic acid, delta-nonalactone, decan-2-one, 3-hydroxy-2-butanone, 2,3-octanedione, 1-octene-3-ol, 2-pentyl furan, 2-methyl-3-[methylthio]furan, 4-hydroxy-5-methyl-3(2H)-furanone (HMF), methylpyrazine,2,5-dimethylpyrazine, methylpyrazine,2,6-dimethylpyrazine, pyrazines, glycine, alanine, lysine, cysteine, methionine, glutamine, succinic acid, lactic acid, inosinic acid, orthophosphoric acid, pyrrolidone carboxylic acid, glucose, fructose, ribose, aspartic acid, histidine, asparagine, pyrrolidone carboxylic, carnosine, anserine, hypoxanthine, arginine, leucine, tryptophan, monosodium glutamate (MSG), inosine monophosphate (IMP), guanosine monophosphate (GMP), bis(2-methyl-3-furyl) disulfide, and 2-methyl-3-furanthiol.

In some embodiments, the increase of any one or more of the traits of the present disclosure is an increase of about 0.1%, about 0.2%, about 0.3%, about 0.4%, about 0.5%, about 0.6%, about 0.7%, about 0.8%, about 0.9%, about 1%, about 2%, about 3%, about 4%, about 5%, about 6%, about 7%, about 8%, about 9%, about 10%, about 11%, about 12%, about 13%, about 14%, about 15%, about 16%, about 17%, about 18%, about 19%, about 20%, about 21%, about 22%, about 23%, about 24%, about 25%, about 26%, about 27%, about 28%, about 29%, about 30%, about 31%, about 32%, about 33%, about 34%, about 35%, about 36%, about 37%, about 38%, about 39%, about 40%, about 41%, about 42%, about 43%, about 44%, about 45%, about 46%, about 47%, about 48%, about 49%, about 50%, about 51%, about 52%, about 53%, about 54%, about 55%, about 56%, about 57%, about 58%, about 59%, about 60%, about 61%, about 62%, about 63%, about 64%, about 65%, about 66%, about 67%, about 68%, about 69%, about 70%, about 71%, about 72%, about 73%, about 74%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% relative to an animal not having been administered one or more microbial compositions of the present disclosure.

In some embodiments, the increase of any one or more of the traits of the present disclosure is an increase of at least 0.1%, at least 0.2%, at least 0.3%, at least 0.4%, at least 0.5%, at least 0.6%, at least 0.7%, at least 0.8%, at least 0.9%, at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 26%, at least 27%, at least 28%, at least 29%, at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or at least 100% relative to an animal not having been administered one or more microbial compositions of the present disclosure.

In some embodiments, the decrease of any one or more of the traits of the present disclosure is a decrease of about 0.1%, about 0.2%, about 0.3%, about 0.4%, about 0.5%, about 0.6%, about 0.7%, about 0.8%, about 0.9%, about 1%, about 2%, about 3%, about 4%, about 5%, about 6%, about 7%, about 8%, about 9%, about 10%, about 11%, about 12%, about 13%, about 14%, about 15%, about 16%, about 17%, about 18%, about 19%, about 20%, about 21%, about 22%, about 23%, about 24%, about 25%, about 26%, about 27%, about 28%, about 29%, about 30%, about 31%, about 32%, about 33%, about 34%, about 35%, about 36%, about 37%, about 38%, about 39%, about 40%, about 41%, about 42%, about 43%, about 44%, about 45%, about 46%, about 47%, about 48%, about 49%, about 50%, about 51%, about 52%, about 53%, about 54%, about 55%, about 56%, about 57%, about 58%, about 59%, about 60%, about 61%, about 62%, about 63%, about 64%, about 65%, about 66%, about 67%, about 68%, about 69%, about 70%, about 71%, about 72%, about 73%, about 74%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% relative to an animal not having been administered one or more microbial compositions of the present disclosure.

In some embodiments, the decrease of any one or more of the traits of the present disclosure is a decrease of at least 0.1%, at least 0.2%, at least 0.3%, at least 0.4%, at least 0.5%, at least 0.6%, at least 0.7%, at least 0.8%, at least 0.9%, at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 26%, at least 27%, at least 28%, at least 29%, at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or at least 100% relative to an animal not having been administered one or more microbial compositions of the present disclosure.

Network Analysis

A network and/or cluster analysis method, in one embodiment, is used to measure connectivity of the one or more strains within a network, wherein the network is a collection of two or more samples that share a common or similar environmental parameter. In one embodiment, network analysis comprises linkage analysis, modularity analysis, robustness measures, betweenness measures, connectivity measures, transitivity measures, centrality measures or a combination thereof. In another embodiment, network analysis comprises predictive modeling of network through link mining and prediction, social network theory, collective classification, link-based clustering, relational similarity, or a combination thereof. In another embodiment, network analysis comprises mutual information, maximal information coefficient (MIC) calculations, or other nonparametric methods between variables to establish connectivity. In another embodiment, network analysis comprises differential equation based modeling of populations. In yet another embodiment, network analysis comprises Lotka-Volterra modeling.

The environmental parameter can be a parameter of the sample itself, e.g., pH, temperature, amount of protein in the sample. Alternatively, the environmental parameter is a parameter that affects a change in the identity of a microbial community (i.e., where the "identity" of a microbial community is characterized by the type of microorganism strains and/or number of particular microorganism strains in a community), or is affected by a change in the identity of a microbial community. For example, an environmental parameter in one embodiment, is the food intake of an animal. In one embodiment, the environmental parameter is the presence, activity and/or abundance of a second microorganism strain in the microbial community, present in the same sample. In some embodiments, an environmental parameter is referred to as a metadata parameter.

Other examples of metadata parameters include but are not limited to genetic information from the host from which the sample was obtained (e.g., DNA mutation information), sample pH, sample temperature, expression of a particular protein or mRNA, nutrient conditions (e.g., level and/or identity of one or more nutrients) of the surrounding environment/ecosystem), susceptibility or resistance to disease, onset or progression of disease, susceptibility or resistance of the sample to toxins, efficacy of xenobiotic compounds (pharmaceutical drugs), biosynthesis of natural products, or a combination thereof.

Diagnostics

In some embodiments, a sample (serum, fecal, rumen, tissue, blood, etc.) is collected from a ruminant. In some embodiments, the sample is assayed for the presence and/or quantity of one or more chemical substances. In some embodiments the presence or absence of the one or more chemical substances are diagnostic of a desirable trait described in the present disclosure.

In some embodiments, the one or more chemical substances may be selected from pantothenate, homocysteine, glutamine, carnitine, D-gluconate, hypoxanthine, orotate, succinate, methylmalonate, aconitate, 2-hydroxy-2-methyl succinate, allantoin, homocysteic acid, homocysteine, citrate, isocitrate, and cytosine.

In some embodiments, the increase of any one of the following chemical substances in the blood or blood serum at greater than 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3. 2.4, 2.5, 2.6, 2.7, 2.8, 2.9, 3.0, 3.1, 3.2, 3.3, 3.4, 3.5, 3.6, 3.7, 3.8, 3.9 or 4.0 fold is predictive of the rumen bacterial community composition comprising bacteria from class Flavobacteriia.

In some embodiments, the increase of at least 0.7 fold of pantothenate in the blood or blood serum is predictive of the rumen bacterial community composition comprising a higher proportion of bacteria from class Flavobacteriia.

In some embodiments, the increase of at least 0.7 fold of pantothenate in the blood or blood serum is predictive of the animal having a low residual feed intake (RFI), as compared to an animal without at least a 0.7 fold increase of pantothenate.

In some embodiments, the present disclosure is drawn to a method of determining the RFI of an animal. In some embodiments, the method comprises collecting a first sample of blood or blood serum at a first time point and collecting a second sample of blood or blood serum at a second time point, assaying the samples for the presence and concentration of pantothenate in the blood or blood serum, wherein the animal is indicated to possess low RFI if the pantothenate exhibits a fold increase of at least 0.7 between the first sample and the second sample.

EXAMPLES

Example I. Determination of Feed Efficiency in Beef Cattle

The objective of the study was to document and quantify the feed efficiency of steers fed finishing diets.

A total of 50 steers were adjusted to trial rations during a pretest adjustment period of at least 15 days. This initial adjustment period enabled the animals to acclimate to the GROWSAFE (model 4000E, GrowSafe Systems Ltd., Airdrie, AB, Canada) feeding units and test rations. Steers were fed a step up diet for approximately 21 days before receiving a high concentrate finishing diet, as presented below. Rumensin was added to the finishing diet at a rate of 96 mg/hd/d. At the end of the first period, a 60 day trial was conducted with a minimum of 50 steers for which RFI was determined using the GROWSAFE feed intake system. Residual feed intakes for steers was ranked together, and animals were classified as low RFI (highly efficient), mid RFI, or high RFI (lowly efficient) by dividing them in thirds. From this classification, the low and high RFI steers were selected for further study.

TABLE 10

Finishing diet defined by crude protein (CP), total digestible nutrients (TDN), and dry matter (DM).

|  | CP (%) | TDN (%) | % of diet (DM) |
| --- | --- | --- | --- |
| Corn | 9.00 | 87.60 | 75.00 |
| *Sorghum* Sudan Hay | 8.33 | 54.00 | 15.00 |
| 44% CP Supplement | 44.00 | 73.00 | 10.00 |

-Total Diet Nutrient Composition: 12.4% CP, 81.1% TDN. Rumensin was added at a rate of 96 mg/hd/d Example II. Characterization of Microbial Communities of Steers that Differ in RFI On day 1 and weekly throughout a 60 trial period, rumen content samples were collected via esophageal tubing. The rumen content was collected while the steer was in a chute by passing the tubing through a Frick speculum placed in the mouth and a rubber bulb was manipulated to provide a suction once the tube was in the rumen to collect three rumen samples. A first sample consisted of 20 ml of rumen content. A second sample consisted of rumen content that was added to a 15 ml conical tube prefilled with stabilization solution and stored at 4° C. immediately after. The conical tube was filled to the top with rumen content. A third sample consisted of 20 ml of rumen content that was added to a conical tube prefilled with stop solution. After adding the rumen content to the stop solution, the solution was mixed via inversion several times and stored at 4° C. immediately after. Samples 2 and 3 were shipped to Ascus overnight on ice the day of or the day following sample collection. In addition, up to 10 ml of venous blood was collected directly after rumen content collection.

Immediately after rumen sampling, rumen pH was measured using an electronic pH meter. Subsamples were frozen to stop microbial fermentation and stored at −20° C. for subsequent volatile fatty acids (acetate, propionate, butyrate, isobutyrate, and valerate) analyses. Ammonia-nitrogen (NH3-N) was analyzed according to the colorimetric technique described by Chaney and Marbach (1962. Clin. Chem. 8(2):130-132). Flash frozen (liquid nitrogen and storage at −80° C.) and live rumen content samples were utilized to determine the abundances of bacterial species utilizing next-generation sequencing of the 16S rRNA, 16S rDNA, and/or ITS sequences on the Illumina MiSeq sequencing platform (Illumina, Inc., San Diego, Calif.). Body weight, dry matter intake, and average daily gain for each animal was also measured at the time of rumen sampling.

Example III. Dynamics Mediating Feed Efficiency in Cattle

Rumen microbes produce metabolites that are released into the rumen lumen and can be absorbed through the rumen epithelium or through the epithelium in the lower gastrointestinal tract. (See Hungate. The Rumen and Its Microbes, Elsevier. 1966.). The rumen microbes are responsible for the production of approximately 70% of the energy supply to the ruminant, including production of organic acids such as acetate and propionate. (See Seymour et al. Animal Feed Sci. Tech. 2005. 119:155-169). Differences in the production of these metabolites as well as variation in rate and quantity of absorption can contribute to divergences in nutrient utilization and efficiency of the ruminants, and may lead to physiological or phenotypic changes. (See Huntington. Reproduction Nutrition Development. 1990. 30:35-47; Okine and Mathison. Journal of Animal Science. 1991. 69:3435-3445). However, it can be difficult to distinguish the origin of many metabolites between those of endogenous origin and metabolites of microbial origin. Although associations between the rumen microbiome and physiological changes in the host have been identified, it has yet to be determined the mechanisms driving these changes and whether foundational, or keystone, species are responsible for the divergences in feed efficiency and other phenotypes. (See Hungate. The Rumen Microbial Ecosystem. Annual Review of Ecology and Systematics. 1975. 39-66).

In order to address these critical knowledge gaps, a combination of microbial genomics, metabolomics, and bioinformatics were utilized to further define variations in feed efficiency as determined by the divergences in residual feed intake (RFI). Determination of the complex associations and networks between the rumen microbiome, host metabolome, and differences in host phenotype can be facilitated by novel utilization of bioinformatics and machine learning to discover physiological patterns and identifying microbial factors. This example examines the relationship among RFI, the rumen microbial community, and serum metabolome in order to identify potential biomarkers for feed efficiency in beef/feedlot cattle.

Fifty weaned steers of approximately 7 months of age were housed at the Plateau Research and Education Center in Crossville, Tenn. Animals weighed 264±2.7 kg at the beginning of the study and transitioned to a backgrounding diet (11.57% crude protein and 76.93% total digestible nutrients with 28 mg monensin/kg on a dry matter basis) for 14 days prior to the start of the trial. Steers were adapted to the GROWSAFE system during that adaptation period. Body weight (BW) was measured at 7 day intervals and daily feed intake measured using the GROWSAFE system for the length of the 70 day feed efficiency trial. Feed efficiency was determined using RFI. (See Koch et al. Journal of Animal Science. 1963. 22:486-494). At the conclusion of the trial, steers were ranked based on RFI. Low- or high-RFI was determined as 0.5 SD below or above the mean RFI, respectively Approximately 9 mL of blood was sampled weekly via venipuncture from the coccygeal vein into serum separator tubes (Corvac, Kendall Health Care, St. Louis, Mo.). Blood samples were centrifuged at 2,000×g for 20 min at 4° C. Serum was decanted into 5 mL plastic culture tubes and stored at −80° C. for further analyses Rumen samples were centrifuged at 4,000 rpm for 15 min, and the nucleic acids were isolated using the POWERVI-RAL Environmental RNA/DNA Isolation Kit (Mo Bio Laboratories, Inc., Carlsbad, Calif., USA). The 16S rRNA gene was amplified. (See Lane. 16S/23S rRNA sequencing. Nucleic acid techniques in bacterial systematics. 1991; Muyzer et al. Applied and Environmental Microbiology. 1993. 59:695-700). Following amplification, PCR products were verified with a 2% agarose gel electrophoresis and purified using AMPure XP bead (Beckman Coulter, Brea, Calif., USA). The purified amplicon library was quantified and sequenced on the MiSeq Platform (Illumina, San Diego, Calif., USA) according to standard protocols. (See Flores et al. Genome Biology. 2014. 15:531). Raw fastq reads were de-multiplexed on the MiSeq Platform (Illumina, San Diego, Calif., USA)

All raw sequencing data was trimmed of adapter sequences and phred33 quality filtered using Trim Galore (See Krueger and Galore. A wrapper tool around Cutadapt and FastQC to consistently apply quality and adapter trimming to FastQ files. 2015). 16S taxonomic sequence clustering and classification was performed on filtered sequence data with the RDP 16S rRNA database. (See Edgar. SIN-TAX: a simple non-Bayesian taxonomy classifier for 16S amplicon reads. BioRxiv. 2016. 074161; Edgar and Flyvbjerg. Bioinformatics. 2015. 31:3476-3482; and Cole et al. Nucleic Acids Research. 2013. 42:D633-D642).

Serum samples (50 µL) from each steer were extracted for metabolomic analysis using 0.1% formic acid in acetonitrile:water:methanol (2:2:1), as described previous. (See Kamphorst et al. *Analytical Chemistry*. 2011. 83:9114-9122). Metabolites were separated using a Synergy Hydro-RP column (100×2 mm, 2.5 µm particle size). Mobile phases consisted of A: 97:3 H2O:MeOH with 11 mM tributylamine and 15 mM acetic acid and B: MeOH. The gradient consisted of the following: 0.0 min, 0% B; 2.5 min 0% B; 5.0 min, 20% B; 7.5 min, 20% B; 13 min, 55% B; 15.5 min, 95% B; 18.5 min, 95% B; 19 min, 0% B, and 25 min, 0% B. Flow rate was set to a constant 0.200 mL/min and the column temperature remained at 25° C. The autosampler tray was maintained at 4° C. and 10 μL of sample was injected into the Dionex UltiMate 3000 UPLC system (Thermo Fisher Scientific, Waltham, Mass.). Electrospray ionization was used to introduce the samples into an Exactive Plus Orbitrap MS (Thermo Fisher Scientific, Waltham, Mass.), using an established method. (See Kamphorst et al. Analytical Chemistry. 2011. 83:9114-9122; and Lu et al. Analytical Chemistry. 2010. 82:3212-3221).

Raw files obtained from Xcalibur MS software (Thermo Electron Corp., Waltham, Mass.) were converted into the mzML format using ProteoWizard. (See Chambers et al. Nature Biotechnology. 2012. 30:918). The converted files were imported into MAVEN (Metabolomic Analysis and Visualization Engine for LC-MS Data), a software package. (See Clasquin et al. Current Protocols in Bioinformatics. 2012. 14.11.1-14.11.23). Peaks for the known metabolites were picked in MAVEN, which automatically performs non-linear retention time correction and calculates peak areas across samples, using a preliminary mass error of ±20 ppm and retention time window of five min. The UTK Biological and Small Molecule Mass Spectrometry Core (BSMMISC) has replicated and expanded the method of Rabinowitz and coworkers and final metabolite annotations were made using a library of 263 retention time-accurate m/z pairs taken from MS1 spectra. (See Lu et al. Analytical Chemistry. 2010. 82:3212-3221). The annotation parameters were verified previously with pure standards as part of establishing the method. For a metabolite to be annotated as a known compound, the eluted peak had to be found within two min of the expected retention time, and the metabolite mass had to be within ±5 ppm of the expected value. Metabolite identities were confirmed using the MAVEN software package, and peak areas for each compound were integrated using the Quan Browser function of the Xcalibur MS Software (Thermo Electron Corp., Waltham, Mass.).

Downstream analysis was performed in python. PCoA was performed on Bray-Curtis distances and statistical significance was assessed through Analysis of Similarities (ANOSIM). (See Clarke. Austral Ecology. 1993. 18:117-143). Alpha diversity was measured both in dominance and singletons. (See Hammer et al. Palaeontol Electronica. 2001. 4:1-9). Regression based analysis was performed through Ordinary Least Squares (OLS) regression. (See Shi et al. The Annals of Applied Statistics. 2016. 10:1019-1040). Feature selection and supervised machine learning was performed on completed data through Random Forests. (See Breiman. Machine Learning. 2001. 45:5-32).

Other measurements of α-diversity, including equitability, Simpson's Evenness E, Shannon's Diversity Index, and Observed OTU, were assessed for normality using SAS 9.4 (SAS Institute, Cary, N.C.). All variables were found to follow a non-normal distribution, and were analyzed using Wilcoxon Rank Sum and Kruskal Wallis test.

Figure 10A:
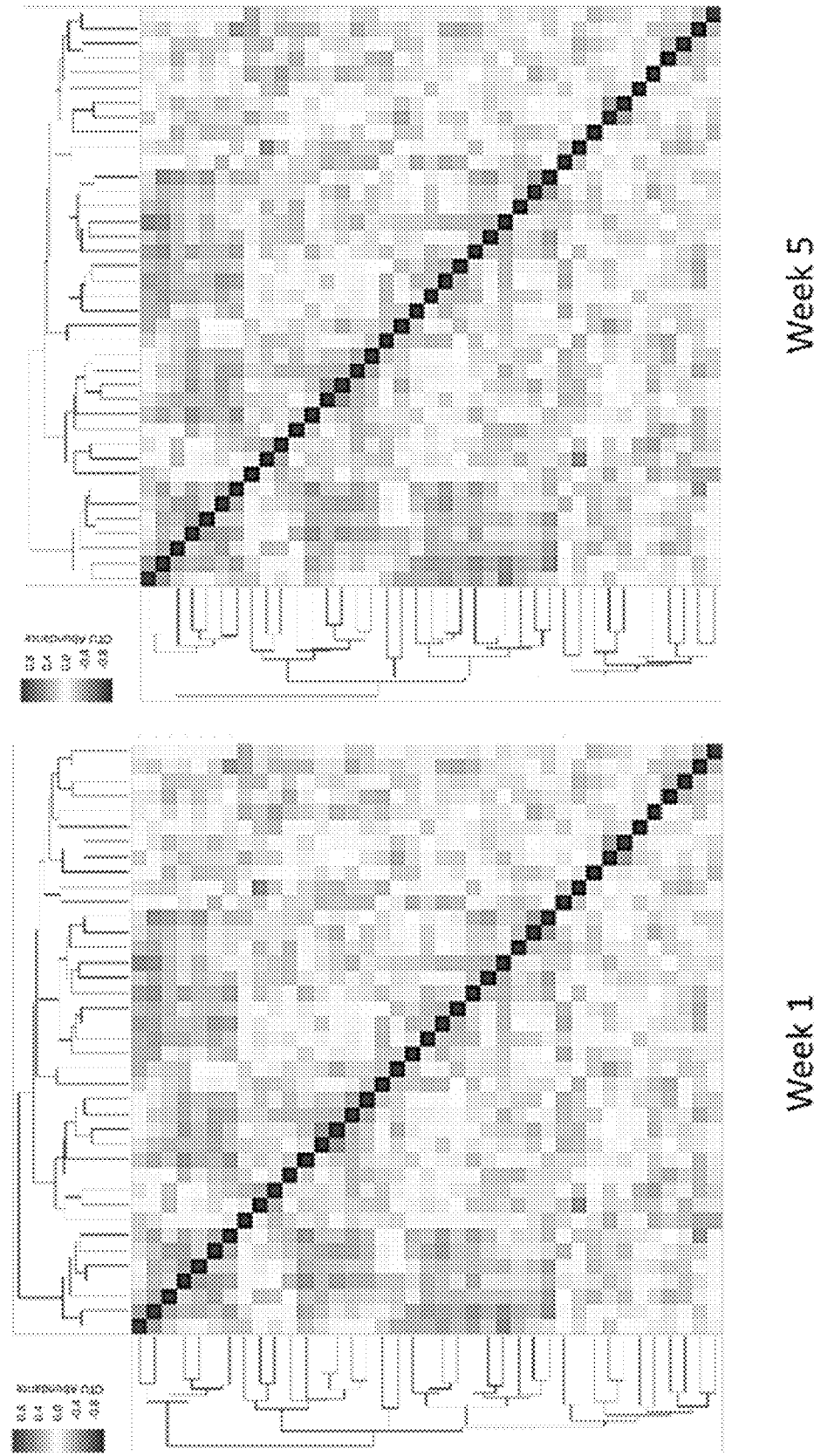
FIG. 10A and FIG. 10B depict the phylogenetic diversity of rumen bacterial communities across samples at week 1 and week 5 of the study (FIG. 10A) and across samples at week 7 and week 10 of the study (FIG. 10B).
Figure 10B:
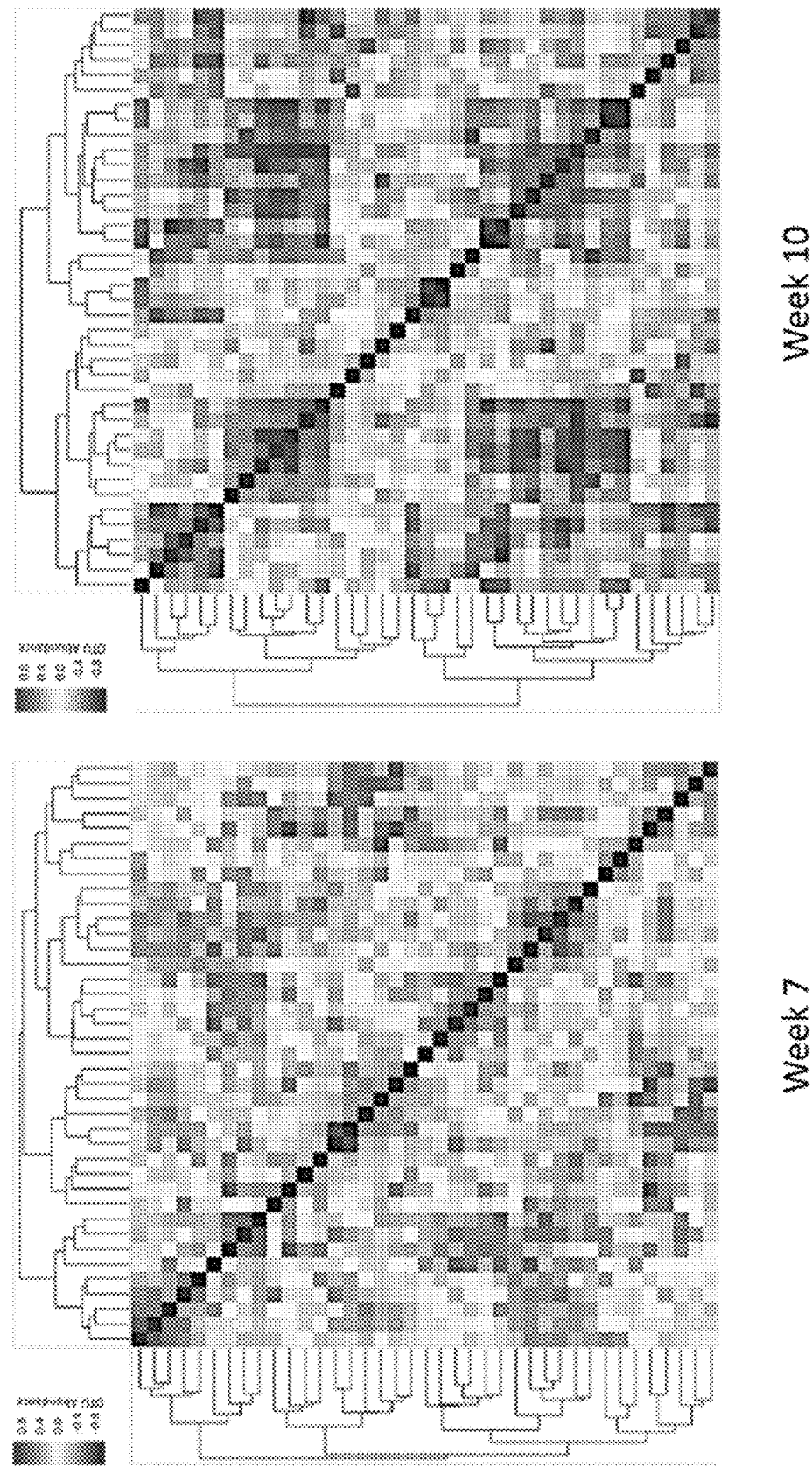

Alpha-diversity was measured by number of singletons, equitability, Simpson's Evenness, observed OTU, Good's coverage, chao1, and Shannon's Diversity Index. With the exception of number of singletons, α-diversity metrics did not differ between low- and high-RFI steers at the end of the study. Other α-diversity metrics did not differ between high- and low-RFI steers, including equitability ($p=0.24$), Simpson's Evenness ($p=0.19$), Observed OTU ($p=0.78$), Good's coverage ($p=0.14$), chao1 ($p=0.78$), and Shannon's Diversity Index ($p=0.07$). Phylogenetic diversity of the rumen bacterial communities also occurred over time with two distinct communities arising (FIG. 10A and FIG. 10B).

Figure 11B:
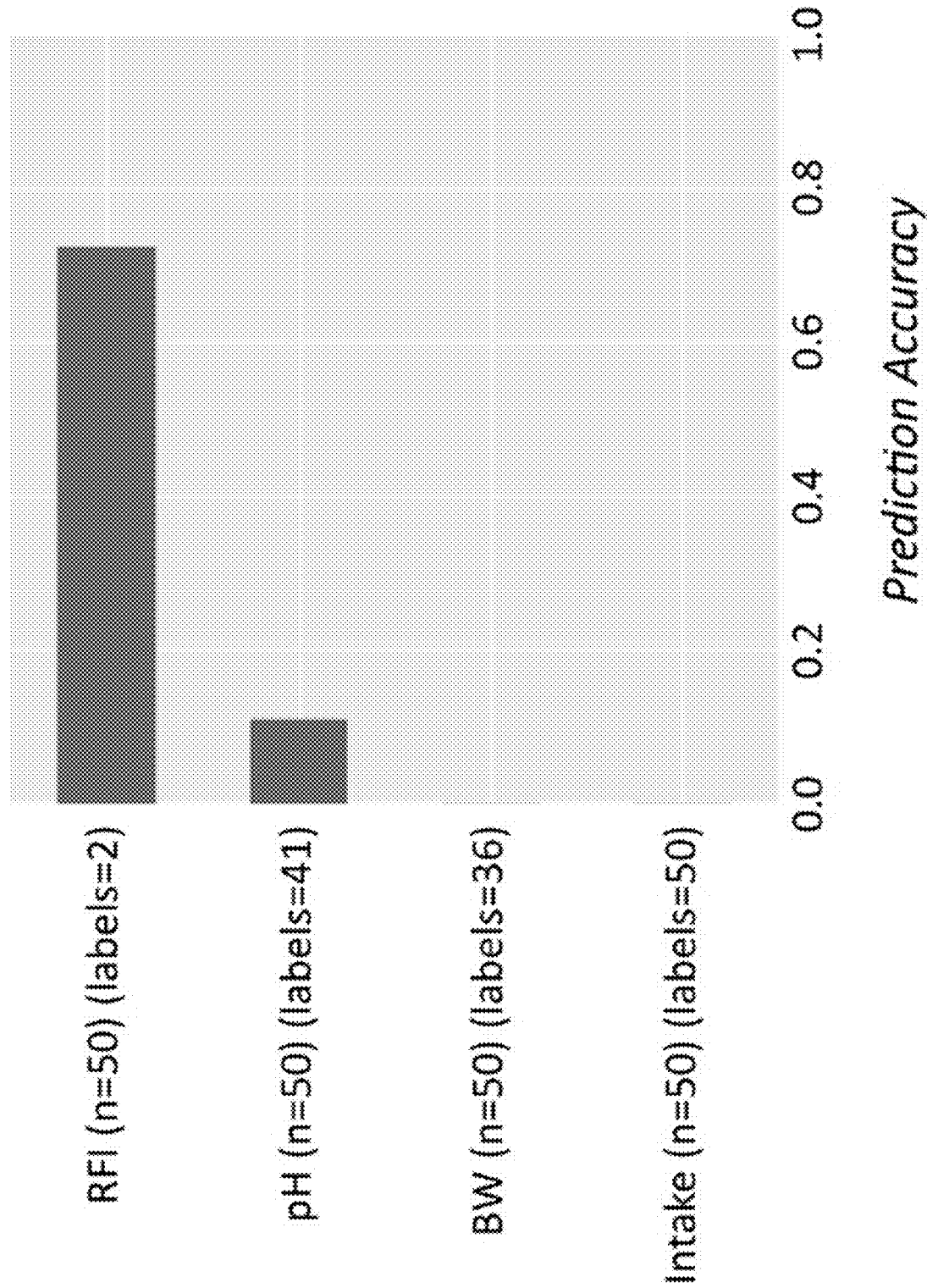
Figure 12:
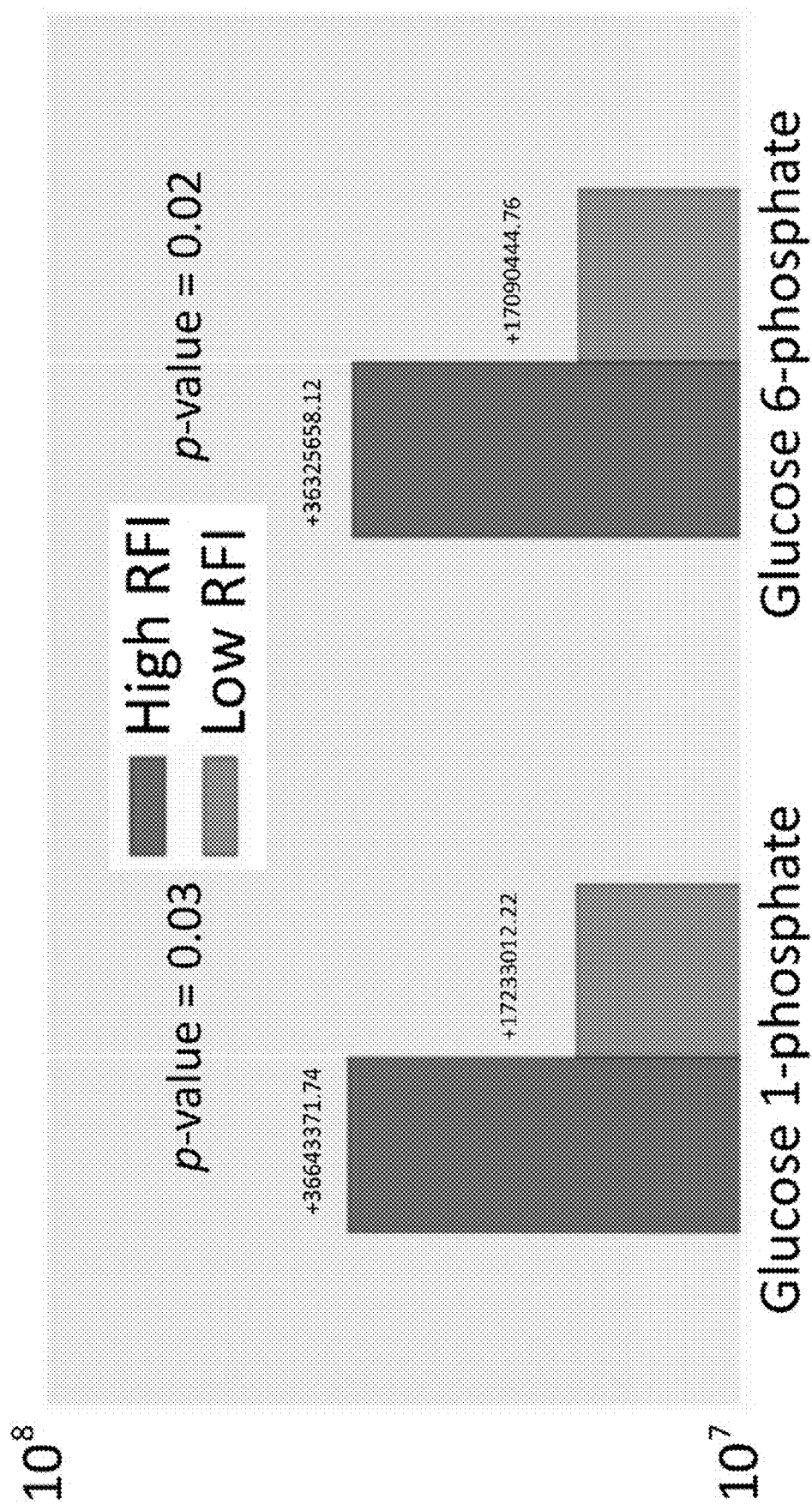
FIG. 12 depicts the mean predictive compounds between low-RFI and high-RFI. The greater the abundance of glucose-1-phosphate and/or glucose-6-phosphate is indicative of high-RFI.
Figure 13:
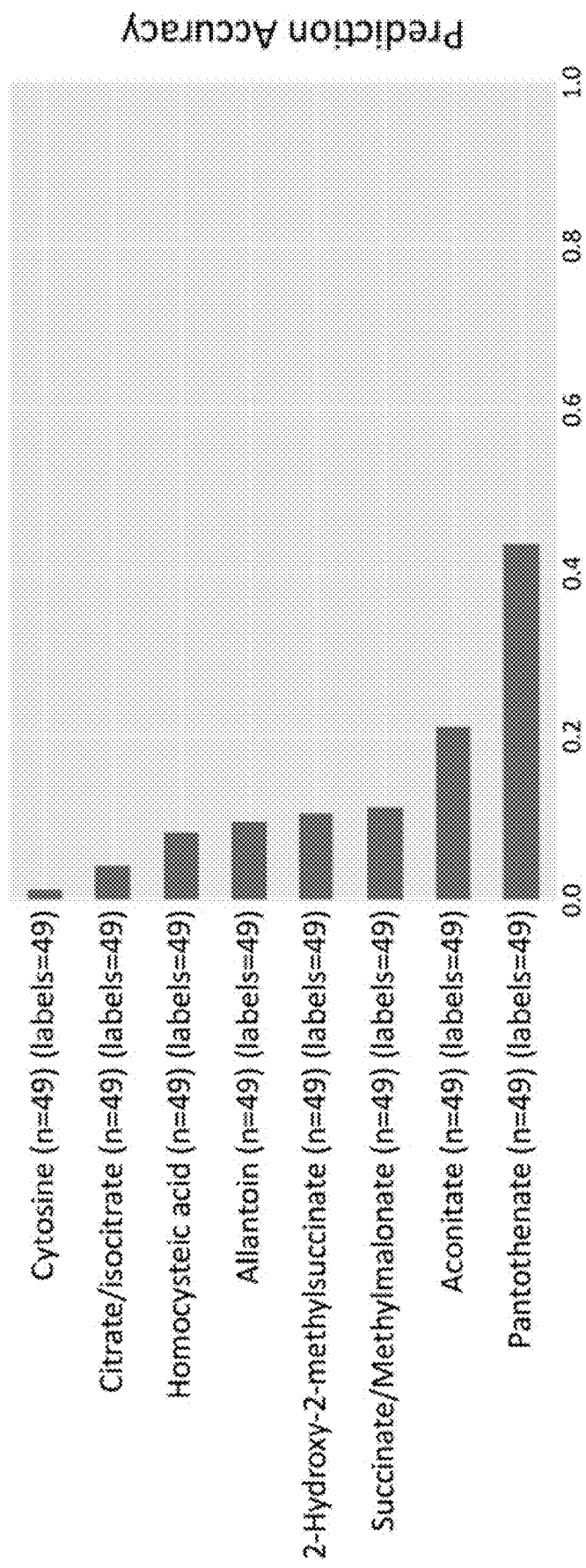
FIG. 13 depicts the serum metabolic signatures correlated to week 10 bacterial community composition.
Figure 14A:
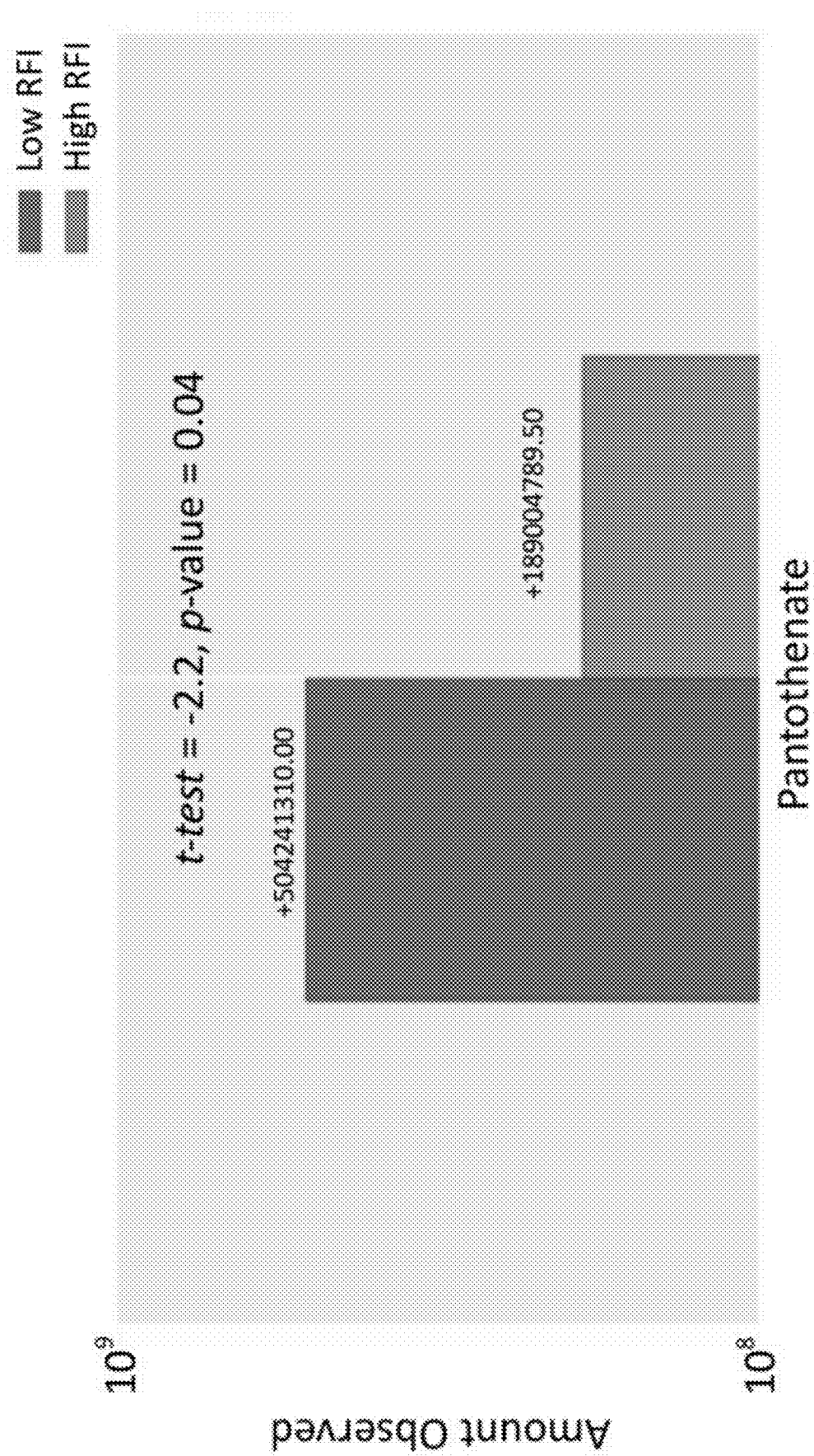
FIG. 14A and FIG. 14B depict the week 10 rumen microbial community correlations to serum metabolome. The mean serum pantothenate abundance differs between low-RFI and high-RFI steers (FIG. 14A). The mean Flavobacteriia abundance is associated with high pantothenate abundance (FIG. 14B).

A total of 109 known metabolites were identified. Residual feed intake was predictive of serum metabolomic signature and rumen microbial community signature at week 10 (FIG. 11A and FIG. 11B). Glucose-1-phosphate ($p=0.03$; FIG. 12) and glucose-6-phosphate ($p=0.02$; FIG. 12) differed between low- and high-RFI steers. Several other serum metabolites were predictive of rumen bacterial community structure, including pantothenate, aconitate, succinate, 2-hydroxy-2-methylsuccinate, allantoin, homocysteic acid, citate/isocitrate, and cytosine (FIG. 13). Serum pantothenate abundance was the greatest predictor of the rumen bacterial community composition, and was also found to be significantly different between low- and high-RFI steers ($p=0.04$; FIG. 13; FIG. 14A).

Figure 14B:
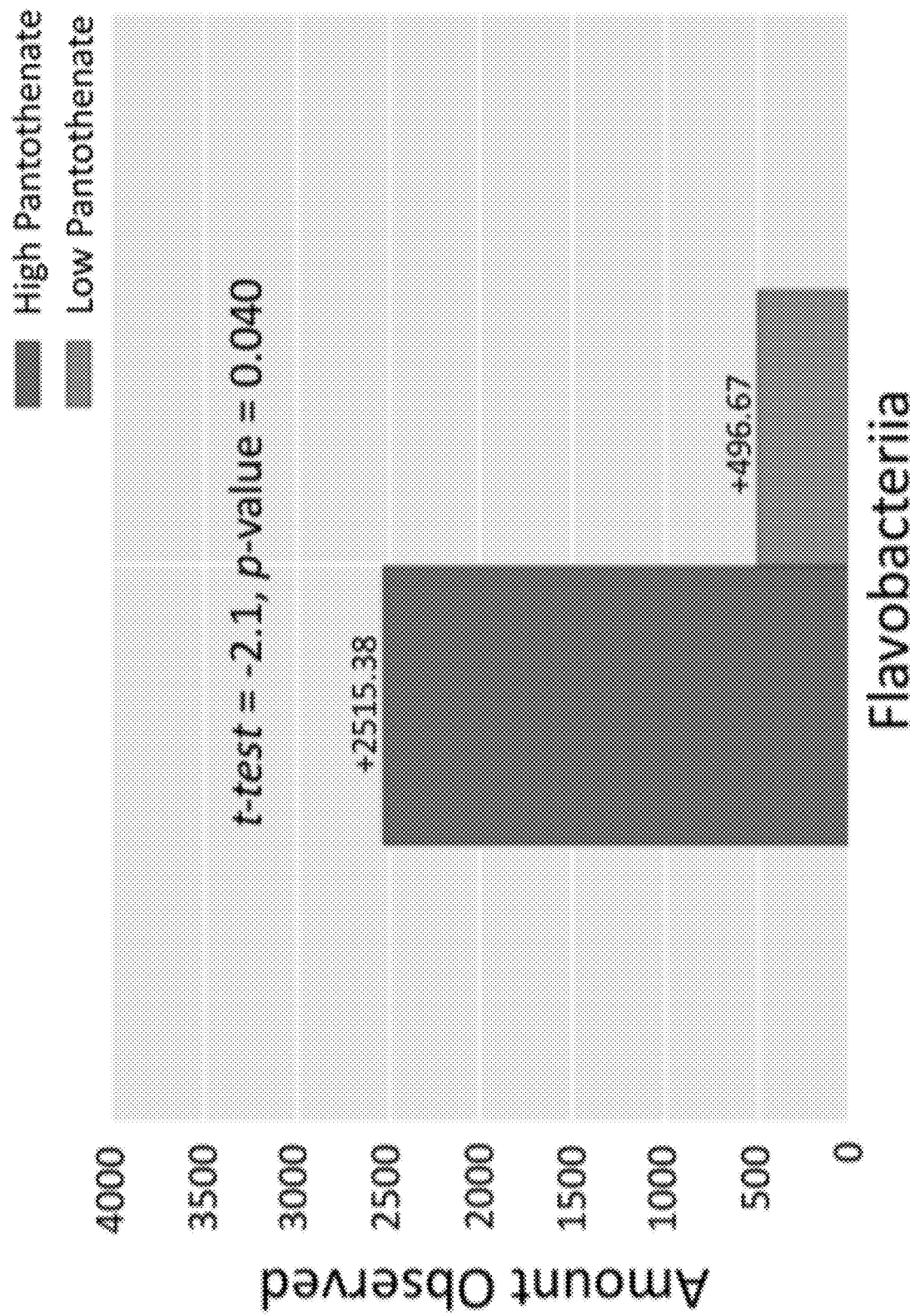
Figure 15:
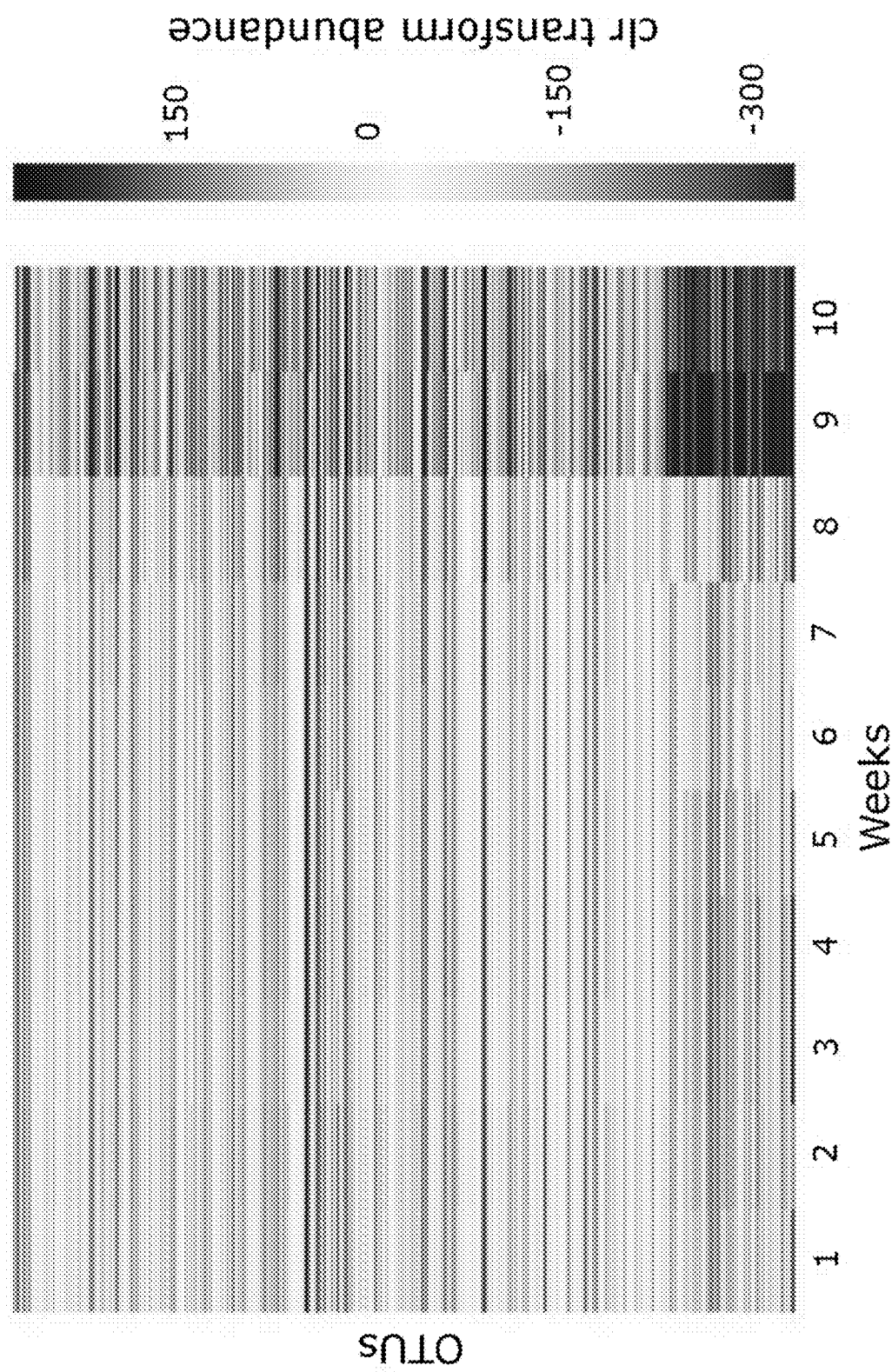
FIG. 15 depicts spectral coclustering of composite average of OTU over time, indicating major microbial successions throughout the study in the rumen microbial community.
Figure 16:
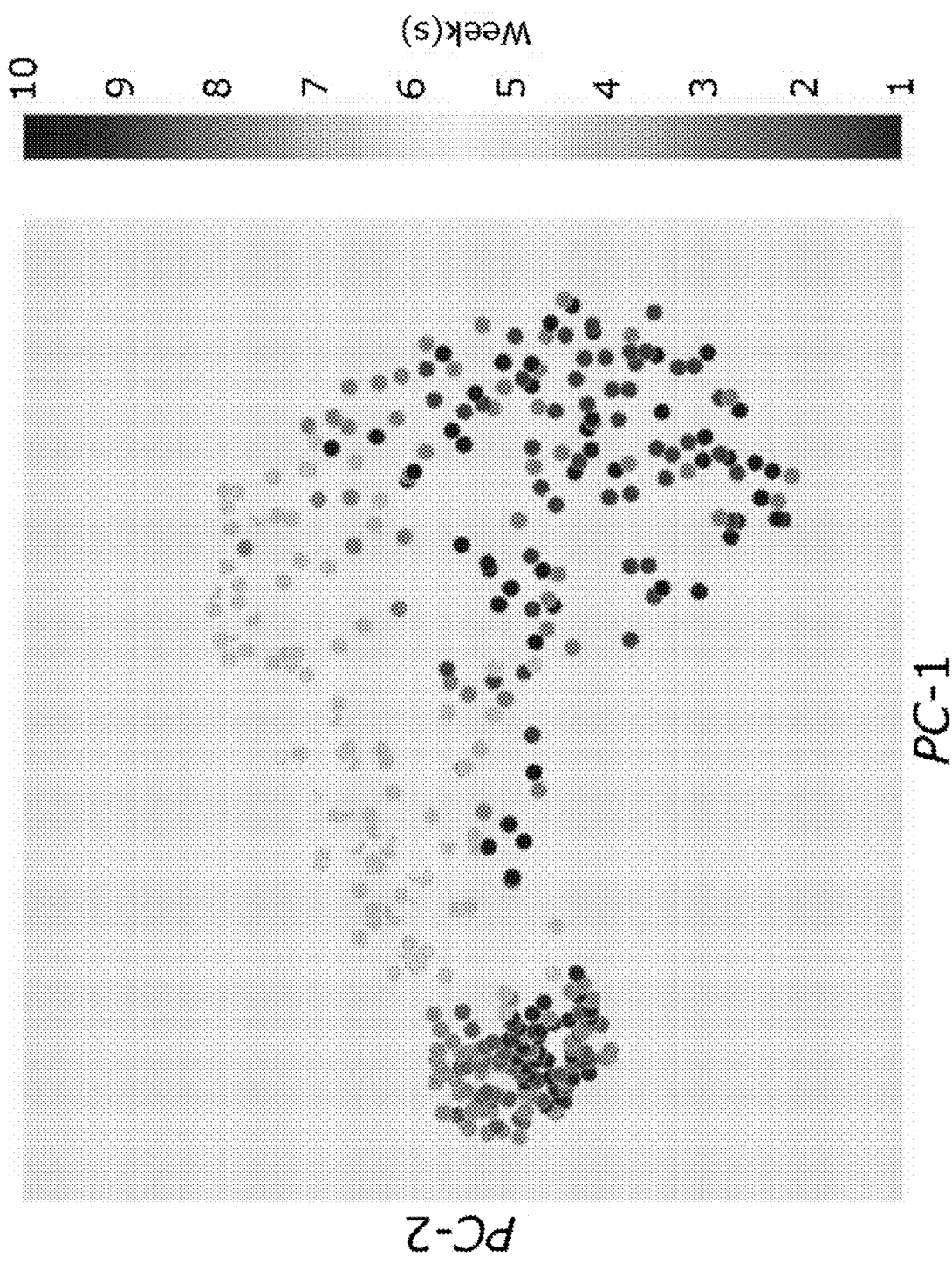
FIG. 16 depicts a principal coordinate analysis (PCoA) based on Bray-Curtis distances among the ruminal bacterial communities throughout the study.

In addition to serum pantothenate abundance as a predictor of rumen bacterial community composition, panothenate abundances were also associated with a class of rumen bacteria, Flavobacteriia. Flavobacteriia were predictive of pantothenate abundance in serum Mean Flavobacteriia abundance differed between steers with low and high pantothenate abundances ($p=0.04$; FIG. 14B).

While a number of singletons in the rumen bacteria differed between low- and high-RFI steers, other measurements of α-diversity did not differ between the two groups. The data presented in this study suggest that α-diversity may not be a significant contributing factor to feed efficiency phenotypes in stable microbial communities in growing beef steers.

Glucose-1-phosphate and glucose-6-phosphate are both intermediate metabolites of the pentose phosphate pathway in which G6P undergoes several enzymatic reactions to generate NADPH, and is most common in pathways involved in fatty acid and steroid production. (See Cori et al. Journal of Biological Chemistry. 1939. 129:629-639). Glucose-6-phosphate dehydrogenase, the first enzyme of the pentose phosphate pathway, is the rate limiting enzyme of this pathway (See Laliotis et al. Comparative Biochemistry and Physiology Part B: Biochemistry and Molecular Biology. 2007. 147:627-634), which is estimated to supply 50 to 80% of the NADPH required to perform fatty acid synthesis in ruminants. (See Vernon. Lipid Metabolism in Ruminant Animals, Pergamon. 1981. P. 279-362; and Belk et al. Journal of Animal Science. 1993. 71:1796-1804). Accumulation of G6P and G1P in less efficient animals may indicate less enzymatic activity or efficiency of the pentose phosphate pathway, which would decrease NADPH concentrations, resulting in less adipose accumulation. Both G1P and G6P in serum could potentially serve as biomarkers for feed efficiency, as increased concentrations are both are associated with decreased feed efficiency.

The rumen microbiome produces several vital nutrients for the host animals, including organic acids that serve as glucogenic precursors, as well as proteins and vitamins. (See Hungate. The Rumen and its Microbes. Elsevier. 1966). A nutrient produced by the rumen microbiota is pantothenate. Pantothenate plays a significant role in the metabolism of fatty acids in ruminants and other species. (See Smith et al. Metabolism. 1987. 36:115-121; Palanker. Journal of Lipid Research. 2016. 57:380-387). In this example, pantothenate was not only associated with greater feed efficiency, but was also predictive of rumen bacterial community composition. Pantothenate is a key component of coenzyme A (CoA), which is required to perform a variety of functions in intermediary metabolism of ruminants. (See Ragaller et al. Journal of Animal Physiology and Animal Nutrition. 2011. 95:6-16). Namely, CoA is responsible for transfer of fatty acid components into and out of the mitochondria. (See Ball.

Vitamins in Foods. Analysis, Bioavailability, and Stability. Boca Raton: CRC Press. 2006). Pantothenate is produced by several species of bacteria in the rumen, and can then be released into the rumen lumen to be absorbed by the host animal. One class of bacteria that can generate pantothenate in the rumen are Flavobacteriia. It was found in this example that greater Flavobacteriia abundances were associated with greater pantothenate abundances, and Flavobacteriia abundances were predictive of pantothenate quantities, supporting that more efficient steers may have greater abundances of Flavobacteriia, which may lead to increased abundance of pantothenate.

As with G1P and G6P, pantothenate can be identified through serum; however, whereas G1P and G6P may serve as indicators of lower feed efficiency, pantothenate may indicate greater feed efficiency. The relationship between pantothenate and Flavobacteriia can not only provide insight as to mechanisms accounting for some variability in feed efficiency, but also serve as biochemical and microbial biomarkers in the serum and rumen, respectively. These biomarkers could allow producers to identify and select animals of greater feed efficiency. Metabolites and microbes predictive of efficiency phenotypes in cattle are not only imperative to partially explaining divergences in feed efficiency, but also due to the selection of microbial communities related to efficient animals. These insights may also lead to the ability to select for an optimal rumen microbiome.

This example identified potential microbial and biochemical biomarkers that were used to determine extremes in feed efficiency in steers. Although, notable correlations between G1P and G6P and feed efficiency were identified, linking, and perhaps predicting, the functional capacity of the rumen and its microbiome, specifically Flavobacteriia, through serum pantothenate offers the potential to use serum biochemistry as an indicator in identification of feed efficient cattle. Additionally, although it has yet to be determined to what degree the rumen microbiome influences the host, or the host influences the rumen microbiome, the present example identified several key physiological elements that may impact or predict microbial community structure (e.g. RFI), or predictive of RFI (i.e. the serum metabolome and rumen microbial community).

Example IV. Dynamics Mediating Feed Efficiency in Cattle

The majority of research aimed at determining the influence of the microbiome on cattle production or the influence of cattle production on the ruminal microbiome has been conducted by examining short-term, end point sampling or single periods of sample collection. These single-point analyses have provided valuable insight to the influence of the rumen microbiome on livestock production but may confound the interpretation of study results and conclusions. Variation of the ruminal microbiota between animals is considerable (See Ross et al. 2012. BMC genetics 13(1):53; and Myer et al. 2015. PLOS ONE 10(6): e0129174), end point samples may not be satisfactory to adequately define an existing state within a population. Studies examining bovine nutrition with regard to the ruminal microbiome routinely rely on differences in diet or diet transitions, where the length of the study is defined by traditional nutritional parameters and historical data, not taking into account microbial acclimation to the study ration. The ruminal microbial temporal stability following such perturbations has yet to be determined. Thus, diet acclimation prior to experiments, diet re-acclimation among experimental periods, and other dietary changes in cattle gut microbiome studies may confound microbial characterization when temporal variation and stability are not taken into consideration. These patterns of variation may have significant implications when aiming to determine relationships between the gut microbiome and nutrition in cattle.

Fifty steers of approximately seven months of were obtained. The steers weighed 264±2.7 kg at the beginning of the trial. The steers grazed on cool-season grasses until being transferred to the GROWSAFE system for a 14d adaptation period. Animals were placed on a step-up diet during the 14d adaptation period and transitioned to a growing diet (11.57% crude protein and 76.93% total digestible nutrients on a dry matter basis) with 28 mg monensin/kg DM. A 70d feed efficiency trial was administered following the acclimation period. Weekly, body weight (BW) via chute scale, rumen fluid samples via gastric tubing, and blood samples via coccygeal venipuncture were collected. (See Krysl and Hess. 1993. Journal of Animal Science 71(9): 2546-2555). Approximately 100 mL of rumen content were transferred to 50 mL conical tubes, rumen content pH determined, and samples stored at −80° C. Feed intake was continually monitored via the GROWSAFE system throughout the 70d feed efficiency trial.

Rumen samples were centrifuged at 4,000 rpm for 15 min, were isolated using the POWERVIRAL Environmental RNA/DNA Isolation Kit (Mo Bio Laboratories, Inc., Carlsbad, Calif., USA). The 16S rRNA gene was amplified for Illumina sequencing. Following amplification, PCR products were verified with a standard agarose gel electrophoresis and purified using AMPure XP bead (Beckman Coulter, Brea, Calif., USA). The purified amplicon library was quantified and sequenced on the MiSeq Platform (Illumina, San Diego, Calif., USA) according to standard protocols (Flores, Caporaso et al. 2014). Raw fastq read were de-multiplexed on the MiSeq Platform (Illumina, San Diego, Calif., USA).

All raw sequencing data was trimmed of adapter sequences and phred33 quality filtered using Trim Galore (See Krueger and Galore. A wrapper tool around Cutadapt and FastQC to consistently apply quality and adapter trimming to FastQ files. 2015). 16S taxonomic sequence clustering and classification was performed on filtered sequencing data with the RDP 16S rRNA database. (See Edgar. SINTAX: a simple non-Bayesian taxonomy classifier for 16S amplicon reads. BioRxiv. 2016. 074161; Edgar and Flyvbjerg. Bioinformatics. 2015. 31:3476-3482; and Cole et al. Nucleic Acids Research. 2013. 42:D633-D642).

Downstream analysis was performed in python. PCoA was performed on Bray-Curtis distances and statistical significance was assessed through Analysis of Similarities (ANOSIM). (See Clarke. Austral Ecology. 1993. 18:117-143). Alpha diversity was measured both in dominance and singletons. (See Hammer et al. Palaeontol Electronica. 2001. 4:1-9). Regression based analysis was performed through Ordinary Least Squares (OLS) regression. (See Shi et al. The Annals of Applied Statistics. 2016. 10:1019-1040). Feature selection and supervised machine learning was performed on completed data through Random Forests. (See Breiman. Machine Learning. 2001. 45:5-32).

Other measurements of α-diversity, including equitability, Simpson's Evenness E, Shannon's Diversity Index, and Observed OTU, were assessed for normality using SAS 9.4 using the PROC UNIVARIATE command (SAS Institute, Cary, N.C.). All variables were found to follow a non-normal distribution, and were analyzed using Wilcoxon Rank Sum and Kruskal Wallis test.

Figure 4:
FIG. 4 depicts the large change in microbial alpha-diversity as an animal continues to be fed a finishing diet.
Figure 5:
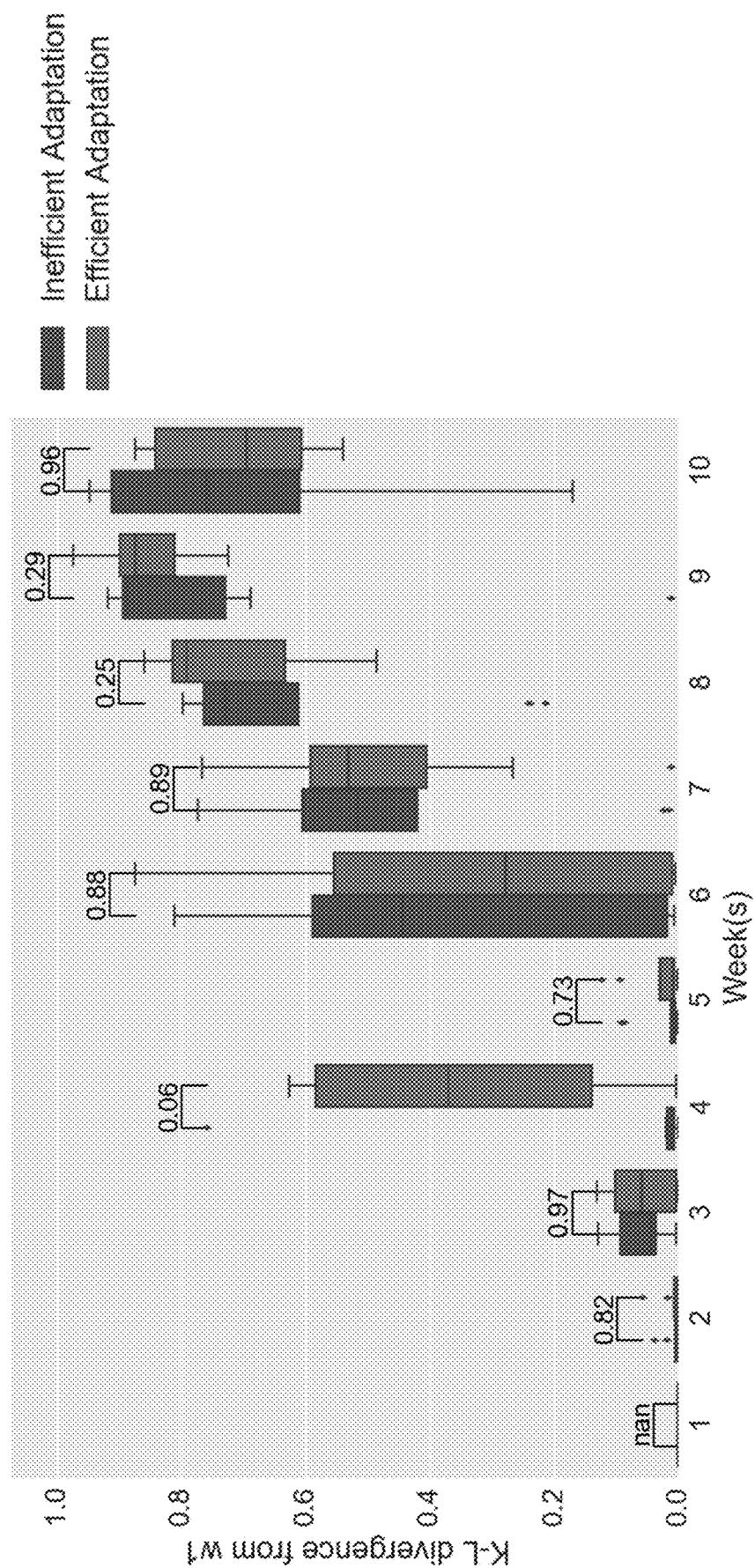
FIG. 5 depicts the importance of the speed of microbial successions into a streamlined microbial ensemble related to animal efficiency. Furthermore, the large shift in the rumen microbiome on week 4 is most significant when related to efficiency.
Figure 25:
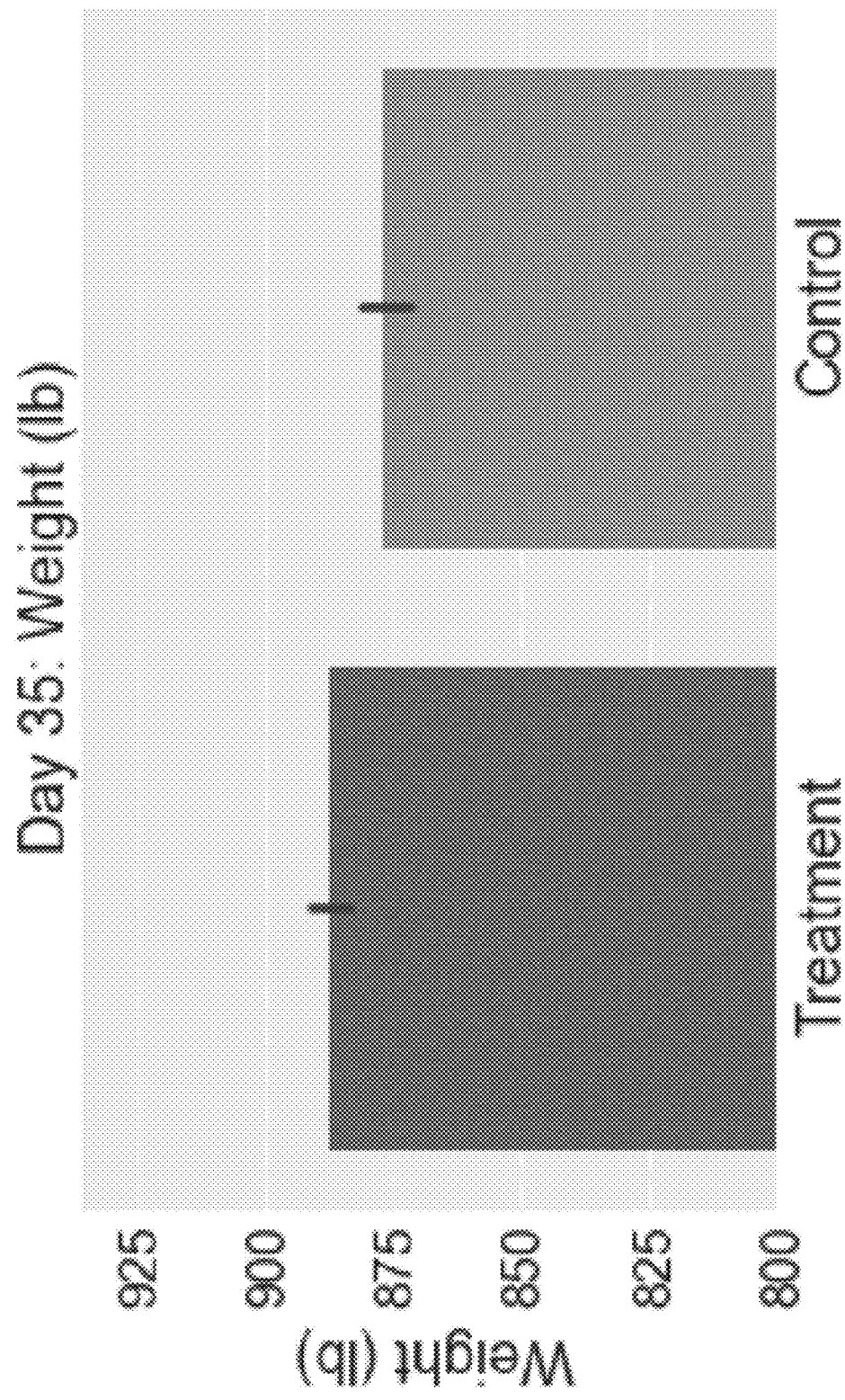
FIG. 25 depicts the evaluation of the microbes of the present disclosure and their ability to modulate weight in the animal, particularly the ability to increase the weight of the animal.

Alpha-diversity was measured using, equitability, Simpson's Evenness, chao1, Shannon's Diversity Index, and observed OTU. Good's coverage was also measured to ensure satisfactory coverage of OTU for each week. Shannon's Diversity Index was greatest at the beginning of the trial (4.66±0.32), but decreased overall by the end of the trial (3.61±0.14; P<0.0001). Observed OTU also was greater during the first week (160.14±12.83) compared to the final week (57.9±2.5; P<0.0001). Equitability was greatest during week 1 of the trial (0.66±0.03), fluctuated throughout the trial, but was lower at week 10 (0.61±0.02; P<0.0001). Whereas several metrics related to richness increased from week 1 to week 10, overall evenness fluctuated greatly (P<0.0001) but was numerically similar by the end of the trial (0.12±0.02) to the first week of the trial (0.13±0.01). Greater phylogenetic diversity was observed at week 5 compared to week 1, but decreased by week 10 as evidence by spatial co-clustering. The rumen microbial community began to shift at week and reached stabilization by week 10. Three orders were identified as changing significantly during the shift to the final microbial community, including Pasteurellales, Aeromonadales, and Bacteriodales. The shift to the final bacterial community composition began to occur at week 4 (FIG. 4). Several physiological factors were predictive of the rumen microbial community. Rumen pH was correlated with α-diversity (P=0.005; FIG. 4) at week 5 and predictive of rumen microbial community signature at week 10 (FIG. 25).

The diversity of the rumen bacterial community was greatest at the start of the trial, following a field-standard two week adaptation period to the growing diet and was greatly variable throughout much of the trial. Rumen bacterial community diversity was lowest by the end of the trial, at ten weeks following the adaptation period. The rumen bacterial diversity was greatest at the start of the trial following the adaptation period, but reached stability by ten weeks. The transition from a predominantly forage-based diet to a diet incorporating concentrates causes a shift in bacterial taxa due to changes in substrate type (See Tajima et al. 2001. Applied and Environmental Microbiology 67(6): 2766-2774). These differences in nutrient availability to the microbes may have resulted in a state of microbial community dysbiosis as bacterial populations competed for nutritional sources, increased functional redundancy occurred, and the physical environment of the rumen, such as pH, changed (See Whittaker. 1972. Taxon 21(2/3): 213-251).

Dietary transitions, adaptation periods, and wash-out periods are often incorporated into nutritional studies, including those involving the rumen microbiome adaptation and wash-out periods have historically spanned anywhere from several days to four weeks, which previous studies have suggested is adequate time for acclimation, as reviewed by (See Brown et al. 2006. Journal of Animal Science 84(13_suppl): E25-E33) and supported by recent nutritional microbial studies (See Anderson et al. 2016. Journal of applied microbiology 120(3): 588-599). However, in this study, it took approximately ten weeks for the rumen microbial community to stabilize, a time frame much longer than traditionally utilized for adaptation or wash-out periods. Although cattle may physically acclimate to feed within a two week period, the results of this study suggest the rumen microbiome requires additional time to stabilize.

At week 4 of this study, three orders appeared to drive the shift to a stable bacterial community composition, including Aeromonadales, Pasteurellales, and Bacteroidales. Two of these orders, Aeromonadales and Pasteurellales, belong to the phylum Proteobacteria, and Bacteroidales belongs to the phylum Bacteroidetes. Proteobacteria and Bacteroidetes are typically two of the three most prevalent bacterial phyla found in the rumen but bacteria belonging to the phylum Firmicutes are frequently found to be the most abundant in the rumen, followed by Bacteroidetes and Proteobacteria in cattle on a primarily forage-based diet. However, as cattle transition to incorporate more readily-fermentable feedstuffs, Bacteroidetes becomes the dominant phylum.

The changes in abundances of these orders also provides additional insight given their function in the rumen. At week 4, relative abundance of Aeromonadales sharply decreased, whereas Bacteroidales and Pasteurellales both increased at week 4. Some rumen microbes belonging to Aeromonadales, including *Ruminobacter* and *Succinovibrio*, are fibrolytic in nature and found in conjunction with high-fiber diets, which may account for the decrease in abundance of those microbes as the rumen microbiome adapted to the more readily digestible diet. Genera found in Bacteroidales and Pasteurellales, including *Prevotella* and *Actinobacillus*, respectively, are important for digestion of protein and carbohydrates. Rapid production of byproducts of metabolism, such as organic acids, by Bacteroidales and Pasteurellales may be responsible for the shift in pH seen in week 5, which was also indicative of rumen microbiome signature. The diet fed in this study included feedstuffs that are more readily fermentable, which can cause decreases in rumen pH due to increased production of organic acids such as lactate. This can shift the bacterial community composition towards those bacteria that are more tolerant of low pH, including those in Bacteroidales and Pasteurellales (See Fernando et al. 2010. *Applied and Environmental Microbiology* 76(22): 7482-7490).

Example V. Dynamics Mediating Efficiency with a High Corn Diet

The lactate and other acids produced in the rumen are generally considered the main drivers of acidosis and feed inefficiency in high corn or grain intensive diets, like those provided in beef/cattle feedlots. Many in the art believe that higher concentrations of volatile fatty acids (VFAs) induce acidosis, and that lactate producers dominate the rumen microbiome during acidosis, dropping the pH faster than other fermentation acids. Many believe that bringing acidotic feedlot cattle back to a healthy state requires increasing the ruminal pH by reducing lactate and VFA concentration, or through the use of feed additives such as buffers for pH stability or ionophores to inhibit lactate producers.

The table that occurs in FIG. 6 identifies the ruminal VFA concentrations and pH of Blank Angus steers between high RFI and low RFI at week 10. The low RFI animals tended to have a higher production of VFAs compared to the high RFI animals, and the pH is similar for both groups.

The pH is measured by taking the $pK_a$ plus the log of $HCO_3^-$ divided by dissolved $CO_2$ ($dCO_2$). $CO_2$ is known to play a key role in respiration and blood buffering, and it likely plays a large role in pH regulation of the rumen. In the rumen, $CO_2$ is present in the rumen gas cap and the rumen liquid. Most is in the rumen liquid as $dCO_2$ as a base (bicarbonate) or as an acid (carbonic acid). The $CO_2$ in the liquid transforms into carbonic acid (~1%), which quickly dissociates to bicarbonate, the primary base in the rumen fluid. (See Laporte-Uribe. 2016. Animal Feed Science and Technology. 219:268-279). Thus, as fermentation progresses, $dCO_2$ becomes the main species, which may lead to pH decline. High levels of $CO_2$ reduce the buffering capability of the rumen.

There are many different microbial pathways that utilize carbon dioxide. Three different bacterial carbon fixation pathways exist in nature: (1) the Calvin cycle, (2) the Wood-Ljungdahl pathway, and the reductive TCA.

High partial pressures of $CO_2$ in the rumen favors carbon dioxide fixers and the utilization of these pathways.

Figure 7:
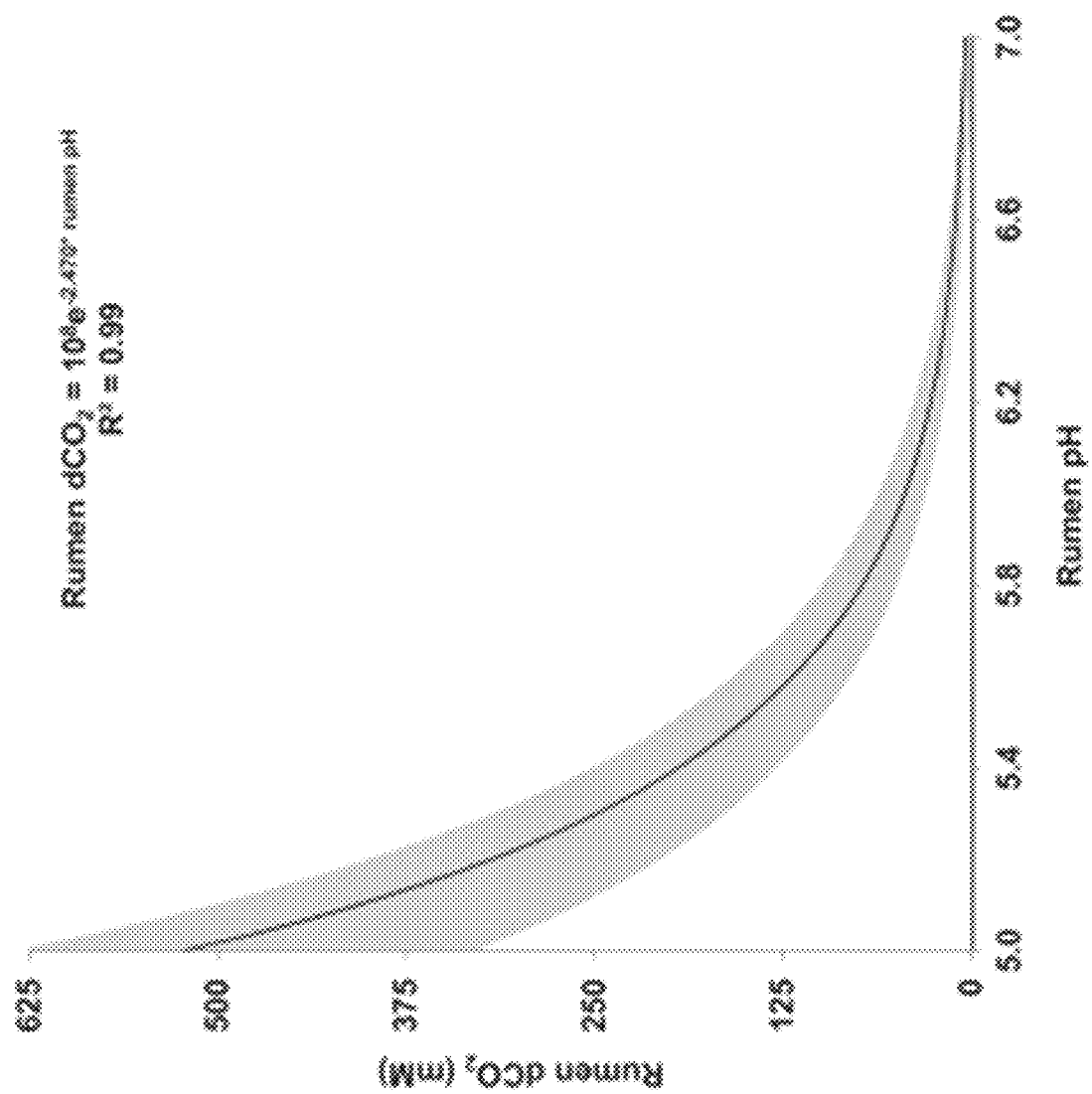
FIG. 7 depicts the theoretical concentrations of dissolved $CO_2$ with respect to rumen pH. Reproduced from Laporte-Uribe, 2016.
Figure 8:
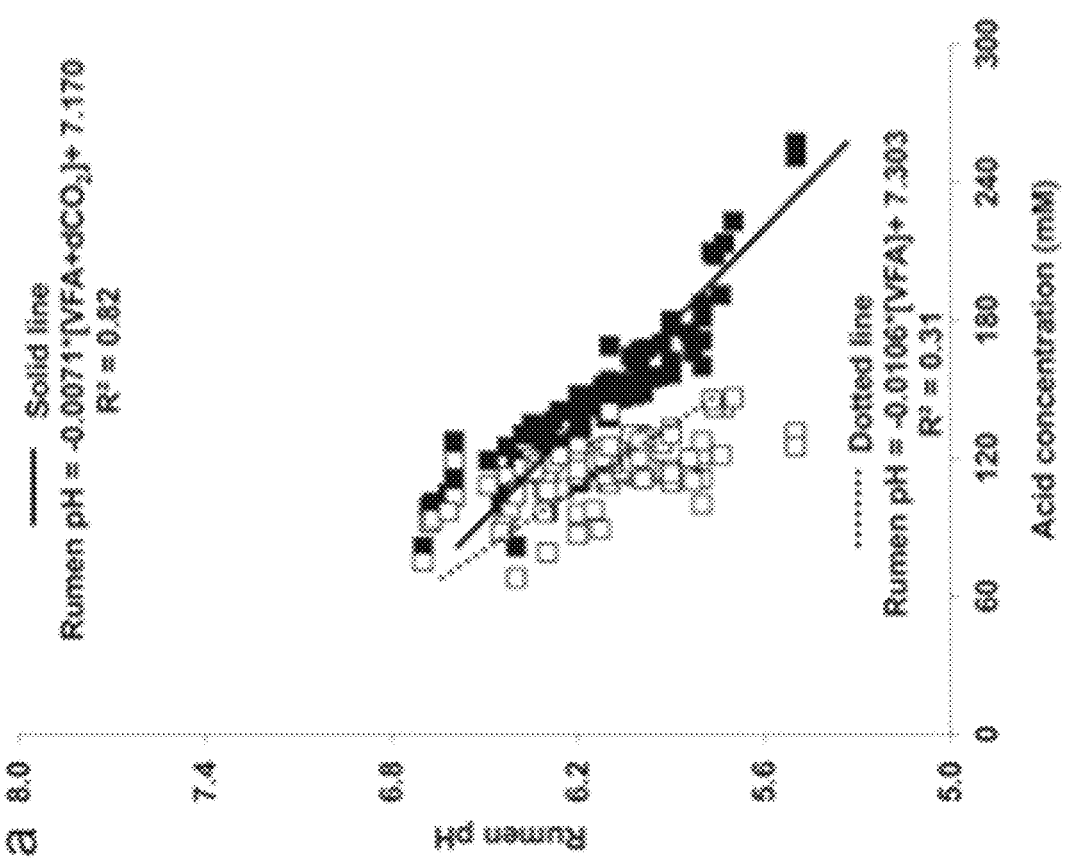
FIG. 8 depicts the theorized pH of the rumen based on both VFA concentrations and $dCO_2$ concentrations (filled squares), and VFA concentrations alone (open squares). Including $dCO_2$ better predicts pH than VFAs alone. Reproduced from Laporte-Uribe, 2016.

Although previously deemed negligible, modeling suggests that $dCO_2$ concentrations can be very high, and a better predictor of ruminal pH. FIG. 7 depicts the theoretical concentrations of dissolved $CO_2$ with respect to rumen pH. FIG. 8 depicts the theorized pH of the rumen when taking into account both VFA concentrations and $dCO_2$ concentrations and VFA concentrations alone. The inclusion of $dCO_2$ in the pH prediction is more accurate than utilizing VFAs alone. Modeling and extrapolation of existing data shows that as pH declines, $dCO_2$ concentration values could increase above the theoretical maximum of 50 mM. Morgante et al. (2009. Comparative Clinical Pathology. 18(3): 229-232) support these models and extrapolations.

Figure 9:
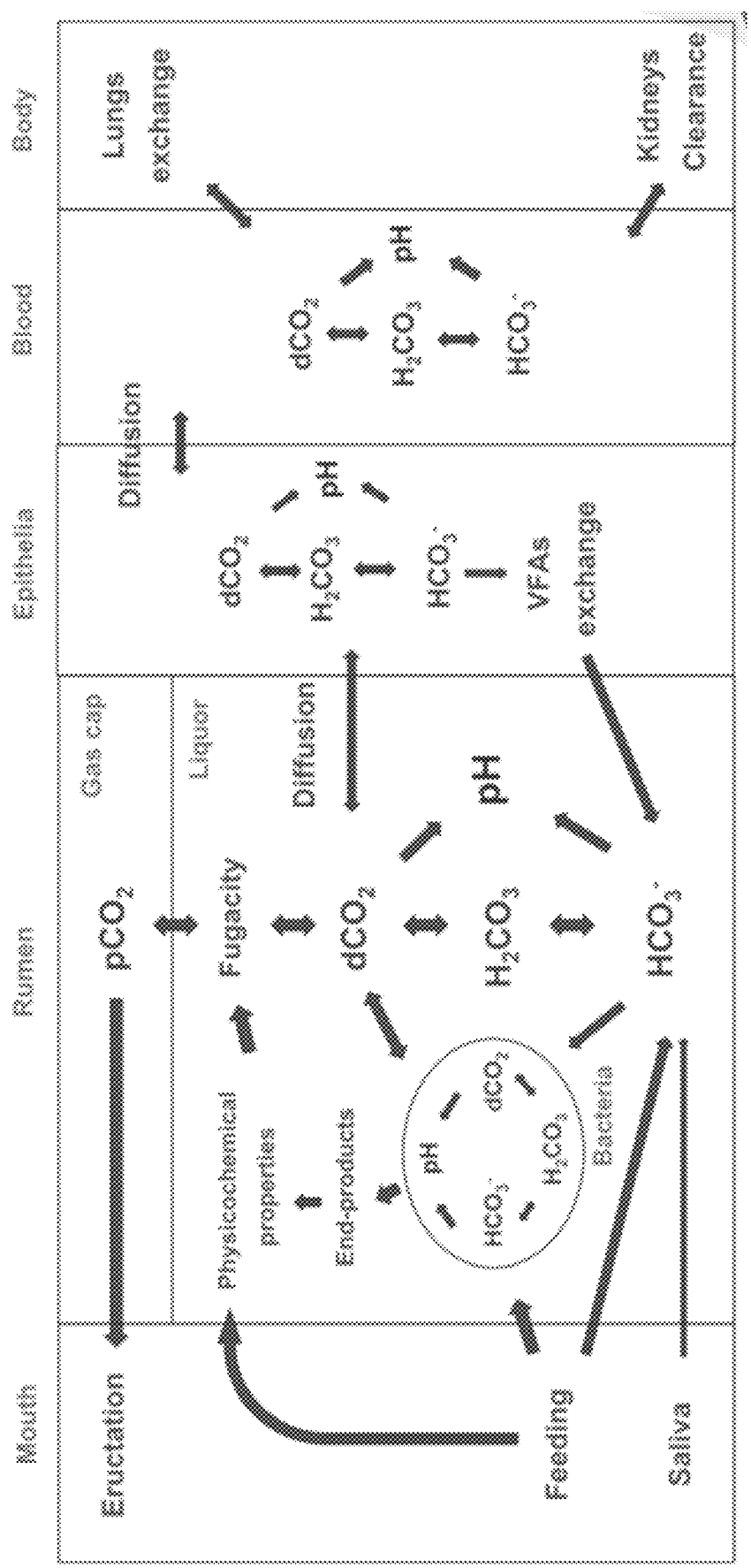
FIG. 9 depicts the potential path ruminal $CO_2$ may follow to impact the physiology of a ruminant. Reproduced from Laporte-Uribe, 2016.

The high $CO_2$ concentrations in the rumen create systemic physiological health problems for the animal. (See FIG. 9). The ruminal microbial metabolism can shift due to changes in the stoichiometry for VFA concentrations that can result in lactate production, and further increase histamine and LPS production. Nutritional diseases related to high $dCO_2$ concentrations cause issues in the rumen due to foaming and high viscosity. High $dCO_2$ concentrations result in rumen acidosis, increased bloat, and abomasal dysplasia. Nutritional diseases related to rumen $dCO_2$ and high $dCO_2$ diffusion include respiratory and metabolic acidosis, modulated immune responses, laminitis, ketosis, liver disease, and liver abscesses. Fat and cholesterol can also mobilize to reduce $dCO_2$ absorption, creating other deleterious physiological health problems for the animal.

Figure 17:
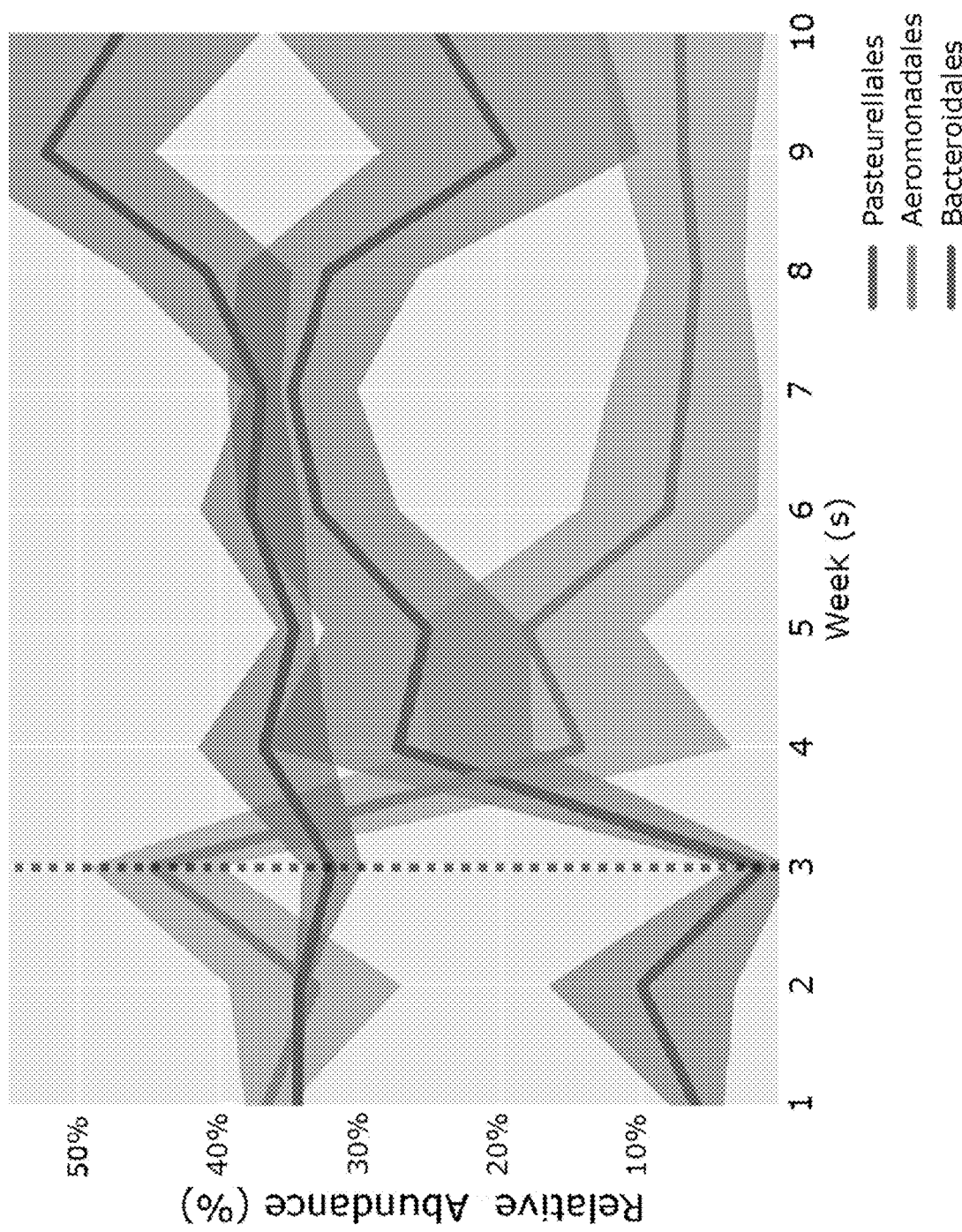
FIG. 17 depicts the relative abundance of three bacterial orders driving the shift in bacterial community composition throughout the 10-week trial. Shaded regions indicate SEM. These three order are important to RFI. A major microbial succession occurs in week 4.
Figure 18A:
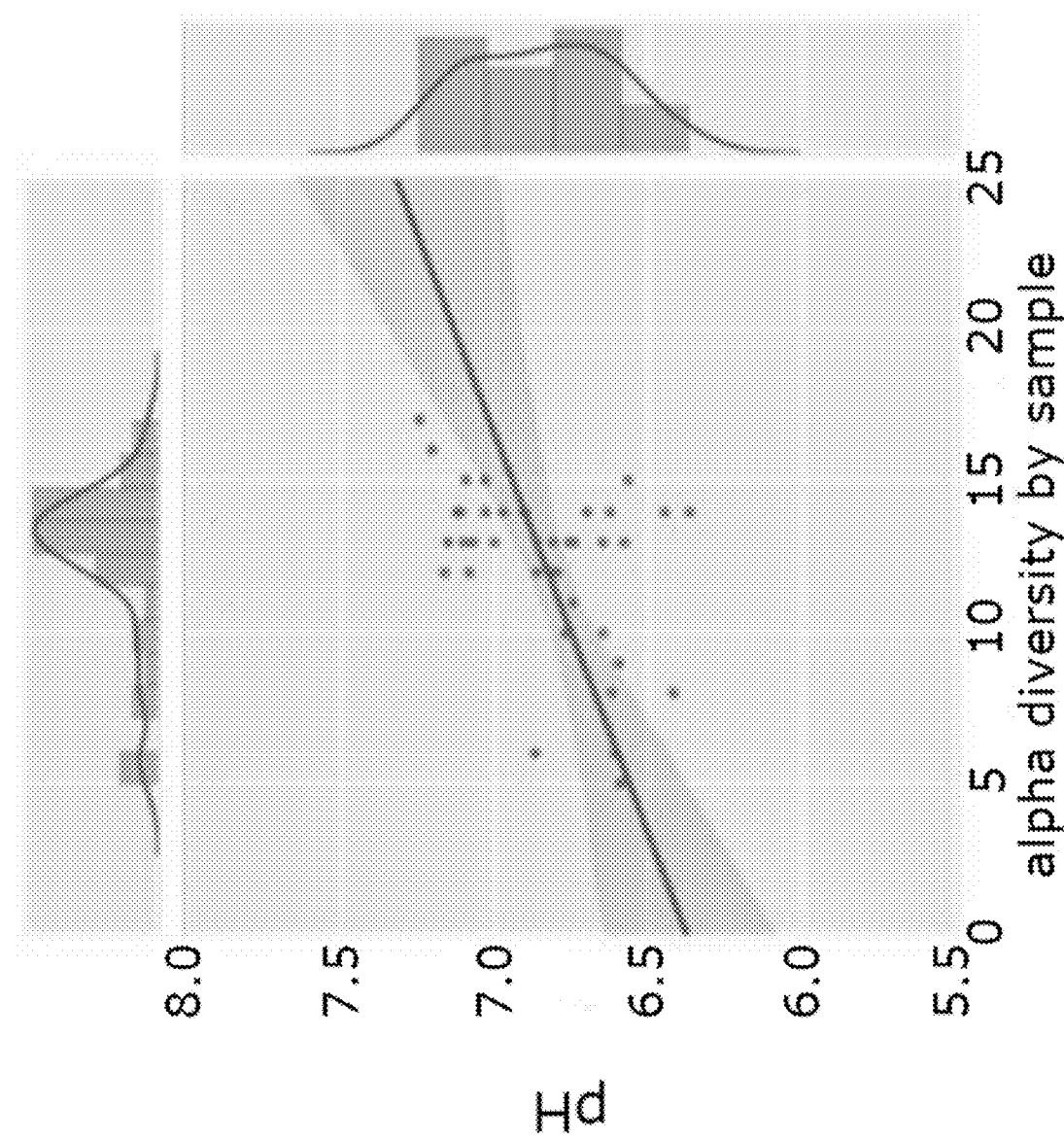
FIG. 18A and FIG. 18B depicts the microbial differentiation over pH between animals on week 5 following the large microbial succession in the rumen on week 4. Rumen alpha-diversity correlated with pH (Pearson R=0.44; P=0.0051) (FIG. 18A). Rumen pH is predictive of bacterial community structure at week 5 ($R^2$=0.48; P=0.04) (FIG. 18B). PC=Principle Component.
Figure 18B:
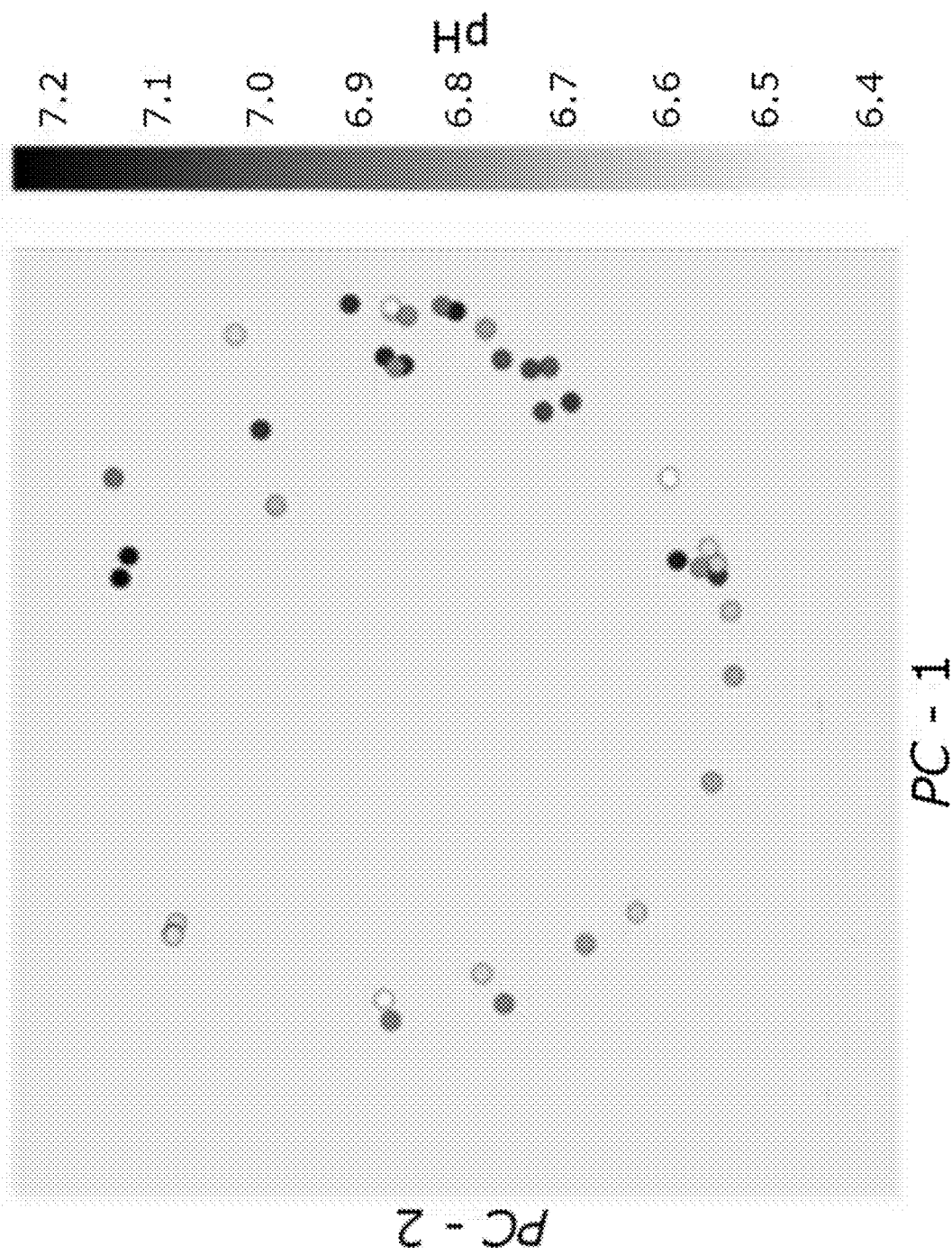
Figure 19:
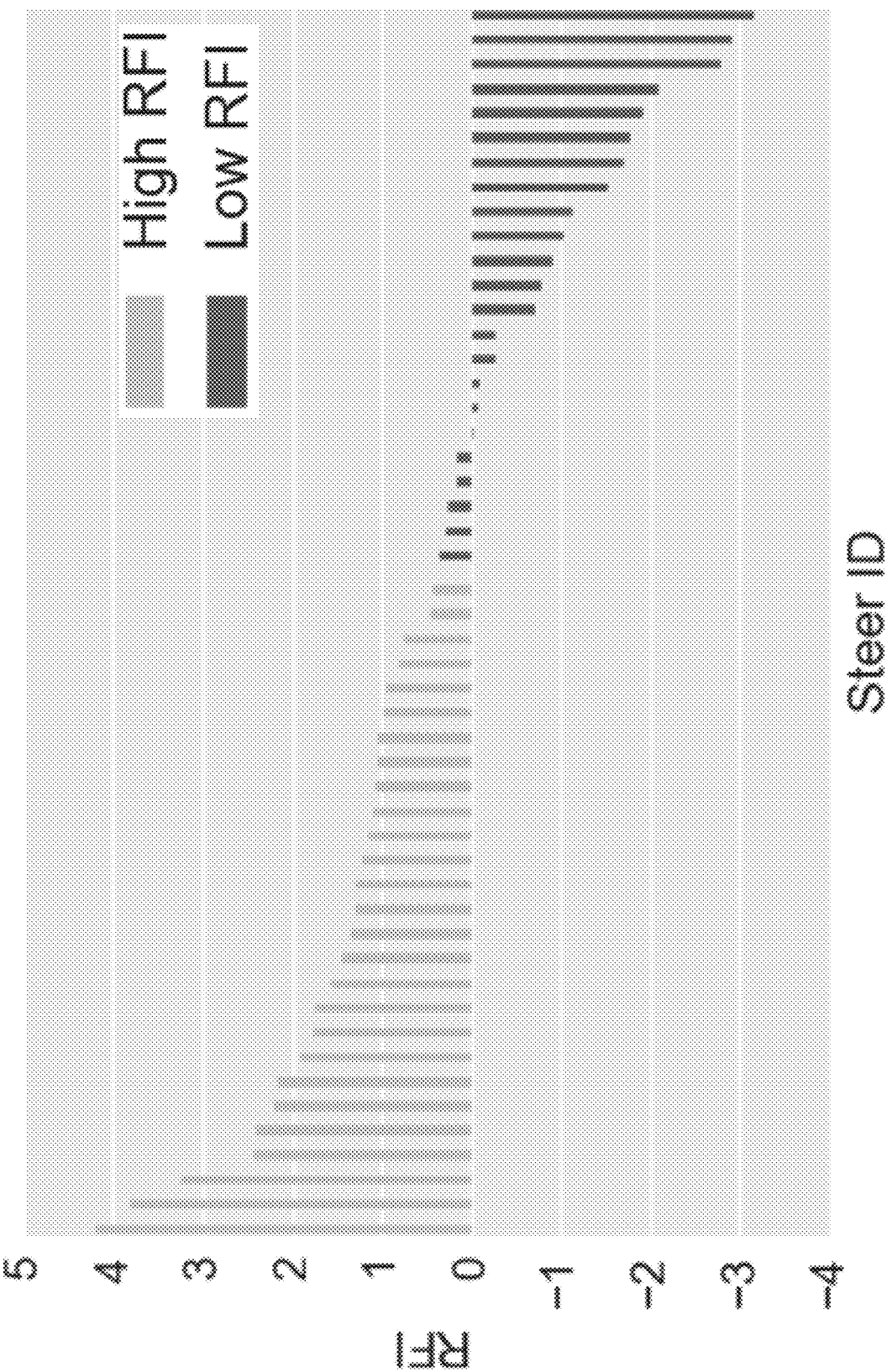
FIG. 19 depicts the plot of the residual feed intake (RFI) of the 50 steers.
Figure 20:
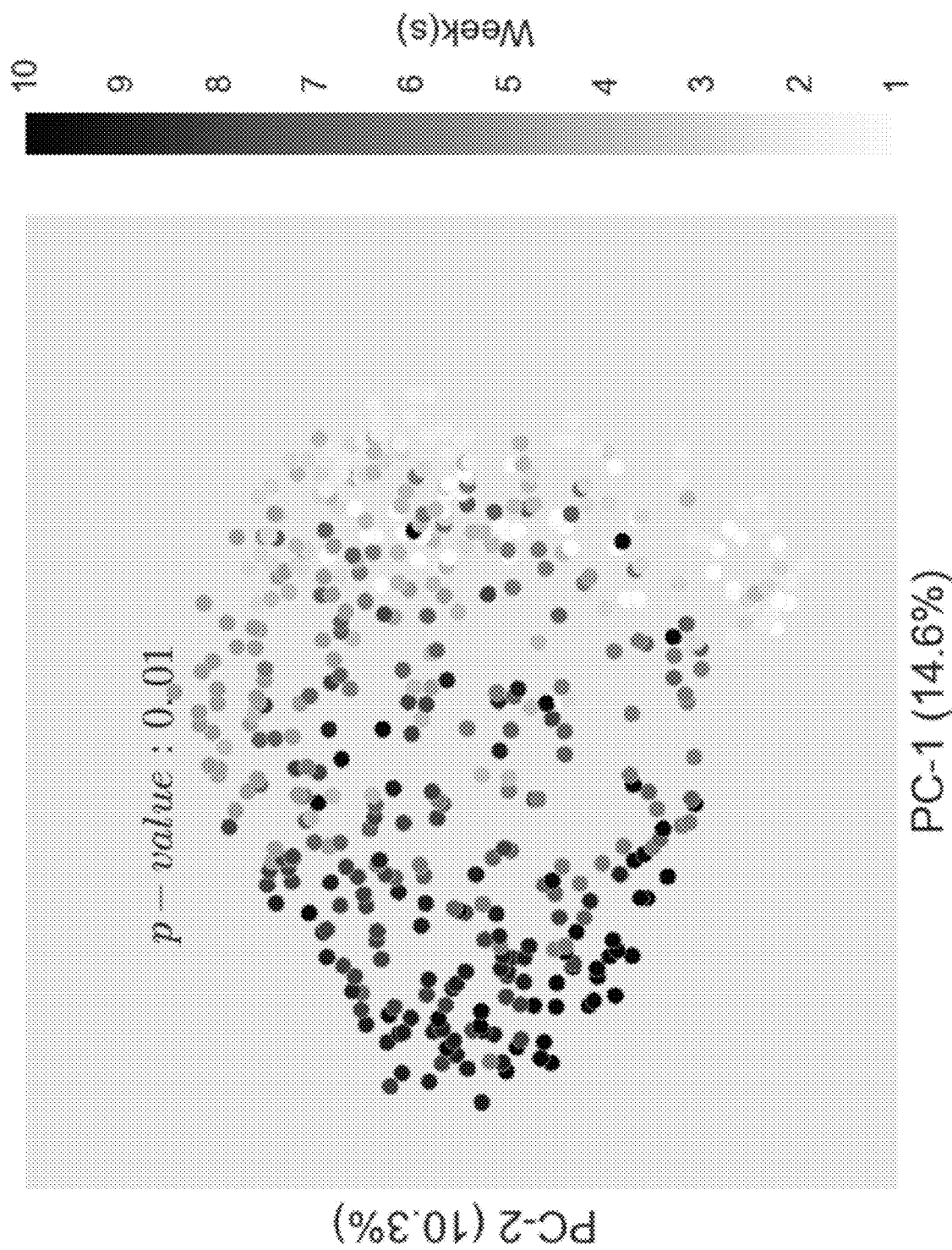
FIG. 20 depicts a principal coordinate analysis (PCoA) of all samples throughout the study. Each dot represents a rumen sample's bacterial community, and the distance between dots represents the difference between those communities. The shading of each dot represents the time in weeks when the sample was taken.
Figure 21:
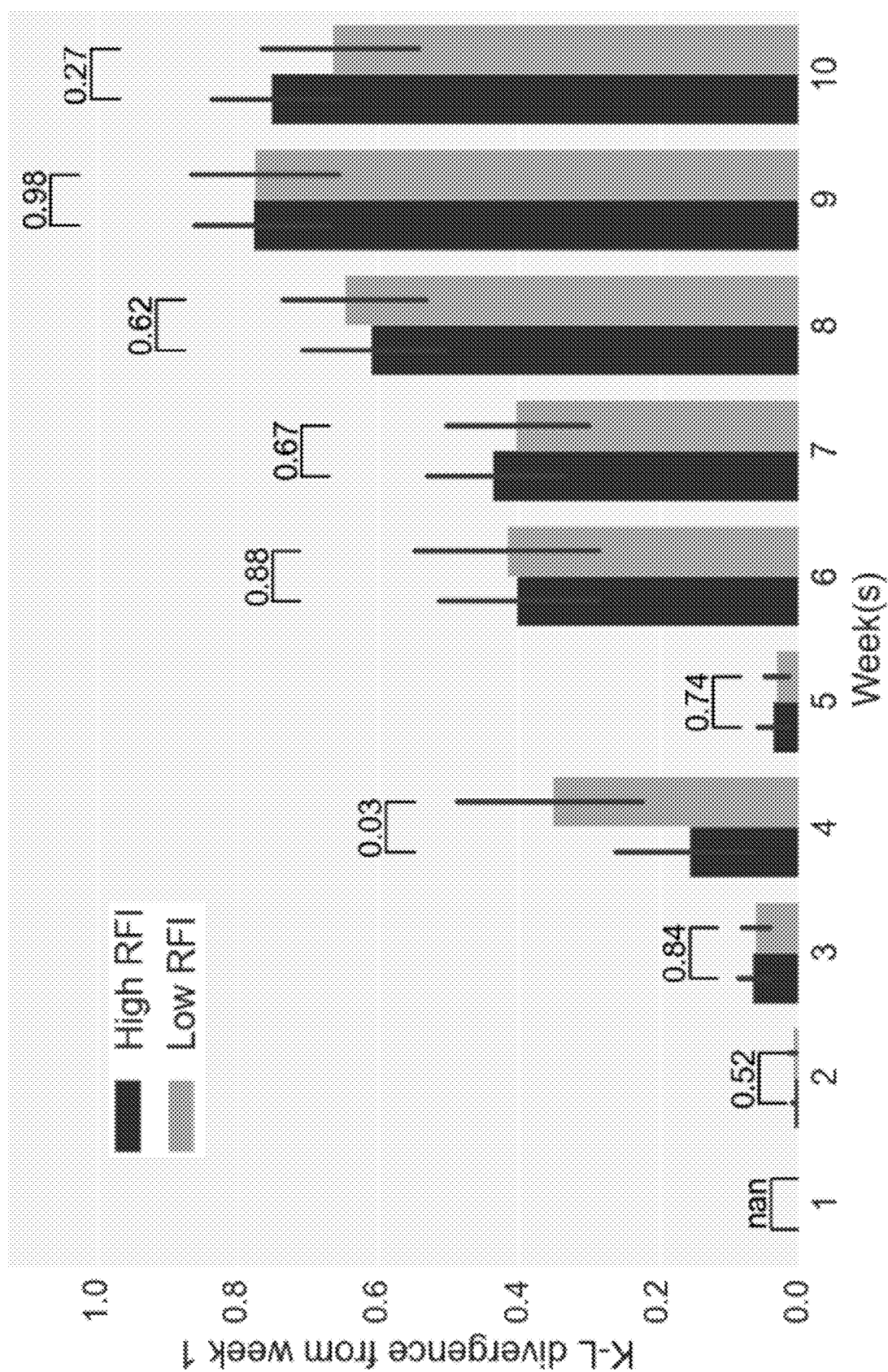
FIG. 21 depicts a Kullback-Leibler (K-L) divergence. The K-L divergence is a method for determining the commotional distance between two sets (i.e., difference between two sample's microbial communities).
Figure 22:
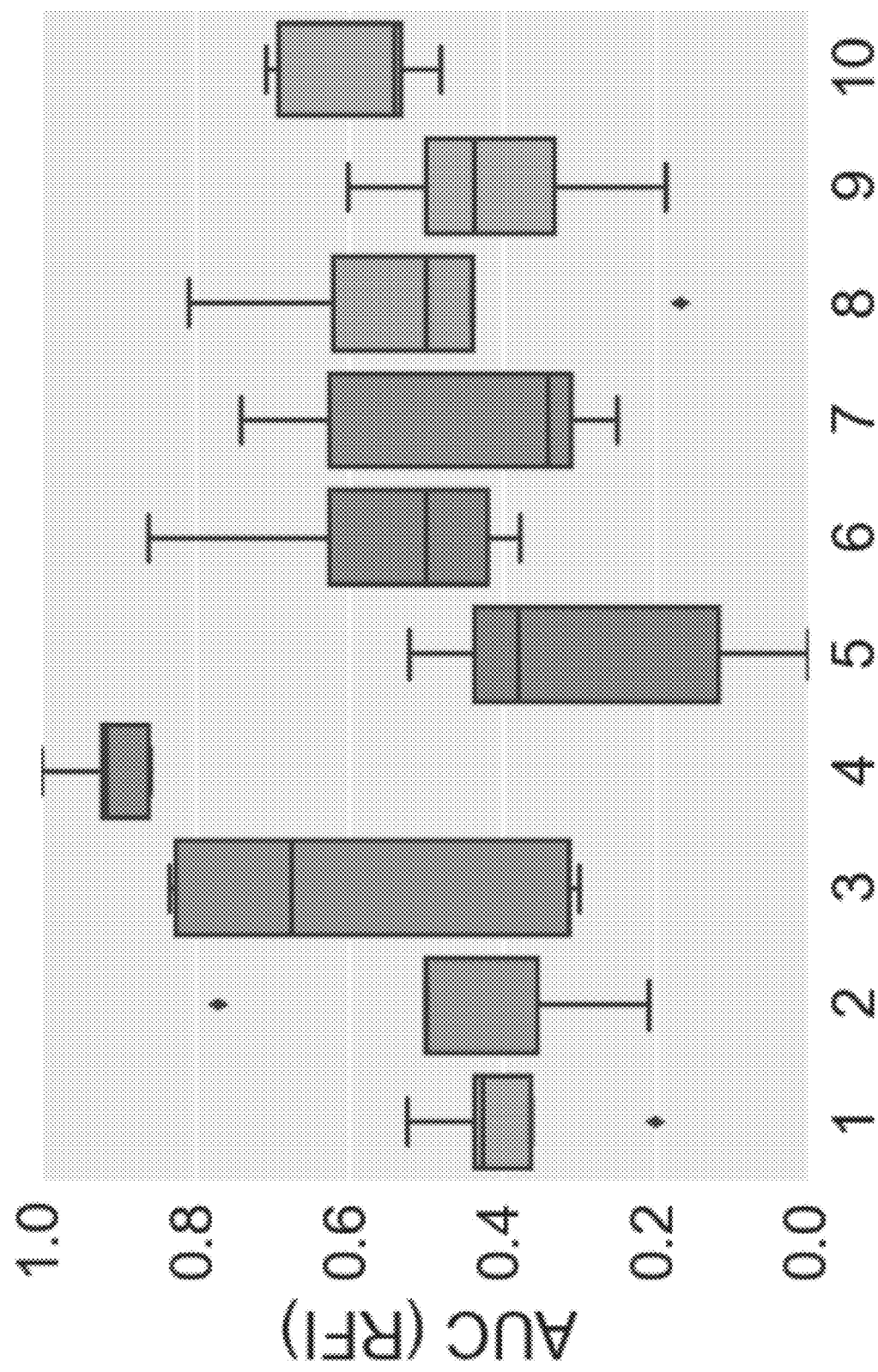
FIG. 22 depicts the AUC for the residual feed intake. Random Forests machine learning was used to predict the RFI on any given week given the microbial community composition. The microbial community is most predictive of RFI at week four.
Figure 23:
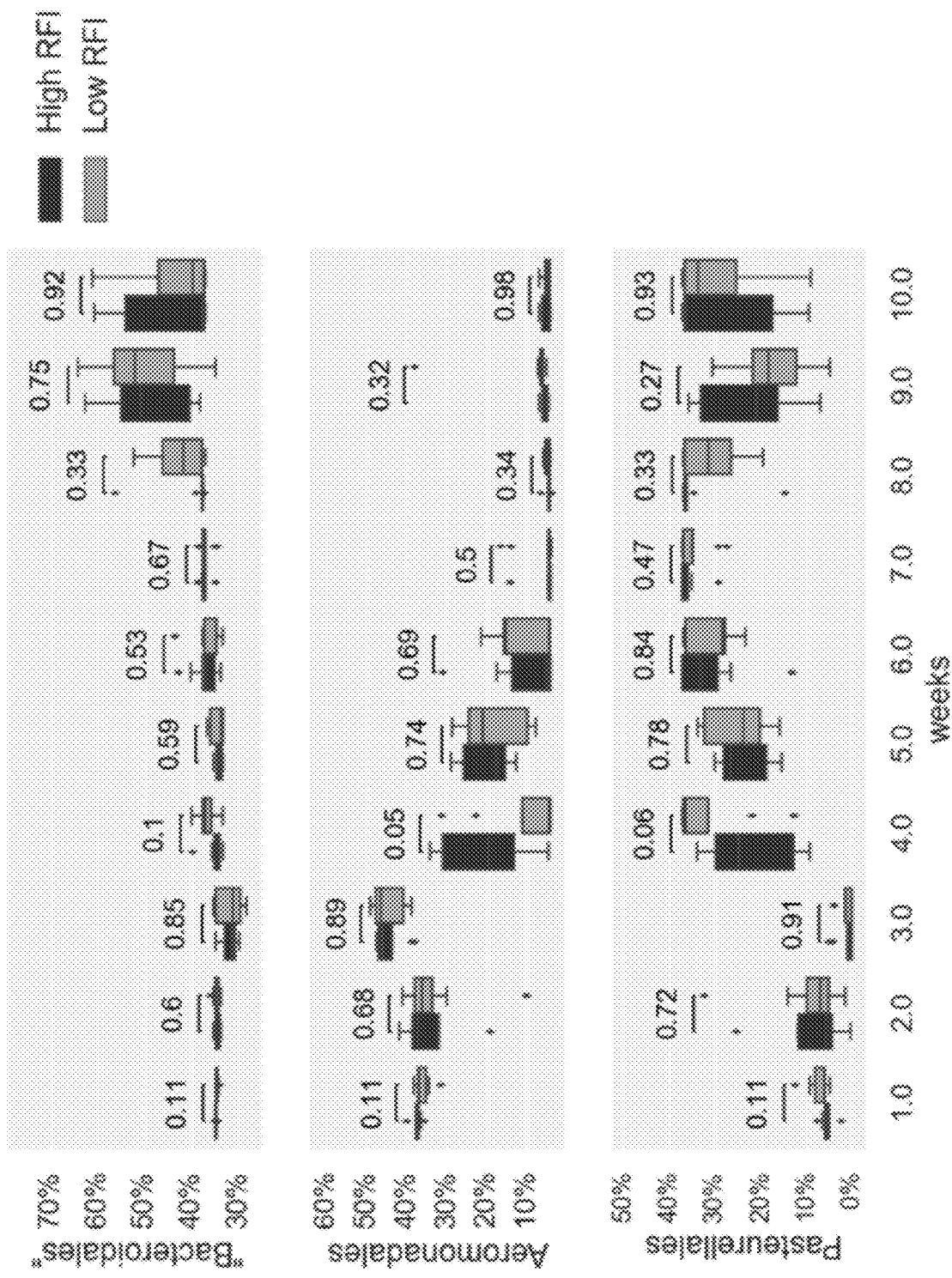
FIG. 23 depicts the abundance of three taxonomic orders by week separated by RFI, which indicates the taxa that are having a direct correlation with RFI and at what time. The figure shows that week four is important for Aeromonadales and Pasteurellales populations in relation to RFI.
Figure 24:
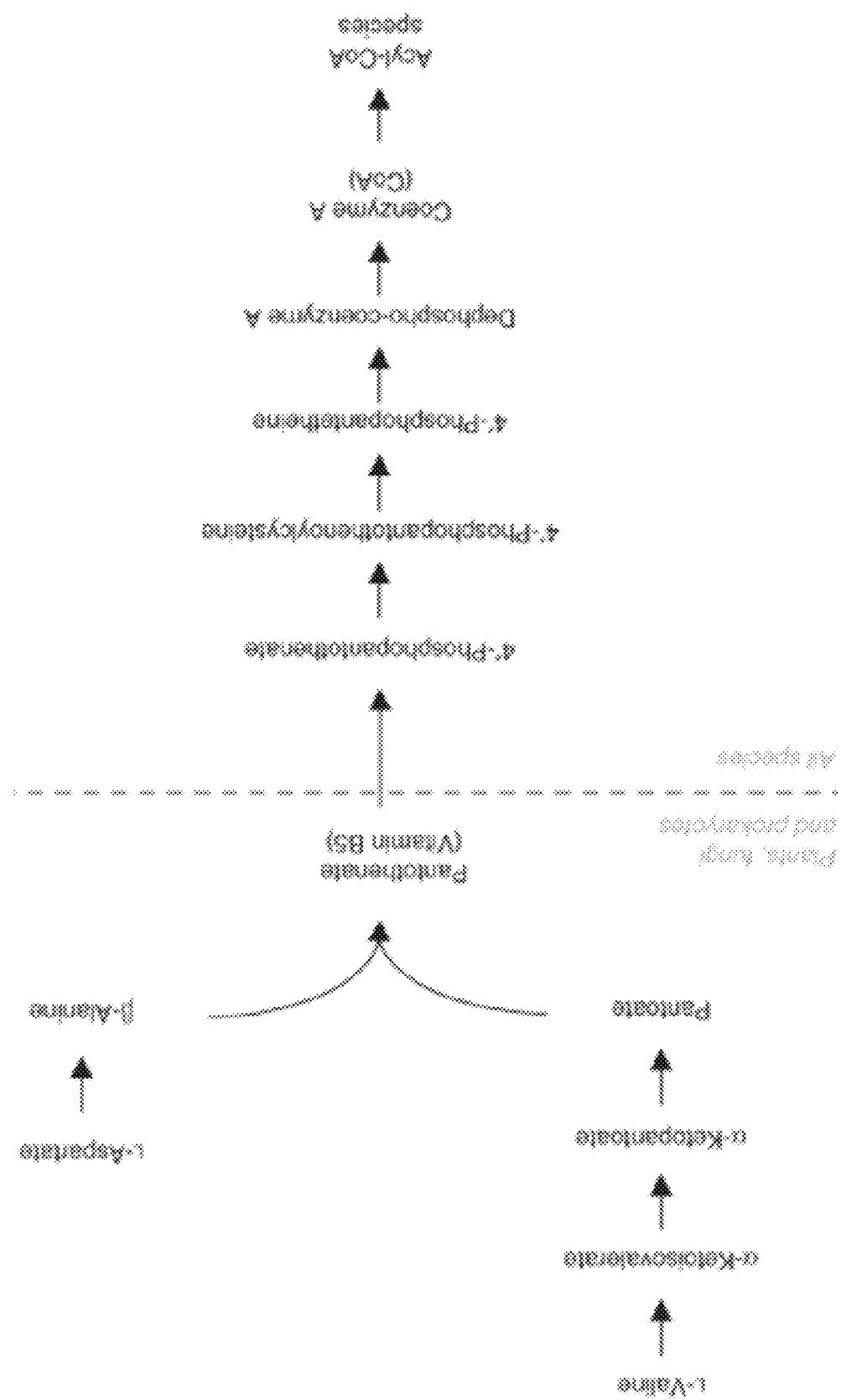
FIG. 24 depicts a flow chart for the synthesis of Vitamin B or pantothenate, and the intermediate products produced to arrive at Acyl-CoA species. Reproduced from Basu and Blair. 2012. Nature Protocols. 7:1-11.

FIG. 17 indicates that many $CO_2$ related microbes become abundant throughout the survey experiment. Many Clostridia, *Prevotella* (Bacteroidales), and other acetogens utilize $CO_2$ and hydrogen to produce acetate.

Example VI. Acidosis Challenge

Sixteen heifers are cannulated, eight controls and eight experimental. The experimental group is to receive six types of rumen microbes directly administered to the rumen daily.

The treatments are run as a 2×2 cross-over design with two 28 day periods. There are 4-6 weeks for adaptation/step up. A 28 day acidosis challenge uses elevates step-up concentrations in the diet. There is a fourteen day covariate between the periods.

The ruminal pH is measured daily using an eCow eBolus. The rumen content is sampled. 10 mL of venous blood is sampled for oximetry. The weight, contractions of the rumen, and intakes are sampled. The rumen samples are assayed for microbial analysis, VFA analysis, and $dCO_2$.

The diet is as follows:

| Item, % of DM | Control Diet | Acidosis Challenge |
| --- | --- | --- |
| Dry-rolled corn | 66 | 74 |
| Dried distiller's grains | 20 | 20 |
| Corn silage | 10 | 2 |
| Premix | 4 | 4 |

The heifers that received microbes daily are expected to tolerate the acidosis challenge more adeptly than heifers not administered the microbes. The heifers that received the microbes are expected to exhibit (1) a higher ruminal and/or systemic pH during the challenge, (2) lower concentrations of ruminal carbon dioxide, (3) increased feed intake (more consistent intake and greater number of pounds of feed eaten, (4) greater average daily weight gain, and (5) greater final weight; as compared to heifers not having been administered the microbes.

Example VII. Effects of Native Rumen Microorganism Supplementation on the Ability of Heifers to Tolerate High-Grain Diets Experimental Design: Sixteen heifers were cannulated and blocked into two different groups: 8 control animals, and 8 experimental animals. The experimental group received live cells of six different rumen bacterial strains: Ascusbbf_24302, Ascusbbf_4, Ascusbbf_14146, Ascusbbf_154, Ascusbbf_1085, and Ascusbbf_876. Fresh cultures of each strain were prepared, and whole cells suspended in saline were directly administered to the rumen via cannula daily at a dose of 1E9 cells/strain/dose. Control animals received an equivalent volume of saline daily via cannula.

The ruminal pH was measured daily using an eCow eBolus. Animal weight was measured weekly and feed intakes were measured daily. Rumen content was sampled weekly to determine concentrations of VFAs and carbon dioxide in the rumen, and to determine colonization of administered strains. Venous blood was sampled for oximetry.

Animals were stepped up to the final ration diet over 4 weeks, using 4 intermediate step-up diets that gradually replaced corn silage with dry-rolled corn. The first two weeks (first two step up diets) were used to create a baseline for blocking the animals. After these two weeks, the animals were assigned into either the experimental or control group. Microbe administration began on day 14 and continued until day 35 (21 days of microbe administration).

The diet is as follows:

| Item, % of DM | Final ration |
| --- | --- |
| Dry-rolled corn | 66 |
| Dried distiller's grains | 20 |
| Corn silage | 10 |
| Premix | 4 |

The diet also included a small amount of premix to add micronutrients, Rumensin, and Tylosin.

Figure 26:
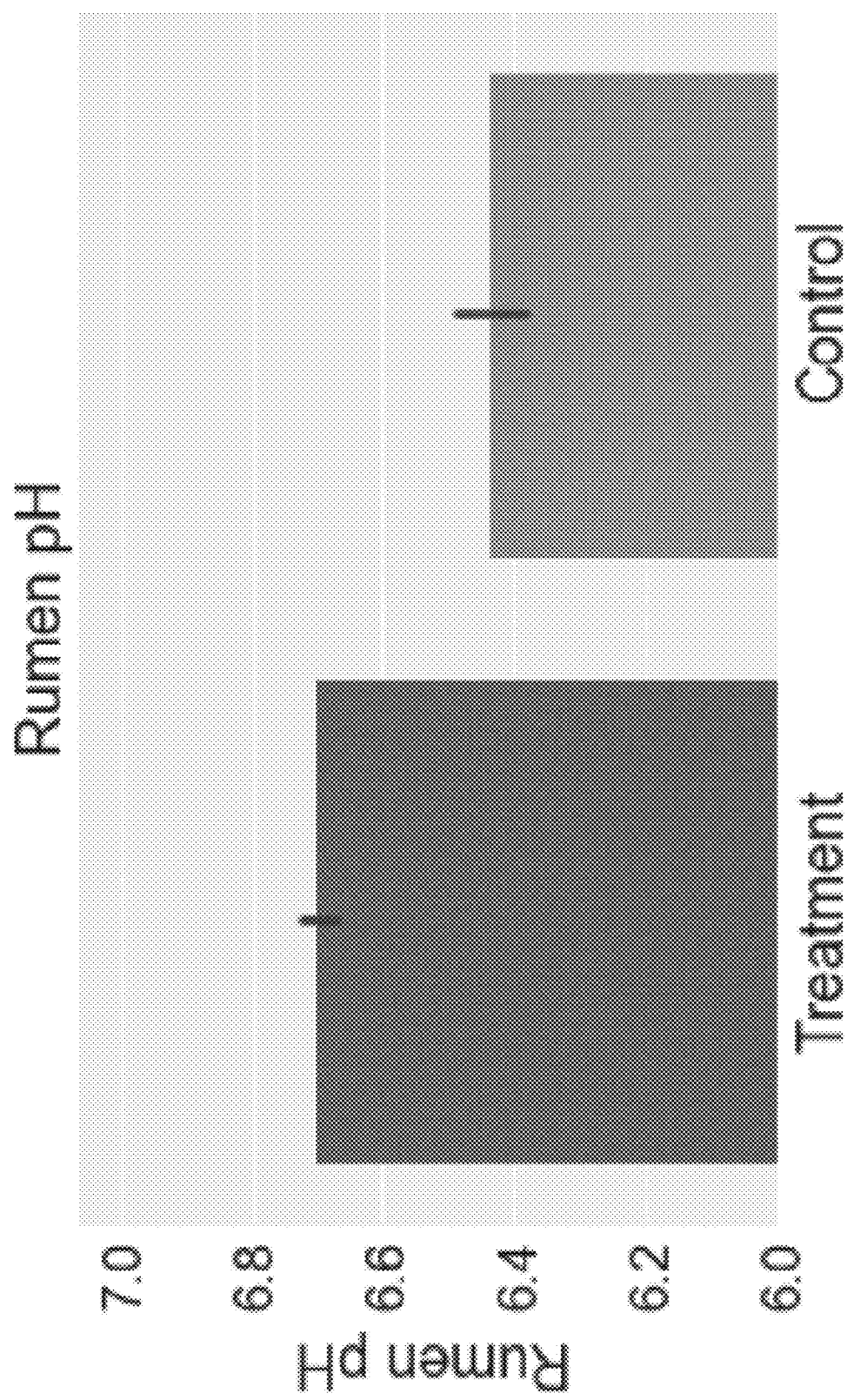
FIG. 26 depicts the evaluation of the microbes of the present disclosure and their ability to modulate pH in the rumen, particularly the ability to increase the pH in the rumen while the animal is being fed a high grain diet.
Figure 27:
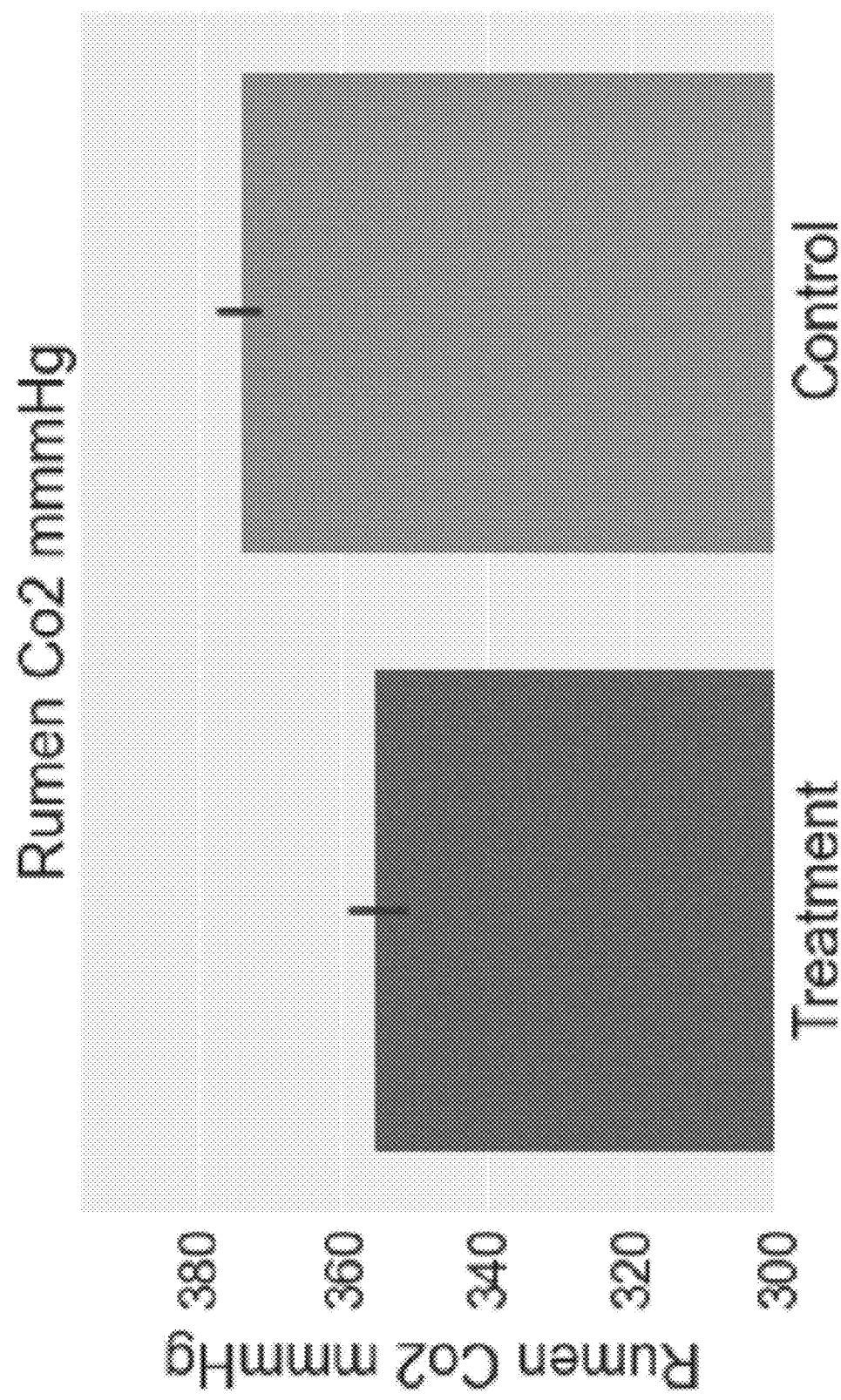
FIG. 27 depicts the evaluation of the microbes of the present disclosure and their ability to decrease $CO_2$ in the rumen.
Figure 28:
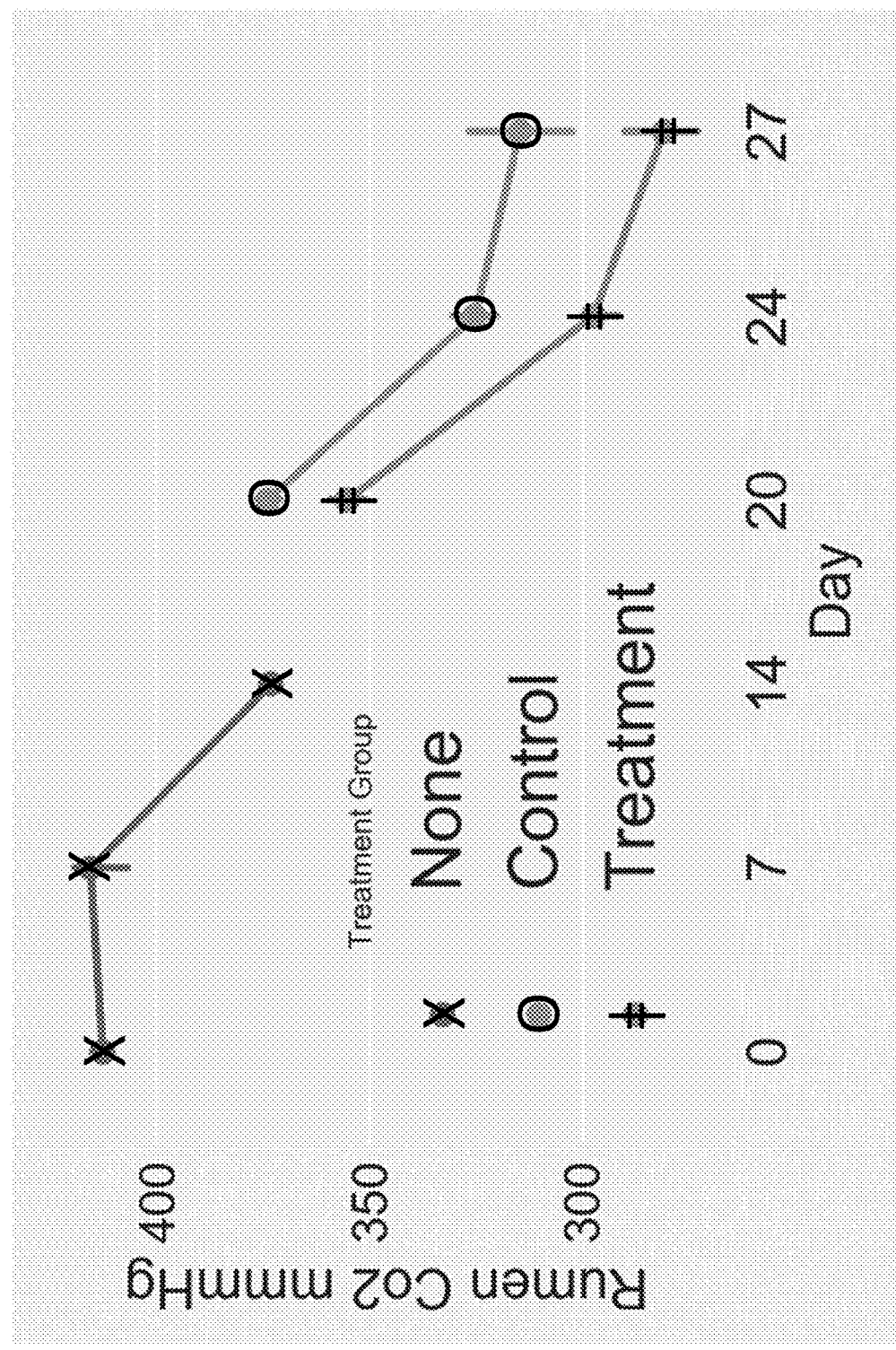
FIG. 28 depicts the evaluation of the microbes of the present disclosure and their ability to modulate $CO_2$ in the rumen, particularly the ability to decrease $CO_2$ in the rumen while the animal is being fed a high grain diet.

Results:

Administration of microbes to heifers had a clear impact on the performance of the animal. Animals that received microbes exhibited higher final weights (FIG. 25), and higher rumen pH (FIG. 26) by day 35 of the experiment. Experimental animals also showed lower concentrations of rumen $CO_2$ (FIG. 227) as compared to control animals. As can be seen from FIG. 28, although rumen $CO_2$ concentrations dropped in both groups, $CO_2$ concentrations in the experimental group dropped more rapidly than the control group.

Example VIII. Carbon Fixation Pathways

The whole genomes of ten microbial strains were sequenced, annotated, and analyzed for carbon fixation-related genes.

The reductive citric acid cycle is used by some bacteria to produce carbon compounds from carbon dioxide and water. The cycle contains three critical enzymes in the pathway: 2-oxoglutarate/2-oxoacid ferredoxin oxidoreductase (EC 1.2.7.3), ATP citrate ligase (EC 2.3.3.8), and fumarate reductase (EC 1.3.4.5, 1.3.5.1, 1.3.1.6, and 1.3.4.1 in KEGG carbon fixation pathways). Ascusbbf_1010 and Ascusbbf_14146 contain EC 1.3.5.1. Furthermore, Ascusbbf_14146 and Ascusbbf_154 contain EC 1.3.5.4.

Figure 30:
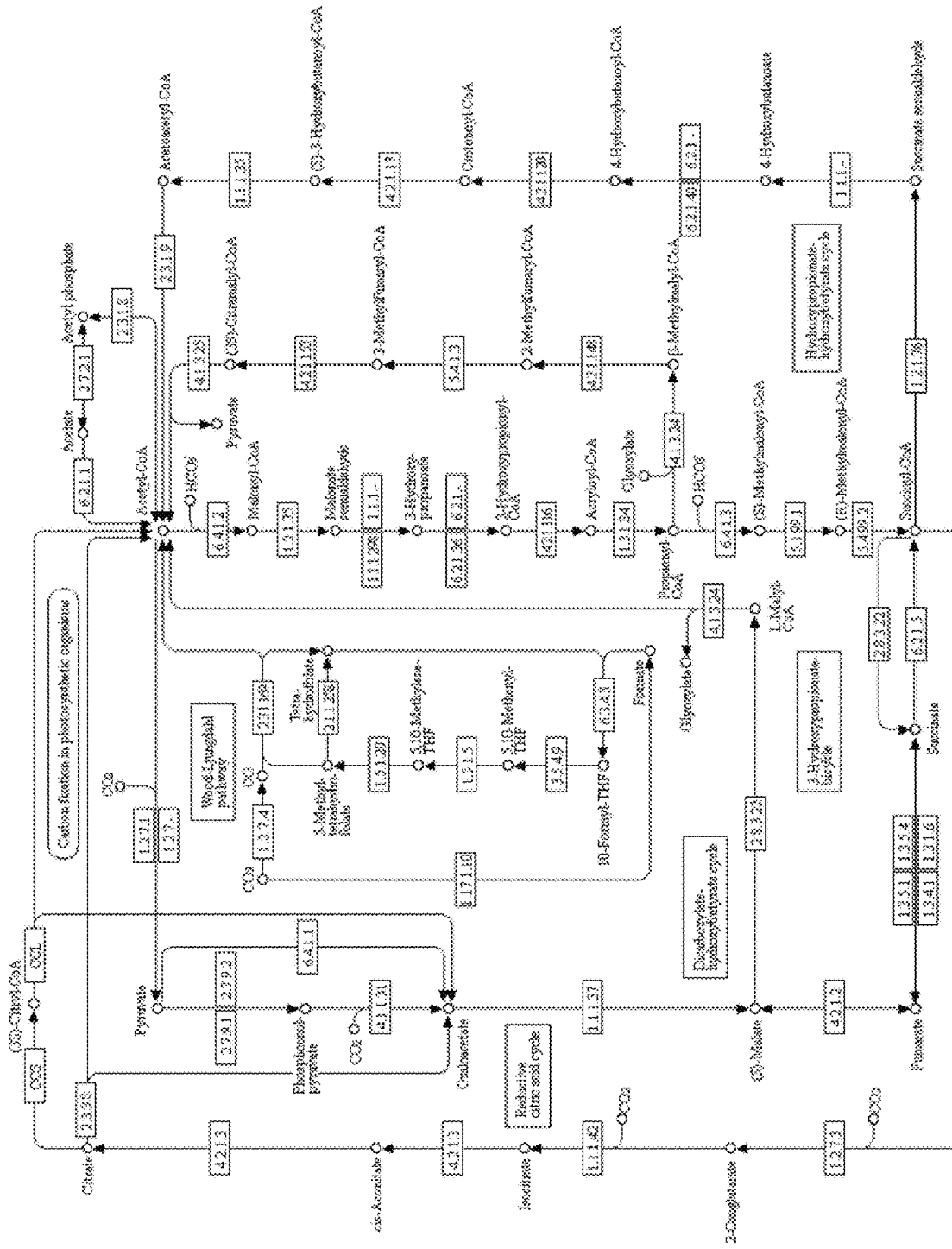
FIG. 30 depicts the KEGG carbon dioxide fixation pathways in prokaryotes.

The Wood-Ljungdahl pathway, also known as the reductive acetyl-coenzyme A pathway enables some bacteria to utilize hydrogen as an electron donor and carbon dioxide as an electron acceptor and as a building block for biosynthesis. The pathway contains three critical enzymes: carbon-monoxide dehydrogenase (EC 1.2.7.4), acetyl-CoA synthase (EC 2.3.1.169), and formate dehydrogenase (EC 1.71.1.10 KEGG and 1.2.1.43 PATRIC). Ascusbbf_1085 and Ascusbbf_876 both contain 1.2.7.4 and 2.3.1.169. See FIG. 30.

Figure 31:
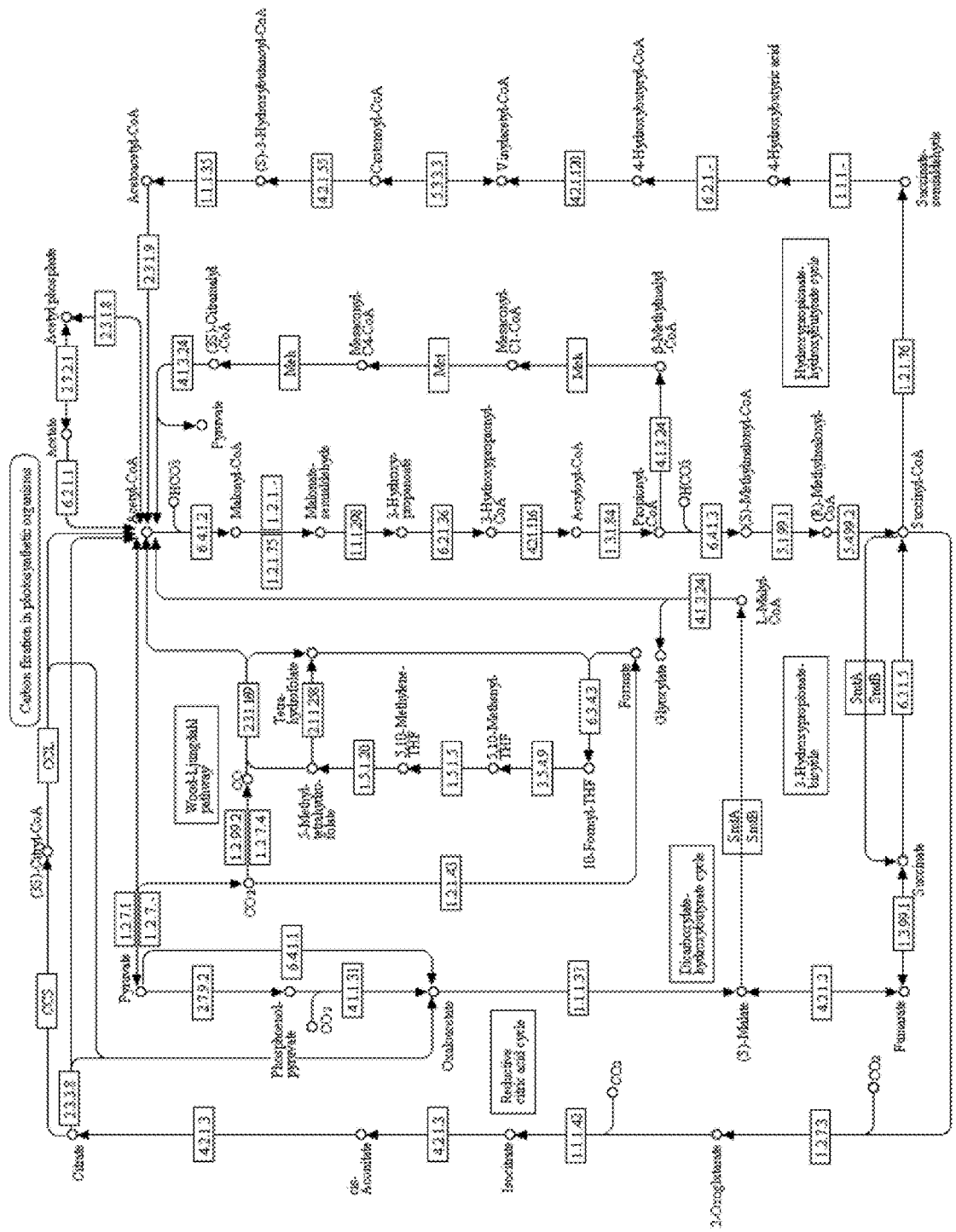
FIG. 31 depicts the PATRIC carbon dioxide fixation pathways in prokaryotes.

The Hydroxypropionate-hydroxybutyrate cycle contains three critical enzymes: succinyl-CoA reductase (EC 1.2.1.76), acetyl-CoA C-acetyltransferase (2.3.1.9), and MalCoA lyase (4.1.3.25 KEGG and 4.1.3.24 PATRIC). The ten sequenced genomes did not contain 1.2.1.76, 4.1.3.25 KEGG, or 4.1.3.24 PATRIC, so it is unlikely that the strains are utilizing this pathway. See FIG. 31.

Several genomes suggested that the strains may be fixing carbon dioxide in conjunction with a carbohydrate, such as glucose. The strains may be fixing carbon during the conversion of: acetyl-CoA+$CO_2$+2 reduced ferredoxin+ $2H^+ \rightarrow$ pyruvate+CoA=2 oxidized ferredoxin.

Example IX. Mode of Action—Highly Fermentable Diet Tolerance in Ruminants

The rumen is a specialized stomach dedicated to the digestion of feed components in ruminants. A diverse microbial population inhabits the rumen, where their primary function revolves around converting the fibrous and non-fibrous carbohydrate components into useable sources of energy and protein (FIG. 3). In typical commercial ruminant diets, cellulose and other plant-related structural carbohydrates (e.g. hemicellulose, pectin, lignin, etc.) are one component of the feed ration. This portion of the ration is considered indigestible by mammals' native metabolism, and must be degraded by microorganisms inhabiting the rumen. The cellulolytic microbes in the rumen leverage extensive enzymatic activity in order break these molecules down into simple sugars and volatile fatty acids. This enzymatic activity is critical to the extraction of energy from feed, and more efficient degradation ultimately provides more energy to the animal. The soluble sugars found in the non-fibrous portion of the feed are also fermented into gases and volatile fatty acids such as butyrate, propionate, and acetate. Volatile fatty acids arising from the digestion of both the fibrous and non-fibrous components of feed are ultimately the main source of energy of the ruminant.

In a feedlot setting, ruminants receive a diet with much higher levels of concentrate and readily digestible soluble sugars to increase weight gain of the animal more rapidly. Because of the highly fermentable nature of the feed, the physiology of the rumen microbial metabolism shifts dramatically (as compared to the rumen microbial metabolism of an animal on a more balanced diet), creating many health issues for the host animal. High levels of fermentation will increase the build-up of fermentation by-products. These by-products include various acids (e.g. lactic acid, volatile fatty acids, succinic acid, citric acid, etc.), alcohols (e.g. ethanol, propanol, etc.) and gases (e.g. hydrogen, carbon dioxide, methane, hydrogen sulfide, etc.).

Accumulation of these by-products in the rumen can lead to: acidosis, bloat, panting, abomasal dysplasia, reduced buffering capacity in the rumen, leaky gut, increased permeability of the gastrointestinal lining, increased histamine and LPS production, respiratory acidosis, metabolic acidosis, laminitis, ketosis, liver disease, and liver abscesses. Microorganisms strains used as products may be utilizing a variety of metabolic and physiological processes to maintain a more healthy rumen state in the host animal. These microbes ultimately counter the increased fermentation and accompanying physiological side effects. The function of microorganisms in the animals that are most productive/most tolerant of a highly fermentable diet in a feedlot setting encourage one or more of the following:

Reduction or Sequestration of Carbon Dioxide Due to Excess Fermentation within the Rumen.

Microorganisms leverage a variety of different pathways to utilize bicarbonate produced by the animal and carbon dioxide produced from fermentation within the rumen. Carbon fixation pathways include the Calvin cycle, Wood-Ljundahl Pathway, Reductive TCA cycle, and variations thereof.

Reduction of the Methanogen Population within the Rumen.

Hydrogenotrophic methanogens convert $CO_2$ and hydrogen to methane, which is subsequently lost to the environment due to cattle flatulence. Microbial strains that compete with methanogens and convert $CO_2$ into a form usable by the animal (e.g. acetate) maximize the amount of energy assimilated by the animal.

Increase Production of Volatile Fatty Acids.

Volatile fatty acids are the primary energy source for ruminants. More efficient animals tend of have higher concentrations of these acids in their rumen. Although overall acid production increases due to the increased amount of fermentation, biasing acid production towards energetically useful acids for the animal promotes productivity.

Increase De Novo Synthesis/Provide Vitamin B, K, and Other Relevant Vitamins as a Prebiotic.

Due to the severe composition shift of the rumen microbial community, vitamins typically synthesized by the microbial community may be insufficient for both animal and microbial nutritional requirements.

Reduction of Alpha Diversity in the Rumen Microbiome.

More efficient animals have lower numbers of microbial species in their rumen microbial population.

Addition of the appropriate microbial strains as a product can ameliorate the effects of rapid rumen microbial fermentation and by-product accumulation, ultimately enhancing the productivity and health of the ruminant. Potential product microorganisms were assayed in vitro for their ability to degrade various carbohydrates, and to identify the acids produced from the degradation of these carbohydrates. (See Example XII and corresponding table). Genomic information was also mined to identify the strains' metabolic potential to fix $CO_2$ and synthesize various vitamins.

Example X. Comparative Analysis of MIC Scores from Published Work of Other Groups Utilizing Ascus Biosciences' technology, the performance of currently available microbial feed additive products was predicted.

Figure 29:
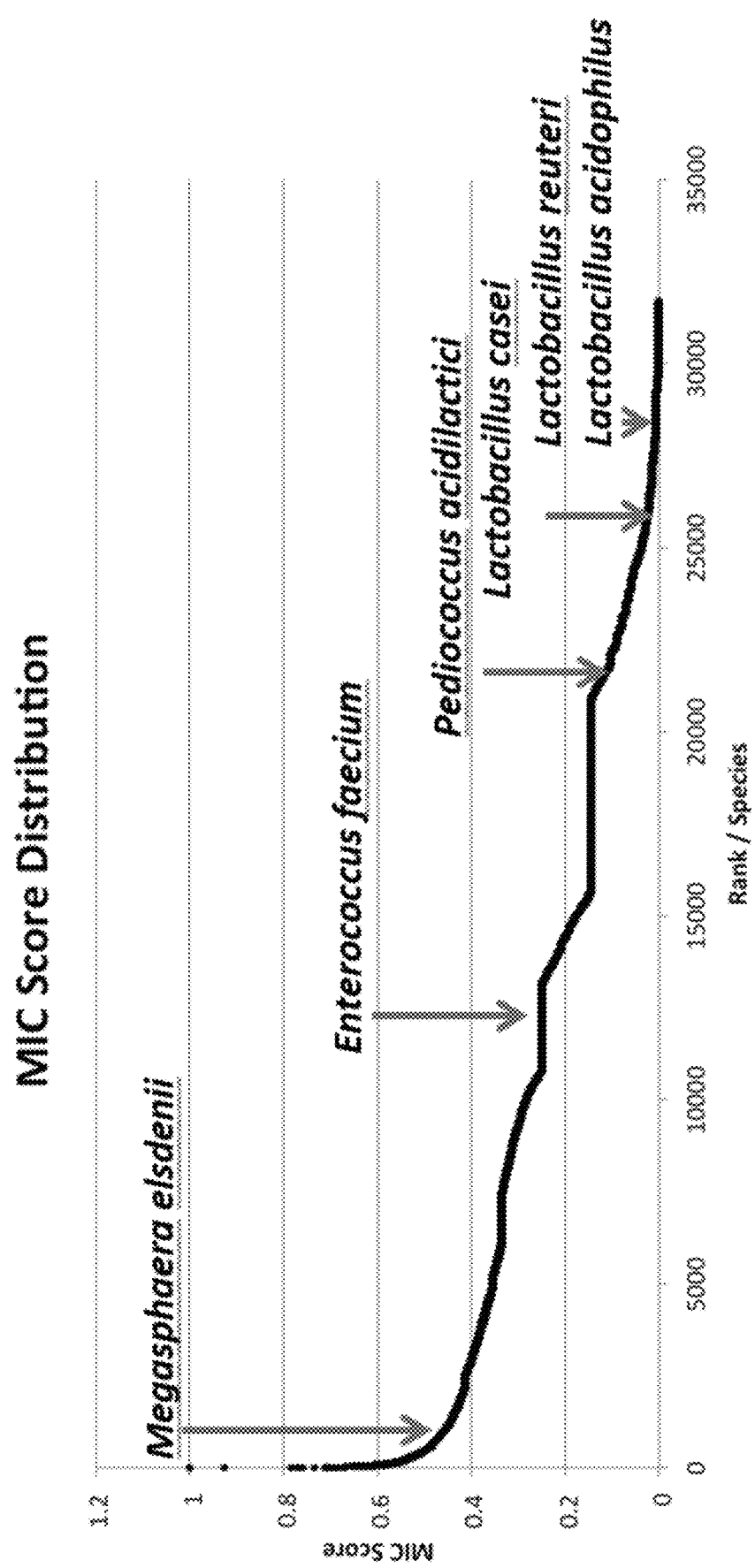
FIG. 29 depicts the MIC score distribution for common performance parameters including average daily weight gain, weight gain, feed intake, and feed efficiency with six species of bacteria, in which many of the species have been evaluated in 3$^{rd}$ party studies. The lower the MIC score, the less likely the species/strains associated with that MIC score are capable of positively modulating the aforementioned performance parameters.

Direct-fed microbial products that claim to enhance cattle performance and prevent acidosis are available on the market. A few of these products contain microorganism strains that are native rumen microorganisms (*Megasphaera elsdenii*), or are within 97% sequence similarity of native rumen microorganisms. Here, we've identified the species that are used in these products, and determined their platform score with respect to common performance parameters: average daily gain, weight gain, feed intake, and feed efficiency (FIG. 29). As can be seen from the curve, all but one of the currently available strains fall below the threshold (~0.4) used to define "useful" and "non-useful" strains. The one strain above the cutoff, *Megasphaera elsdenii*, has shown a positive effect in a few studies. Other common strains used in direct fed microbial products, such as *Lactobacillus animalis* and *Propionibacterium freudenreichii*, were not similar to any native rumen microorganisms. Thus, scores could not be generated for these microorganisms.

*Lactobacillus casei*: MIC 0.04587

No Change in Performance During Finishing.

Impact of a mixed culture of *Lactobacillus casei* and *L. lactis* on in vitro ruminal fermentation and the growth of feedlot steers fed barley-based diets. Baah et al. 2009.

*Megasphaera elsdenii*: MIC 0.54494

Small Increase in Hot Carcass Weight.

*M. elsdenii* on the performance of steers adapting to a high-concentrate diet, using three or five transition diets. Drouillard et al. 2012.

Higher Rumen pH after Carbohydrate Challenge.

The effects of dosing feedlot cattle with *M. elsdenii* strain NCIMB 41125 prior to the introduction of a grain-rich diet. McDaniel et al. 2007.

No effect, slight shift of acetate led to propionate production. Rumen pH and fermentation characteristics in dairy cows supplemented with *M. elsdenii* NCIMB 41125 in early lactation. Aikman et al. 2011.

Higher Feed Intakes and Improved ADG.

Effect of ruminal administration of the lactate-utilizing strain *M. elsdenii* MCIMB 41125 on abrupt or gradual transition from forage to concentrate diets. Henning et al. 2010.

Higher Carcass Weights when Used with 30 kg/Ton Roughage Diet.

Effects of virginiamycin and monensin administered alone or together with *M. elsdenii* strain NCIMB 41125 on in vitro production of lactate and VFA and the effects of monensin and *M. elsdenii* strain NCIMB 41125 on health and performance of feedlot steers. Leeuw et al. 2015.

*Lactobacillus acidophilus*: MIC 0.04839

No Change in Performance, but May Decrease *E. coli* Levels.

Prevalence of *Escherichia coli* O157:H7 and Performance by Beef Feedlot Cattle Given *Lactobacillus* Direct-Fed Microbials. Brashears et al. 2003.

Slightly Improved Overall Gain—127 kg to 130 kg (2.3%).

Performance and carcass characteristics of commercial feedlot cattle from a study of vaccine and direct-fed microbial effects on *Escherichia coli* O157:H7 fecal shedding. Cull et al. 2015.

No Effect on Performance.

Direct-fed microbials containing lactate-producing bacteria influence ruminal fermentation but not lactate utilization in steers fed a high-concentrate diet. Kenney et al. 2015.

No Effect.

Effect of Direct-Fed Microbial Dosage on the Fecal Concentrations of Enterohemorrhagic *Escherichia coli* in Feedlot Cattle. Luedtke et al. 2016.

No Effect on Performance.

Effect of *Lactobacillus acidophilus* Strain NP51 on *Escherichia coli* O157:H7 Fecal Shedding and Finishing Performance in Beef Feedlot Cattle. Peterson et al. 2007.

No Effect.

Evaluation of *Lactobacillus* Fermentation Cultures in Calf Feeding Systems. Higginbotham et al. 1992.

*Pediococcus acidilactici*: MIC 0.14609

No Effect on Performance.

Direct-fed microbials containing lactate-producing bacteria influence ruminal fermentation but not lactate utilization in steers fed a high-concentrate diet. Kenney et al. 2015.

*Enterococcus faecium*: MIC 0.37215

No Effect on Acidosis/Tolerance of High Grain Diet.

Effects of bacterial direct-fed microbials and yeast on site and extent of digestion, blood chemistry, and subclinical ruminal acidosis in feedlot cattle. Beauchemin et al. 2003.

No Effect on Ruminal pH, Blood pH, or DMI.

Effects of bacterial direct-fed microbials on ruminal fermentation, blood variables, and the microbial populations of feedlot cattle. Ghorbani et al. 2002.

No Effect on Performance.

Direct-fed microbials containing lactate-producing bacteria influence ruminal fermentation but not lactate utilization in steers fed a high-concentrate diet. Kenney et al. 2015.

*Lactobacillus reuteri*: MIC 0.06366

May Help Reduce *E. coli*, No Mention of Performance Improvements.

*Lactobacillus reuteri* suppresses *E. coli* O157:H7 in bovine ruminal fluid: Toward a pre-slaughter strategy to improve food safety. Bertin et al. 2017.

*Propionibacterium freudenreichii*: MIC not Detected

Slightly Improved Overall Gain—127 kg to 130 kg (2.3%).

Performance and carcass characteristics of commercial feedlot cattle from a study of vaccine and direct-fed microbial effects on *Escherichia coli* O157:H7 fecal shedding. Cull et al. 2015.

No Effect on Performance or Carcass Characteristics.

Effects of live culture of *Lactobacillus acidophilus* (strains NP45 and NP51) and *Propionibacterium freudenreichii* on performance, carcass, and intestinal characteristics, and *Escherichia coli* strain O157 shedding of finishing beef steers. Elam et al. 2013.

No Effect on Ruminal pH, Blood pH, or DMI.

Effects of bacterial direct-fed microbials on ruminal fermentation, blood variables, and the microbial populations of feedlot cattle. Ghorbani et al. 2002.

No Effect on Performance.

Direct-fed microbials containing lactate-producing bacteria influence ruminal fermentation but not lactate utilization in steers fed a high-concentrate diet. Kenney et al. 2015.

No Effect.

Effect of Direct-Fed Microbial Dosage on the Fecal Concentrations of Enterohemorrhagic *Escherichia coli* in Feedlot Cattle. Luedtke et al. 2016.

No Effect on Performance.

Effects of increasing dose of live cultures of *Lactobacillus acidophilus* (Strain NP 51) combined with a single dose of *Propionibacterium freudenreichii* (Strain NP 24) on performance and carcass characteristics of finishing beef steers. Vasconcelos et al. 2008.

Lactobacillus Animals: MIC not Detected

No Effect on Performance or Carcass Characteristics.

Effects of live culture of Lactobacillus acidophilus (strains NP45 and NP51) and Propionibacterium freudenreichii on performance, carcass, and intestinal characteristics, and Escherichia coli strain O157 shedding of finishing beef steers. Elam et al. 2003. L. acidophilus NP51 has been reclassified as Lactobacillus animalis.

No Effect on Performance.

Effects of increasing dose of live cultures of Lactobacillus acidophilus (Strain NP 51) combined with a single dose of Propionibacterium freudenreichii (Strain NP 24) on performance and carcass characteristics of finishing beef steers. Vasconcelos et al. 2008.

Lactobacillus plantarum: MIC not Detected

No Effect on Performance.

Direct-fed microbials containing lactate-producing bacteria influence ruminal fermentation but not lactate utilization in steers fed a high-concentrate diet. Kenney et al. 2015.

Bacillus subtilis: MIC not Detected

No Effect.

Evaluation of a Direct-Fed Microbial Product Effect on the Prevalence and Load of Escherichia coli 0157:H7 in Feedlot Cattle. Arthur et al. 2010.

Example XI. Beef Enrichment Media Compositions

Kreb's Yeast Lactate Medium

| Component | g/L |
| --- | --- |
| Yeast Extract | 10.0 |
| $NaNO_3$ | 1.7 |
| Sodium Lactate | 46.7 |
| $KH_2PO_4$ | 1 |
| $Na_2HPO_4$ | 2.4 |
| Resazurin | 1 mL |
| Agar/Gelrite/Gellan Gum | 15 |
| DI H2O | 1 L |

Place the above components into a flask 2× larger than the volume being prepared. pH to 6.8-7.0. Autoclave at 121° C. for 15 minutes, liquid cycle. Place in 47° C. for 30 minutes MRS Medium (Originally from BD Difco Lactobacilli MR)

| Component | g/1000 mL |
| --- | --- |
| Proteose Peptone No. 3 | 10.0 |
| Beef Extract | 10.0 |
| Yeast Extract | 5.0 |
| Glucose | 20.0 |
| Tween 80 | 1.0 mL |
| Sodium Acetate | 5.0 |
| Ammonium citrate | 2.0 |
| Magnesium Sulfate | 0.1 |
| Manganese Sulfate | 0.05 |
| Agar | 15.0 |
| L-Cysteine HCl | 0.5 |
| 0.1% Rezasurin | 1.0 mL |
| DI H2O | 1000 mL |

Place the aforementioned components into a flask 2× larger than the volume being prepared. Adjust pH to 6.8 with HCl or NaOH. Autoclave at 121° C. for 15 minutes, liquid cycle.

M2 Salts

| Component | g/L |
| --- | --- |
| $(NH_4)_2SO_4$ | 0.674 |
| $MgSO_4\ 7H_2O$ | 0.035 |
| $K_2HPO_4$ | 0.348 |
| $KH_2PO_4$ | 0.347 |
| 0.1% Resazurin | 1 mL |
| DI $H_2O$ | Up to 1 L |

Place the aforementioned components into a flask 2× larger than the volume being prepared. Adjust pH to 6.8. Place in 47° C. for 30 minutes. Add L-cysteine hydrochloride (100 mM) to liquid media. Sterile filter any additives from the following list to create amended medias.

| Component | Molarity (mM) | g/L |
| --- | --- | --- |
| Fructose | 13.9 | 2.5 |
| Arabinose | 16.7 | 2.5 |
| Cellulose | 7.3 | 2.5 |
| Xylose | 79.9 | 12.0 |
| Maltose | 2.86 | 0.978 |
| Galactose | 13.88 | 2.5 |
| Cellobiose | 10 | 3.42 |
| Ground Corn** | — | 0.5 |
| Sodium Lactate (60% Soln) | 233.8 | 20 mLs |
| Amino Acid Soln 1 | — | 100 mLs |
| Fatty Acid Soln 2 | — | 20 mLs |
| Wolfes Mineral Solution | — | 1.0 mL |

**Add to media before autoclaving

Amino Acid Solution 1 (50 mL)

| Component | Molarity (mM) | g/50 mL |
| --- | --- | --- |
| Glutamine | 100.0 | .731 |
| Glycine | 100.0 | .375 |
| Proline | 100.0 | .576 |
| DI $H_2O$ | — | Up to 50 mL |

Fatty Acid Solution 2 (50 mL)

| Component | 1.1-Molarity (mM) | uL/50 mL |
| --- | --- | --- |
| Propionic Acid | 9.40 | 35.0 |
| Isovaleric Acid | 0.906 | 5.0 |
| Methylbutyric ACid | 0.916 | 5.0 |
| DI $H_2O$ | — | Up to 50 mL |

Wolfe's Mineral Solution

| Component | g/L |
| --- | --- |
| $MgSO_4\ 7H_2O$ | 3.0 |
| Nitrilotriacetic acid | 1.5 |
| NaCl | 1.0 |
| $MnSO_4\ H_2O$ | 0.5 |
| $CaCl_2$ | 0.1 |
| $CoCl_2\ 6H_2O$ | 0.1 |
| $FeSO_4\ 7H_2O$ | 0.1 |
| $ZnSO_4\ 7H_2O$ | 0.1 |
| $AlK(SO_4)_2\ 12H_2O$ | 0.01 |
| $CuSO_4\ 5H_2O$ | 0.01 |
| $H_3BO_3$ | 0.01 |
| $NaMoO_4\ 2H_2O$ | 0.01 |
| DI H2O | To 1 L |

MBM

| Component | g/L |
| --- | --- |
| 100x Wolfes Minerals | 1.0 mL |
| Ammonium Sulfate | 0.90 |
| Cellobiose | 4.0 |
| Sodium Bicarbonate | 7.5 |
| Sodium Carbonate | 4.0 |
| 0.1% Resazurin | 1 mL |
| VFA Soln | 48 mL |
| DI H2O | 1 L |

Place the aforementioned components into a flask 2× the size of the volume being made.

To create modified MBM (MBM mod) media, add the following components:

| Component | g/L |
| --- | --- |
| $KH_2PO_4$ | 1.0 |
| $K_2HPO_4$ | 1.0 | pH to 6.8-7.0. Autoclave at 121° C. for 15 minutes, liquid cycle. Place in 47° C. water bath for 30 minutes. Sterile filter any of the following additives to create amended media:

| Component | Molarity (mM) | g/L |
| --- | --- | --- |
| Xylan | 30.0 | 4.98 |
| Fructose | 13.88 | 2.5 |
| Cellulose | 7.30 | 2.5 |

VFA Solution

| Component | g/L |
| --- | --- |
| Acetic Acid | 40 mL |
| Isobutyric Acid | 2 mL |
| Isovaleric Acid | 2 mL |
| Valeric Acid | 2 mL |
| 2-Methylbutyric acid | 2 mL |

RCM

BD Difco Dehydrated Culture Media: Reinforced Clostridial Medium

| Component | g/L |
| --- | --- |
| Peptone | 10 |
| Beef Extract | 10 |
| Yeast Extract | 3 |
| Dextrose | 5 |
| Sodium Chloride | 5 |
| Soluble Starch | 1 |
| Cysteine HCl | 0.5 |
| Sodium Acetate | 3 |
| Agar | 0.5 |

Place me aforementioned components into a flask 2× larger than the volume being made. pH to 6.8-7.0. Autoclave at 121° C. for 15 minutes, liquid cycle.

Trypic Soy Broth (TSB)

Add the following components into a flask 2× larger than the volume being made. Add 500 mL of deionized water. Add stir bar to flask and place on stir plate. Stir while adding 30 g/L of Tryptic Soy Broth (Sigma Aldrich T8907). Top off to 850 mL with deionized water. Add 1 mL of 0.01% resazurin indicator. Autoclave at 121° C. for 15 minutes, liquid cycle. Place flask in hot bath at 47° C. for 30 minutes.

TSBHK

Sterile filter (0.2 micrometer) 10 mL hemin (0.05%) and 0.2 mL vitamin K1 solution.

To create stock solutions:

| Hemin Solution (100 mLs) | |
| --- | --- |
| Component | grams/volumes |
| Hemin (Sigma Aldrich H9039) | 50 mg |
| 1M NaOH | 1.0 mLs |
| dI H2O | 99 mLs |

| Vitamin K1 Solution (30 mLs) | |
| --- | --- |
| Component | mLs |
| Vitamin K1 (Sigma Aldrich V3501) | 0.15 |
| 95% EtOH | 30 |

TSB+5% Sheep's Blood

Add 50 mL of defibrinated sheep's blood to 950 mL of TSB.

VL55/BC (Modified DSMZ 1266)

Place the following components into a flask 2× larger than the volume being made.

| Component | mL/L |
| --- | --- |
| 2-Morpholinoethanesulfonic Acid (MES) | 1.95 g |
| 20 mM $MgSO_4$ | 10.0 |
| 30 mM $CaCl_2$ | 10.0 |
| 20 mM $(NH_4)_2HPO_4$ | 10.0 |
| Selenite-Tungstate Soln | 1.0 |
| Trace Element Soln SL10 | 1.0 |
| 0.1% Resazurin | 1.0 |
| Di $H_2O$ | 960 |

Once all components are in solution, aliquot 50 mL into separate 120 mL serum vials. Each vial is bubbled under $N_2$ gas for 3 minutes at 15 psi. All vials are stoppered with grey stops and crimped with aluminum tear off crimps. Head space of every vial is sparged, needle in/out, for 2 minutes under $N_2$ gas. All vials are labeled and autoclaved at 121° C. for 20 minutes under fast cycle. When vials have finished autoclaving and cooled, the following three sets of components are added at the following concentration to every vial, via syringe, syringe filter 0.2 micrometers, and needle.

| Component | mL/L |
| --- | --- |
| 100x Wolfe's Minerals | 10.0 |
| 1000x Wolfe's Vitamins | 1.0 |
| BC Solution | 40.0 |
| 5% $Na_2S$ | 10.0 |
| NaOH | 10.0 |
| $Na_2SeO \times 5H_2O$ | 1.0 |
| $Na_2WO_4 \times 2H_2O$ | 10.0 |
| Di $H_2O$ | 1000 |
| | mg/L |
| HCl (25%; 7.7M) | 10.0 mLs |
| $FeCl_2 \times 4H_2O$ | 1.50 g |
| $ZnCl_2$ | 70.0 |
| $MnCl_2 \times 4H_2O$ | 100.0 |

-continued

| Component | |
|---|---|
| H$_3$BO$_3$ | 6.0 |
| CoCl$_2$ × 6H$_2$O | 190.0 |
| CuCl$_2$ × 2H$_2$O | 2.0 |
| NiCl$_2$ × 6H$_2$O | 24.0 |
| Na$_2$MoO$_4$ × 2H$_2$O | 36.0 |
| Di H$_2$O | 990.0 |

First dissolved FeCl$_2$ in the HCL, then dilute in water, add and dissolve the other salts.
Finally make up to volume.

| Component | g/50 mLs |
|---|---|
| Bile Salts | 1.0 g |
| Creatine | .282 |

Rumen Winogradsky Column
Clarified Rumen Fluid Creation
(a) Obtain approximately 2 L of unfiltered rumen fluid.
(b) Aliquot into 250 mL conicals.
(c) Spin at 4300 RPM for 30 minutes at 4° C.
  (i) Remove the supernatant (1× Clarified Rumen Fluid) in an anaerobic chamber with 5:20:75, H2:CO$_2$:N$_2$ gas. Store half the 1× Clarified Rumen Fluid in an airtight container at 4° C. until ready to use.
  (ii) Remove the pellet (Rumen solids) from all conicals and store in an airtight container at 4° C. until ready to use.
(d) Aliquot the 1× Clarified Rumen Fluid into 50 mL conicals.
(e) Spin 1× Clarified Rumen Fluid at 13200 RPM for 30 minutes
  (i) Remove supernatant (2× Clarified Rumen Fluid) in an anaerobic chamber and store in an airtight container at 4° C. until ready to use.
  (ii) Discard the pellet.
Creation of Column
(a) Bring sterile Winogradsky Column, fresh beef Total Mixed Ration (TMR), Beef Rumen Sample, Rumen Solids, 1× Clarified Rumen Fluid and 2× Clarified Rumen Fluid into an anaerobic chamber.
(b) Tightly pack approximately 100-mLs of Rumen Solids into the bottom of the column.
(c) Pour approximately 150-mLs 1× Clarified Rumen Fluid on top of the Rumen Solids.
(d) Pour Approximately 150-mLs 2× Clarified Rumen Fluid on top of the 1× Rumen Fluid.
(e) Seed column with approximately 10-mLs raw beef rumen sample.
(f) Add 50-mLs TMR to the top of the column.
(g) Incubate at 39° C. in a well ventilated incubator.
Basal Salts Medium with Sodium Sulfate (BSMS)
Prepare the following solutions and filter sterilize and then store at 4° C.
Solution I

| Component | g/L |
|---|---|
| Na$_2$SO$_4$ | 5.0 |
| NaCl | 2.0 |
| (NH$_4$)$_2$SO$_4$ | 3.0 |
| KH$_2$PO$_4$ | 3.0 |
| CaCl$_2$ 2H$_2$O | 0.6 |
| MgSO$_4$ 7H$_2$O | 0.6 |

Solution II

| | | |
|---|---|---|
| K$_2$HPO$_4$ | | 3.0 |

Media Preparation

| Component | g/L |
|---|---|
| Solution I | 150 mL |
| Solution II | 150 mL |
| Yeast extract | 1.50 |
| Sodium Bicarbonate | 6.0 |

Bring up to 1 L. Adjust pH to 7.0+/−0.05. Autoclave for 15 minutes at 121° C. under slow exhaust. After autoclave, add sterile L-cysteine (100 micromolar).
RAMM Salts with Vitamins, Minerals, and Sodium Sulfide

| Component | g/500 mL |
|---|---|
| KH$_2$PO$_4$ | 0.11 |
| K$_2$HPO$_4$ | 0.08 |
| NH$_4$Cl | 0.265 |
| NaHCO$_3$ | 0.6 |
| DIH$_2$O | 500 mL |

After autoclaving, add 5 mL of 100× Wolfe's vitamin mix. 5 mL of 5% sodium sulfide.

Example XII. Analysis of Rumen Microbes for Volatile Fatty Acid Production and Carbon Source Use A. Carbon Source Use To assess the ability of the strains to metabolize various carbon sources, OD600 was used to measure the growth of strains over time in both minimal and rich media. Minimal media conditions demonstrate what compounds a strain can use as its sole carbon source, while the rich media iteration shows which carbon sources a strain can use under ideal, rumen-like conditions.

A single colony from each of the desired strains (on anaerobic agar plates) was inoculated into 1 ml of anaerobic RAMM salts. This was vortexed briefly and 10 μL was inoculated into a rich and minimal media, spiked with a chosen carbon source.

Strains were inoculated anaerobically into 1 mL of media in the 2 ml well of a 96 well plate. Carbon sources included arabinose, fructose, dextrose, galactose, xylose, cellobiose and starch. Carbon sources for the minimal media conditions were made at a 20 g/L concentration in RAMM salts, and filter sterilized through a 0.22 μm polyethersulfone membrane. Starch was prepared at a concentration of 2 g/L and autoclaved. Carbon sources for the rich media conditions were made in RAMM salts at a 200 g/L concentration and 100 μl of sterile carbon source was added to 900 μl of rich media.

Plates were incubated in the dark anaerobically at 37° C. 1004, aliquots of each well were periodically read at 600 nm over a two-week period on a "Synergy H4 hybrid plate reader". Strain ID was confirmed prior to inoculation with Illumina sequencing. Duplicate entries represent strains within 97% of the listed strain ID.

| | Minimal | | | | | | |
|---|---|---|---|---|---|---|---|
| strain_id | Arabinose | Fructose | Starch | Dextrose | Galactose | Xylose | Cellobiose |
| Ascusbbf_24302 | + | N/A | − | + | + | + | + |
| Ascusbbf_24302 | + | N/A | − | + | + | + | + |
| Ascusbbf_24302 | + | N/A | − | + | + | + | + |
| Ascusbbf_10712 | − | N/A | − | − | − | − | − |
| Ascusbbf_4 | − | N/A | − | − | − | − | − |
| Ascusbbf_4 | − | N/A | − | − | − | − | − |
| Ascusbbf_951 | − | N/A | − | − | − | − | − |
| Ascusbbf_951 | − | − | N/A | − | − | − | − |
| Ascusbbf_951 | − | N/A | − | − | − | − | − |
| Ascusbbf_14146 | + | N/A | − | + | + | + | + |
| Ascusbbf_14146 | − | N/A | − | + | − | − | − |
| Ascusbbf_14146 | − | − | N/A | − | − | − | − |
| Ascusbbf_154 | − | N/A | − | − | − | − | − |
| Ascusbbf_1010 | + | N/A | + | + | + | + | − |
| Ascusbbf_154 | − | N/A | − | − | − | − | − |
| Ascusbbf_24302 | + | N/A | + | + | + | + | + |
| Ascusbbf_24302 | + | N/A | + | + | + | + | + |
| Ascusbbf_1085 | − | N/A | − | − | − | − | − |
| Ascusbbf_14146 | − | N/A | + | + | + | + | − |
| Ascusbbf_951 | − | N/A | − | − | − | − | − |
| Ascusbbf_951 | − | N/A | − | − | − | − | − |
| Ascusbbf_951 | − | N/A | − | − | − | − | − |
| Ascusbbf_1085 | − | N/A | − | − | − | − | − |
| Ascusbbf_876 | − | N/A | − | − | − | − | − |
| Ascusbbf_10712 | − | N/A | − | − | − | − | − |
| Ascusbbf_10712 | − | N/A | − | − | − | − | − |
| Ascusbbf_10109 | − | − | N/A | − | − | − | − |

| | Rich | | | | | |
|---|---|---|---|---|---|---|
| strain_id | Arabinose | Fructose | Dextrose | Galactose | Xylose | Cellobiose |
| Ascusbbf_24302 | + | + | + | + | + | + |
| Ascusbbf_24302 | + | + | + | + | + | + |
| Ascusbbf_10712 | − | + | + | − | − | − |
| Ascusbbf_4 | N/A | N/A | N/A | N/A | N/A | N/A |
| Ascusbbf_4 | − | − | − | + | − | − |
| Ascusbbf_951 | N/A | N/A | N/A | N/A | N/A | N/A |
| Ascusbbf_951 | + | + | + | + | − | + |
| Ascusbbf_951 | − | + | + | − | − | − |
| Ascusbbf_14146 | N/A | N/A | N/A | N/A | N/A | N/A |
| Ascusbbf_14146 | N/A | N/A | N/A | N/A | N/A | N/A |
| Ascusbbf_14146 | − | + | − | − | − | − |
| Ascusbbf_154 | N/A | N/A | N/A | N/A | N/A | N/A |
| Ascusbbf_1010 | + | + | + | + | − | − |
| Ascusbbf_154 | + | + | + | + | + | + |
| Ascusbbf_24302 | + | + | + | + | + | + |
| Ascusbbf_24302 | + | + | + | + | + | + |
| Ascusbbf_1085 | − | + | − | + | − | − |
| Ascusbbf_14146 | N/A | N/A | N/A | N/A | N/A | N/A |
| Ascusbbf_951 | − | − | − | − | − | − |
| Ascusbbf_951 | − | − | − | − | − | − |
| Ascusbbf_1085 | − | + | + | + | − | + |
| Ascusbbf_876 | − | − | − | − | − | − |
| Ascusbbf_10712 | − | + | + | − | − | − |
| Ascusbbf_10712 | − | + | + | − | − | − |
| Ascusbbf_10109 | + | − | − | − | − | − |

B. Volatile Fatty Acid (VFA) Production

To assess the ability of the strains or enrichments to produce volatile fatty acids, HPLC was used to measure the concentrations of acetate, butyrate, and propionate in spent media.

For pure isolates, a single colony from each of the desired strains (on solid anaerobic media) was inoculated into the strain's preferred rich media. Enrichments were inoculated from fresh rumen sample into a desired media.

Cultures and medium blanks were incubated at their optimal conditions until significant growth was visible in the cultures. Absorbance reads were taken at 600 and 420 nm to determine the growth of each culture.

Pure culture strain IDs were confirmed with Illumina sequencing. Enrichments and their corresponding rumen sample inocula were Illumina sequenced to determine the presence or absence of target strains. These sequencing datasets were integrated with cell count data to determine if target strains grew in vitro.

An aliquot of each culture was sterile filtered through 0.22 micrometer polyethersulfone membrane into a sterile acid washed 15 mL glass sample vial to be analyzed by HPLC. HPLC reactions were performed at Michigan State University Bioeconomy Institute. Concentrations of acetate, butyrate, and propionate were quantified for the cultures and media blanks. HPLC parameters: The column is BioRad Aminex HPX-87H, 60° C., 0.5 mL/min mobile phase 0.00325 N H2SO4, 500 psi, 35C RI detector, 45 min run time, injection volume 5 μL.

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_1007A | 0 | 0 | 0 | 0 | 0 | + | + | + | − | 0 |
| Ascusbbf_100A | 0 | − | + | − | + | + | + | 0 | 0 | 0 |
| Ascusbbf_100A | 0 | 0 | 0 | 0 | + | − | 0 | 0 | + | 0 |
| Ascusbbf_100A | 0 | − | + | − | − | + | − | + | − | 0 |
| Ascusbbf_100A | 0 | 0 | 0 | + | 0 | + | 0 | 0 | 0 | 0 |
| Ascusbbf_100B | 0 | 0 | 0 | 0 | − | − | 0 | + | 0 | 0 |
| Ascusbbf_100B | 0 | − | + | 0 | 0 | + | + | + | + | 0 |
| Ascusbbf_100C | 0 | − | + | − | + | + | + | 0 | 0 | 0 |
| Ascusbbf_100C | 0 | 0 | 0 | 0 | − | − | 0 | + | 0 | 0 |
| Ascusbbf_100C | 0 | 0 | 0 | 0 | + | + | 0 | + | + | 0 |
| Ascusbbf_100C | 0 | − | + | 0 | 0 | + | + | 0 | + | 0 |
| Ascusbbf_100C | 0 | 0 | 0 | 0 | + | + | 0 | 0 | + | 0 |
| Ascusbbf_100C | 0 | 0 | 0 | 0 | 0 | + | 0 | 0 | 0 | 0 |
| Ascusbbf_100C | 0 | 0 | 0 | + | 0 | + | 0 | 0 | 0 | 0 |
| Ascusbbf_100D | 0 | − | + | − | + | + | + | 0 | 0 | 0 |
| Ascusbbf_100D | 0 | 0 | 0 | 0 | − | − | 0 | + | 0 | 0 |
| Ascusbbf_100D | 0 | 0 | 0 | 0 | 0 | + | + | + | − | 0 |
| Ascusbbf_100D | 0 | − | + | − | − | + | − | + | − | 0 |
| Ascusbbf_100E | 0 | − | + | − | + | + | + | 0 | 0 | 0 |
| Ascusbbf_100E | 0 | 0 | 0 | 0 | − | − | 0 | + | 0 | 0 |
| Ascusbbf_100E | 0 | 0 | 0 | 0 | + | + | 0 | + | + | 0 |
| Ascusbbf_100E | 0 | − | + | 0 | 0 | + | + | 0 | + | 0 |
| Ascusbbf_100E | 0 | 0 | 0 | 0 | + | − | 0 | 0 | + | 0 |
| Ascusbbf_100E | 0 | 0 | 0 | 0 | 0 | + | 0 | 0 | 0 | 0 |
| Ascusbbf_100F | 0 | 0 | 0 | 0 | 0 | + | + | + | − | 0 |
| Ascusbbf_100G | 0 | − | + | 0 | 0 | + | + | 0 | + | 0 |
| Ascusbbf_10109A | + | − | + | − | 0 | + | + | + | − | 0 |
| Ascusbbf_10109B | + | − | + | − | 0 | + | + | + | − | 0 |
| Ascusbbf_10109C | 0 | − | + | − | + | + | + | 0 | 0 | 0 |
| Ascusbbf_10109C | 0 | 0 | 0 | 0 | + | − | 0 | 0 | + | 0 |
| Ascusbbf_10109D | 0 | 0 | 0 | 0 | + | − | 0 | 0 | + | 0 |
| Ascusbbf_10109E | 0 | 0 | 0 | 0 | + | − | 0 | 0 | + | 0 |
| Ascusbbf_10109E | 0 | − | + | − | − | + | − | + | − | 0 |
| Ascusbbf_10109F | 0 | 0 | 0 | 0 | + | − | 0 | 0 | + | 0 |
| Ascusbbf_10109G | 0 | 0 | 0 | 0 | + | − | 0 | 0 | + | 0 |
| Ascusbbf_10109G | 0 | − | + | + | − | + | + | + | − | 0 |
| Ascusbbf_10109H | 0 | 0 | 0 | 0 | + | − | 0 | 0 | + | 0 |
| Ascusbbf_10109H | 0 | − | + | − | − | + | − | + | − | 0 |
| Ascusbbf_10109I | 0 | − | + | − | − | + | − | + | − | 0 |
| Ascusbbf_1010A | + | − | + | − | 0 | + | + | + | − | 0 |
| Ascusbbf_1010A | + | − | 0 | + | − | + | + | 0 | + | 0 |
| Ascusbbf_1010B | 0 | − | + | − | + | + | + | 0 | 0 | 0 |
| Ascusbbf_1010B | 0 | 0 | 0 | 0 | − | − | 0 | + | 0 | 0 |
| Ascusbbf_1010B | 0 | 0 | 0 | 0 | + | + | 0 | + | + | 0 |
| Ascusbbf_1010B | 0 | − | + | 0 | 0 | + | + | + | + | 0 |
| Ascusbbf_1010B | 0 | 0 | 0 | 0 | + | − | 0 | 0 | + | 0 |
| Ascusbbf_1010B | 0 | 0 | 0 | 0 | 0 | + | 0 | 0 | 0 | 0 |
| Ascusbbf_1010B | 0 | 0 | + | + | + | + | + | 0 | + | 0 |
| Ascusbbf_1010B | 0 | 0 | 0 | + | 0 | + | 0 | 0 | + | 0 |
| Ascusbbf_1010C | 0 | 0 | 0 | 0 | − | − | 0 | + | 0 | 0 |
| Ascusbbf_1010C | 0 | 0 | 0 | 0 | + | + | 0 | + | + | 0 |
| Ascusbbf_1010C | 0 | − | + | 0 | 0 | + | + | + | + | 0 |
| Ascusbbf_1010C | 0 | 0 | 0 | 0 | + | − | 0 | 0 | + | 0 |
| Ascusbbf_1010C | 0 | 0 | 0 | 0 | 0 | + | 0 | 0 | 0 | 0 |
| Ascusbbf_1010C | 0 | 0 | + | + | + | + | + | 0 | + | 0 |
| Ascusbbf_1010C | 0 | 0 | 0 | + | 0 | + | 0 | 0 | 0 | 0 |
| Ascusbbf_1010D | 0 | − | + | − | + | + | + | 0 | 0 | 0 |
| Ascusbbf_1010D | 0 | 0 | 0 | 0 | − | − | 0 | + | 0 | 0 |
| Ascusbbf_1010D | 0 | 0 | 0 | 0 | + | − | 0 | + | + | 0 |
| Ascusbbf_1010D | 0 | − | + | 0 | 0 | + | + | + | + | 0 |
| Ascusbbf_1010D | 0 | 0 | 0 | 0 | + | − | 0 | 0 | + | 0 |
| Ascusbbf_1010D | 0 | − | + | + | + | + | 0 | 0 | + | 0 |
| Ascusbbf_1010D | 0 | 0 | + | + | + | + | + | 0 | + | 0 |
| Ascusbbf_1010D | 0 | 0 | 0 | + | 0 | + | 0 | 0 | 0 | 0 |
| Ascusbbf_1010E | 0 | − | + | − | + | + | + | 0 | 0 | 0 |
| Ascusbbf_1010E | 0 | 0 | 0 | 0 | − | − | 0 | + | 0 | 0 |
| Ascusbbf_1010E | 0 | 0 | 0 | 0 | 0 | + | + | + | − | 0 |
| Ascusbbf_1010E | 0 | − | + | − | + | + | + | + | + | 0 |
| Ascusbbf_1010E | 0 | 0 | 0 | + | 0 | + | 0 | 0 | 0 | 0 |
| Ascusbbf_1010F | 0 | − | + | − | + | + | + | 0 | 0 | 0 |
| Ascusbbf_1010F | 0 | 0 | 0 | 0 | − | − | 0 | + | 0 | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_1010F | 0 | 0 | 0 | 0 | 0 | + | + | + | − | 0 |
| Ascusbbf_1010F | 0 | 0 | 0 | + | 0 | + | 0 | 0 | 0 | 0 |
| Ascusbbf_1010G | 0 | − | + | − | + | + | + | 0 | 0 | 0 |
| Ascusbbf_1010G | 0 | 0 | 0 | 0 | − | − | 0 | + | 0 | 0 |
| Ascusbbf_1010G | 0 | 0 | 0 | 0 | + | + | 0 | + | + | 0 |
| Ascusbbf_1010G | 0 | − | + | 0 | 0 | + | + | + | + | 0 |
| Ascusbbf_1010G | 0 | 0 | 0 | 0 | + | − | 0 | 0 | + | 0 |
| Ascusbbf_1010G | 0 | − | + | + | + | + | 0 | 0 | + | 0 |
| Ascusbbf_1010G | 0 | 0 | + | + | + | + | + | 0 | + | 0 |
| Ascusbbf_1010G | 0 | 0 | 0 | + | 0 | + | 0 | 0 | 0 | 0 |
| Ascusbbf_1010H | 0 | − | + | − | + | + | + | 0 | 0 | 0 |
| Ascusbbf_1010H | 0 | 0 | 0 | 0 | 0 | + | + | + | − | 0 |
| Ascusbbf_1010I | 0 | − | + | − | + | + | + | 0 | 0 | 0 |
| Ascusbbf_1010I | 0 | 0 | 0 | 0 | 0 | + | + | + | − | 0 |
| Ascusbbf_1010I | 0 | 0 | + | + | + | + | + | 0 | + | 0 |
| Ascusbbf_1010J | 0 | 0 | 0 | 0 | + | + | 0 | + | + | 0 |
| Ascusbbf_1010J | 0 | 0 | 0 | 0 | 0 | + | 0 | 0 | 0 | 0 |
| Ascusbbf_1010J | 0 | 0 | 0 | + | 0 | + | 0 | 0 | 0 | 0 |
| Ascusbbf_1034A | 0 | 0 | 0 | + | 0 | + | 0 | 0 | + | 0 |
| Ascusbbf_1034A | 0 | 0 | 0 | + | 0 | + | 0 | 0 | + | 0 |
| Ascusbbf_1034B | 0 | 0 | 0 | + | 0 | + | 0 | 0 | + | 0 |
| Ascusbbf_1034B | 0 | 0 | 0 | + | 0 | + | 0 | 0 | + | 0 |
| Ascusbbf_104A | 0 | 0 | 0 | − | 0 | + | 0 | 0 | + | − |
| Ascusbbf_104B | 0 | 0 | 0 | 0 | − | − | 0 | + | 0 | 0 |
| Ascusbbf_104B | 0 | − | + | 0 | 0 | + | + | + | + | 0 |
| Ascusbbf_104B | 0 | 0 | 0 | 0 | + | − | 0 | 0 | + | 0 |
| Ascusbbf_104B | 0 | − | + | − | − | + | − | + | − | 0 |
| Ascusbbf_104C | 0 | 0 | 0 | 0 | − | − | 0 | + | 0 | 0 |
| Ascusbbf_104C | 0 | − | + | 0 | 0 | + | + | + | + | 0 |
| Ascusbbf_104C | 0 | 0 | 0 | 0 | + | − | 0 | 0 | + | 0 |
| Ascusbbf_104C | 0 | − | + | − | − | + | − | + | − | 0 |
| Ascusbbf_104D | 0 | 0 | 0 | 0 | − | − | 0 | + | 0 | 0 |
| Ascusbbf_104E | 0 | 0 | 0 | 0 | − | − | 0 | + | 0 | 0 |
| Ascusbbf_104E | 0 | 0 | 0 | 0 | 0 | + | + | + | − | 0 |
| Ascusbbf_104E | 0 | − | + | 0 | 0 | + | + | + | + | 0 |
| Ascusbbf_104F | 0 | − | + | − | + | + | + | 0 | 0 | 0 |
| Ascusbbf_104F | 0 | − | + | 0 | 0 | + | + | + | + | 0 |
| Ascusbbf_104G | 0 | − | + | − | − | + | − | + | − | 0 |
| Ascusbbf_104H | 0 | − | + | − | + | + | + | + | + | 0 |
| Ascusbbf_104I | 0 | − | + | − | + | + | + | + | + | 0 |
| Ascusbbf_10576A | 0 | 0 | 0 | 0 | + | − | 0 | 0 | + | 0 |
| Ascusbbf_10576A | 0 | − | + | − | − | + | − | + | − | 0 |
| Ascusbbf_10576A | 0 | 0 | + | + | + | + | + | 0 | + | 0 |
| Ascusbbf_10576B | 0 | 0 | 0 | 0 | + | − | 0 | 0 | + | 0 |
| Ascusbbf_10576B | 0 | − | + | − | − | + | − | + | − | 0 |
| Ascusbbf_10576B | 0 | 0 | + | + | + | + | + | 0 | + | 0 |
| Ascusbbf_10576B | 0 | 0 | 0 | + | 0 | + | 0 | 0 | 0 | 0 |
| Ascusbbf_10576C | 0 | 0 | 0 | 0 | + | − | 0 | 0 | + | 0 |
| Ascusbbf_10576C | 0 | − | + | − | − | + | − | + | − | 0 |
| Ascusbbf_10576C | 0 | 0 | + | + | + | + | + | 0 | + | 0 |
| Ascusbbf_10576D | 0 | 0 | 0 | 0 | + | − | 0 | 0 | + | 0 |
| Ascusbbf_10576E | 0 | 0 | + | + | + | + | + | 0 | + | 0 |
| Ascusbbf_106863A | 0 | 0 | 0 | + | 0 | + | 0 | 0 | + | 0 |
| Ascusbbf_106863A | 0 | 0 | 0 | + | 0 | + | 0 | 0 | + | 0 |
| Ascusbbf_106863B | 0 | 0 | 0 | + | 0 | + | 0 | 0 | + | 0 |
| Ascusbbf_106863B | 0 | 0 | 0 | + | 0 | + | 0 | 0 | + | 0 |
| Ascusbbf_10712A | 0 | − | + | − | + | + | + | 0 | 0 | 0 |
| Ascusbbf_10712A | 0 | − | + | 0 | 0 | + | + | + | + | 0 |
| Ascusbbf_10712A | 0 | − | + | + | + | + | 0 | 0 | + | 0 |
| Ascusbbf_10712A | + | − | + | − | 0 | + | + | + | − | 0 |
| Ascusbbf_10712B | + | − | + | 0 | 0 | + | + | + | − | 0 |
| Ascusbbf_10712C | 0 | − | + | − | + | + | + | 0 | 0 | 0 |
| Ascusbbf_10712C | 0 | − | + | 0 | 0 | + | + | 0 | + | 0 |
| Ascusbbf_10712C | 0 | 0 | 0 | 0 | + | − | 0 | 0 | + | 0 |
| Ascusbbf_10712D | 0 | − | + | − | + | + | + | 0 | 0 | 0 |
| Ascusbbf_10712D | 0 | − | + | 0 | 0 | + | + | + | + | 0 |
| Ascusbbf_10712E | 0 | − | + | 0 | 0 | + | + | + | + | 0 |
| Ascusbbf_10712E | 0 | 0 | 0 | 0 | + | − | 0 | 0 | + | 0 |
| Ascusbbf_10712F | 0 | − | + | − | + | + | + | 0 | 0 | 0 |
| Ascusbbf_10712F | 0 | − | 0 | − | − | 0 | 0 | + | + | 0 |
| Ascusbbf_10712F | 0 | − | + | 0 | 0 | + | + | + | + | 0 |
| Ascusbbf_10712F | 0 | − | + | − | − | + | − | + | − | 0 |
| Ascusbbf_10712F | 0 | 0 | 0 | − | − | 0 | 0 | + | + | 0 |
| Ascusbbf_10712G | 0 | − | + | − | + | + | + | 0 | 0 | 0 |
| Ascusbbf_10712G | 0 | − | + | 0 | 0 | + | + | + | + | 0 |
| Ascusbbf_10712G | 0 | 0 | 0 | 0 | + | − | 0 | 0 | + | 0 |

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_10712G | 0 | − | + | − | − | + | − | + | − | 0 |
| Ascusbbf_10712G | 0 | − | 0 | − | − | 0 | 0 | + | + | 0 |
| Ascusbbf_10712H | 0 | − | + | − | + | + | + | 0 | 0 | 0 |
| Ascusbbf_10712H | 0 | − | + | 0 | 0 | + | + | + | + | 0 |
| Ascusbbf_10712H | 0 | 0 | 0 | 0 | + | − | 0 | 0 | + | 0 |
| Ascusbbf_10712H | 0 | − | + | − | − | + | − | + | − | 0 |
| Ascusbbf_10712H | 0 | 0 | 0 | + | 0 | + | 0 | 0 | 0 | 0 |
| Ascusbbf_10712I | 0 | − | + | 0 | 0 | + | + | + | + | 0 |
| Ascusbbf_10712I | 0 | − | + | + | + | + | 0 | 0 | + | 0 |
| Ascusbbf_1085A | 0 | − | + | − | + | + | + | 0 | 0 | 0 |
| Ascusbbf_1085A | 0 | 0 | 0 | 0 | 0 | + | + | + | − | 0 |
| Ascusbbf_1085A | 0 | 0 | 0 | 0 | + | − | 0 | 0 | + | 0 |
| Ascusbbf_1085A | 0 | 0 | 0 | 0 | 0 | + | 0 | 0 | 0 | 0 |
| Ascusbbf_1085A | + | − | + | − | 0 | + | + | + | − | 0 |
| Ascusbbf_1085A | + | − | 0 | + | − | + | 0 | + | − | 0 |
| Ascusbbf_1085B | 0 | − | + | − | + | + | + | 0 | 0 | 0 |
| Ascusbbf_1085B | 0 | − | + | − | + | + | + | + | + | 0 |
| Ascusbbf_1085B | 0 | 0 | 0 | 0 | 0 | + | 0 | 0 | 0 | 0 |
| Ascusbbf_1085B | 0 | 0 | + | + | + | + | 0 | 0 | + | 0 |
| Ascusbbf_1085B | + | − | 0 | + | 0 | + | 0 | + | + | 0 |
| Ascusbbf_1085C | 0 | − | + | − | + | + | + | 0 | 0 | 0 |
| Ascusbbf_1085C | 0 | 0 | 0 | 0 | − | − | 0 | + | 0 | 0 |
| Ascusbbf_1085C | 0 | 0 | 0 | 0 | 0 | + | + | + | − | 0 |
| Ascusbbf_1085C | 0 | − | + | 0 | 0 | + | + | 0 | + | 0 |
| Ascusbbf_1085C | 0 | 0 | 0 | 0 | + | − | 0 | 0 | + | 0 |
| Ascusbbf_1085C | 0 | 0 | 0 | 0 | 0 | + | 0 | 0 | 0 | 0 |
| Ascusbbf_1085C | 0 | 0 | 0 | + | 0 | + | 0 | 0 | + | 0 |
| Ascusbbf_1085C | 0 | 0 | 0 | + | 0 | + | 0 | 0 | + | 0 |
| Ascusbbf_1085D | 0 | 0 | 0 | 0 | − | − | 0 | + | 0 | 0 |
| Ascusbbf_1085D | 0 | 0 | 0 | 0 | 0 | + | + | + | − | 0 |
| Ascusbbf_1085D | 0 | − | + | 0 | 0 | + | + | + | + | 0 |
| Ascusbbf_1085D | 0 | 0 | 0 | 0 | + | − | 0 | 0 | + | 0 |
| Ascusbbf_1085D | 0 | 0 | 0 | 0 | 0 | + | 0 | 0 | 0 | 0 |
| Ascusbbf_1085D | 0 | 0 | 0 | + | 0 | + | 0 | 0 | 0 | 0 |
| Ascusbbf_1085E | 0 | − | + | − | + | + | + | 0 | 0 | 0 |
| Ascusbbf_1085E | 0 | 0 | 0 | 0 | − | − | 0 | + | 0 | 0 |
| Ascusbbf_1085E | 0 | 0 | 0 | 0 | 0 | + | + | + | − | 0 |
| Ascusbbf_1085E | 0 | − | + | 0 | 0 | + | + | + | + | 0 |
| Ascusbbf_1085E | 0 | 0 | 0 | 0 | + | − | 0 | 0 | + | 0 |
| Ascusbbf_1085E | 0 | 0 | 0 | 0 | 0 | + | 0 | 0 | 0 | 0 |
| Ascusbbf_1085E | 0 | 0 | 0 | + | 0 | + | 0 | 0 | 0 | 0 |
| Ascusbbf_1085E | + | − | 0 | + | 0 | + | 0 | + | + | 0 |
| Ascusbbf_1085F | 0 | − | + | − | + | + | + | 0 | 0 | 0 |
| Ascusbbf_1085F | 0 | 0 | 0 | 0 | + | − | 0 | 0 | + | 0 |
| Ascusbbf_1085F | 0 | 0 | 0 | + | 0 | + | 0 | 0 | + | 0 |
| Ascusbbf_1085F | 0 | 0 | 0 | + | 0 | + | 0 | 0 | + | 0 |
| Ascusbbf_1085G | 0 | − | + | − | + | + | + | 0 | 0 | 0 |
| Ascusbbf_1085G | 0 | − | + | − | − | + | − | + | − | 0 |
| Ascusbbf_1085H | 0 | − | + | − | + | + | + | 0 | 0 | 0 |
| Ascusbbf_1085H | 0 | − | + | − | − | + | − | + | − | 0 |
| Ascusbbf_1085I | 0 | − | + | − | + | + | + | 0 | 0 | 0 |
| Ascusbbf_1085I | 0 | − | + | − | − | + | − | + | − | 0 |
| Ascusbbf_1085J | 0 | − | + | − | + | + | + | 0 | 0 | 0 |
| Ascusbbf_1085J | 0 | − | + | − | + | + | + | + | + | 0 |
| Ascusbbf_1085K | 0 | − | + | − | + | + | + | + | + | 0 |
| Ascusbbf_1103A | 0 | − | + | − | + | + | + | 0 | 0 | 0 |
| Ascusbbf_1103A | 0 | 0 | 0 | 0 | + | + | 0 | + | + | 0 |
| Ascusbbf_1103B | 0 | 0 | 0 | 0 | 0 | + | + | + | − | 0 |
| Ascusbbf_1103B | 0 | 0 | + | + | + | + | + | 0 | + | 0 |
| Ascusbbf_1103B | 0 | 0 | 0 | + | 0 | + | 0 | 0 | + | 0 |
| Ascusbbf_1103C | 0 | 0 | 0 | 0 | 0 | + | + | + | − | 0 |
| Ascusbbf_1103C | 0 | 0 | 0 | + | 0 | + | 0 | 0 | + | 0 |
| Ascusbbf_1103C | 0 | 0 | 0 | + | 0 | + | 0 | 0 | + | 0 |
| Ascusbbf_1103D | 0 | 0 | 0 | 0 | + | + | 0 | + | + | 0 |
| Ascusbbf_1103D | 0 | − | + | 0 | 0 | + | + | 0 | + | 0 |
| Ascusbbf_1103D | 0 | 0 | 0 | + | 0 | + | 0 | 0 | + | 0 |
| Ascusbbf_1103D | 0 | 0 | 0 | + | 0 | + | 0 | 0 | + | 0 |
| Ascusbbf_1103E | 0 | 0 | 0 | 0 | + | + | 0 | + | + | 0 |
| Ascusbbf_1103E | 0 | 0 | + | + | + | + | + | 0 | + | 0 |
| Ascusbbf_1103E | 0 | 0 | 0 | + | 0 | + | 0 | 0 | + | 0 |
| Ascusbbf_1103F | 0 | 0 | 0 | + | 0 | + | 0 | 0 | + | 0 |
| Ascusbbf_1103G | 0 | 0 | 0 | + | 0 | + | 0 | 0 | + | 0 |
| Ascusbbf_1103G | 0 | 0 | 0 | + | 0 | + | 0 | 0 | + | 0 |
| Ascusbbf_1103H | 0 | 0 | 0 | + | 0 | + | 0 | 0 | + | 0 |
| Ascusbbf_1103H | 0 | 0 | 0 | + | 0 | + | 0 | 0 | + | 0 |
| Ascusbbf_1103I | 0 | 0 | + | + | + | + | + | 0 | + | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_1103I | 0 | 0 | 0 | + | 0 | + | 0 | 0 | + | 0 |
| Ascusbbf_113152A | 0 | − | + | − | − | + | − | + | − | 0 |
| Ascusbbf_1136A | 0 | 0 | 0 | 0 | − | − | 0 | + | 0 | 0 |
| Ascusbbf_1136A | 0 | 0 | 0 | 0 | + | + | 0 | + | + | 0 |
| Ascusbbf_1136A | 0 | − | + | 0 | 0 | + | + | + | + | 0 |
| Ascusbbf_1136A | 0 | 0 | 0 | 0 | + | − | 0 | 0 | + | 0 |
| Ascusbbf_1136A | 0 | − | + | − | − | + | − | + | − | 0 |
| Ascusbbf_1136B | 0 | 0 | 0 | 0 | − | − | 0 | + | 0 | 0 |
| Ascusbbf_1136B | 0 | 0 | 0 | 0 | 0 | + | + | + | − | 0 |
| Ascusbbf_1136B | 0 | − | + | 0 | 0 | + | + | 0 | + | 0 |
| Ascusbbf_1136B | 0 | 0 | 0 | 0 | + | − | 0 | 0 | + | 0 |
| Ascusbbf_1136B | 0 | − | + | − | − | + | − | + | − | 0 |
| Ascusbbf_1136B | 0 | 0 | 0 | + | 0 | + | 0 | 0 | 0 | 0 |
| Ascusbbf_1136C | 0 | − | + | − | + | + | + | 0 | 0 | 0 |
| Ascusbbf_1136C | 0 | 0 | 0 | 0 | − | − | 0 | + | 0 | 0 |
| Ascusbbf_1136C | 0 | 0 | 0 | 0 | 0 | + | + | + | − | 0 |
| Ascusbbf_1136C | 0 | − | + | 0 | 0 | + | + | + | + | 0 |
| Ascusbbf_1136C | 0 | 0 | 0 | 0 | + | − | 0 | 0 | + | 0 |
| Ascusbbf_1136C | 0 | − | + | − | − | + | − | + | − | 0 |
| Ascusbbf_1136D | 0 | 0 | 0 | 0 | − | − | 0 | + | 0 | 0 |
| Ascusbbf_1136D | 0 | 0 | 0 | 0 | + | + | 0 | + | + | 0 |
| Ascusbbf_1136D | 0 | − | + | 0 | 0 | + | + | + | + | 0 |
| Ascusbbf_1136D | 0 | 0 | 0 | 0 | + | − | 0 | 0 | + | 0 |
| Ascusbbf_1136D | 0 | 0 | 0 | 0 | 0 | + | 0 | 0 | 0 | 0 |
| Ascusbbf_1136D | 0 | 0 | 0 | + | 0 | + | 0 | 0 | 0 | 0 |
| Ascusbbf_1136E | 0 | 0 | 0 | 0 | − | − | 0 | + | 0 | 0 |
| Ascusbbf_1136E | 0 | 0 | 0 | 0 | + | + | 0 | + | + | 0 |
| Ascusbbf_1136E | 0 | 0 | 0 | 0 | + | − | 0 | 0 | + | 0 |
| Ascusbbf_1136E | 0 | − | + | − | − | + | − | + | − | 0 |
| Ascusbbf_1136F | 0 | − | + | 0 | 0 | + | + | + | + | 0 |
| Ascusbbf_11823A | 0 | 0 | 0 | 0 | 0 | + | + | + | − | 0 |
| Ascusbbf_11823B | 0 | 0 | 0 | 0 | 0 | + | + | + | − | 0 |
| Ascusbbf_11823B | 0 | − | + | − | + | + | + | + | + | 0 |
| Ascusbbf_11823B | 0 | 0 | 0 | 0 | + | − | 0 | 0 | + | 0 |
| Ascusbbf_11823C | 0 | − | + | − | − | + | − | + | − | 0 |
| Ascusbbf_118A | 0 | 0 | 0 | 0 | + | − | 0 | 0 | + | 0 |
| Ascusbbf_118A | 0 | 0 | 0 | + | 0 | + | 0 | 0 | + | 0 |
| Ascusbbf_118A | 0 | 0 | 0 | + | 0 | + | 0 | 0 | + | 0 |
| Ascusbbf_118B | 0 | 0 | 0 | + | 0 | + | 0 | 0 | + | 0 |
| Ascusbbf_118B | 0 | 0 | 0 | + | 0 | + | 0 | 0 | + | 0 |
| Ascusbbf_118C | 0 | 0 | 0 | + | 0 | + | 0 | 0 | + | 0 |
| Ascusbbf_118C | 0 | 0 | 0 | + | 0 | + | 0 | 0 | + | 0 |
| Ascusbbf_1207A | 0 | − | + | − | + | + | + | 0 | 0 | 0 |
| Ascusbbf_1207A | 0 | − | + | 0 | 0 | + | + | 0 | + | 0 |
| Ascusbbf_1207A | 0 | 0 | 0 | 0 | + | − | 0 | 0 | + | 0 |
| Ascusbbf_1207A | 0 | − | + | − | − | + | − | + | − | 0 |
| Ascusbbf_1207B | 0 | − | + | − | + | + | + | 0 | 0 | 0 |
| Ascusbbf_1207B | 0 | − | + | − | + | + | + | + | + | 0 |
| Ascusbbf_1207C | 0 | − | + | − | + | + | + | 0 | 0 | 0 |
| Ascusbbf_1207D | 0 | 0 | 0 | 0 | − | − | 0 | + | 0 | 0 |
| Ascusbbf_1207D | 0 | 0 | 0 | 0 | 0 | + | + | + | − | 0 |
| Ascusbbf_1207E | 0 | 0 | 0 | 0 | − | − | 0 | + | 0 | 0 |
| Ascusbbf_1207E | 0 | 0 | 0 | 0 | 0 | + | + | + | − | 0 |
| Ascusbbf_1207F | 0 | 0 | 0 | 0 | − | − | 0 | + | 0 | 0 |
| Ascusbbf_1207F | 0 | 0 | 0 | 0 | 0 | + | + | + | − | 0 |
| Ascusbbf_1207F | 0 | − | + | 0 | 0 | + | + | 0 | + | 0 |
| Ascusbbf_1207G | 0 | − | + | − | + | + | + | 0 | 0 | 0 |
| Ascusbbf_1207G | 0 | 0 | 0 | 0 | − | − | 0 | + | 0 | 0 |
| Ascusbbf_1207G | 0 | 0 | 0 | 0 | + | + | 0 | + | + | 0 |
| Ascusbbf_1207G | 0 | − | + | 0 | 0 | + | + | 0 | + | 0 |
| Ascusbbf_1207G | 0 | 0 | 0 | 0 | + | − | 0 | 0 | + | 0 |
| Ascusbbf_1207G | 0 | 0 | 0 | 0 | 0 | + | 0 | 0 | 0 | 0 |
| Ascusbbf_1207G | 0 | 0 | 0 | + | 0 | + | 0 | 0 | 0 | 0 |
| Ascusbbf_1207H | 0 | − | + | − | + | + | + | 0 | 0 | 0 |
| Ascusbbf_1207H | 0 | 0 | 0 | 0 | − | − | 0 | + | 0 | 0 |
| Ascusbbf_1207I | 0 | − | + | − | + | + | + | 0 | 0 | 0 |
| Ascusbbf_1207I | 0 | 0 | 0 | 0 | − | − | 0 | + | 0 | 0 |
| Ascusbbf_1207I | 0 | 0 | 0 | 0 | + | + | 0 | + | + | 0 |
| Ascusbbf_1207I | 0 | 0 | 0 | 0 | + | − | 0 | 0 | + | 0 |
| Ascusbbf_1207I | 0 | 0 | 0 | 0 | 0 | + | 0 | 0 | 0 | 0 |
| Ascusbbf_1207J | 0 | − | + | 0 | + | + | + | 0 | 0 | 0 |
| Ascusbbf_1207J | 0 | − | + | 0 | 0 | + | + | 0 | + | 0 |
| Ascusbbf_1207J | 0 | 0 | 0 | 0 | + | − | 0 | 0 | + | 0 |
| Ascusbbf_1207K | 0 | − | + | − | + | + | + | 0 | 0 | 0 |
| Ascusbbf_1207K | 0 | 0 | 0 | 0 | + | − | 0 | 0 | + | 0 |
| Ascusbbf_1207K | 0 | − | + | − | − | + | − | + | − | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_1207L | 0 | 0 | 0 | 0 | + | − | 0 | 0 | + | 0 |
| Ascusbbf_120A | 0 | 0 | + | + | + | + | + | 0 | + | 0 |
| Ascusbbf_120B | 0 | 0 | + | + | + | + | + | 0 | + | 0 |
| Ascusbbf_120C | 0 | 0 | + | + | + | + | + | 0 | + | 0 |
| Ascusbbf_121971A | 0 | 0 | 0 | 0 | 0 | + | + | + | − | 0 |
| Ascusbbf_1238A | 0 | − | + | − | + | + | + | 0 | 0 | 0 |
| Ascusbbf_1238A | 0 | 0 | 0 | 0 | − | − | 0 | + | 0 | 0 |
| Ascusbbf_1238A | 0 | 0 | 0 | 0 | + | + | 0 | + | + | 0 |
| Ascusbbf_1238A | 0 | 0 | 0 | 0 | 0 | + | 0 | 0 | 0 | 0 |
| Ascusbbf_1238A | 0 | 0 | + | + | + | + | + | 0 | + | 0 |
| Ascusbbf_1238A | 0 | 0 | 0 | + | 0 | + | 0 | 0 | 0 | 0 |
| Ascusbbf_1238B | 0 | 0 | 0 | 0 | − | − | 0 | + | 0 | 0 |
| Ascusbbf_1238B | 0 | 0 | 0 | 0 | + | + | 0 | + | + | 0 |
| Ascusbbf_1238B | 0 | 0 | 0 | 0 | 0 | + | 0 | 0 | 0 | 0 |
| Ascusbbf_1238B | 0 | 0 | 0 | + | 0 | + | 0 | 0 | 0 | 0 |
| Ascusbbf_1238C | 0 | − | + | − | + | + | + | 0 | 0 | 0 |
| Ascusbbf_1238C | 0 | 0 | 0 | 0 | − | − | 0 | + | 0 | 0 |
| Ascusbbf_1238C | 0 | 0 | 0 | 0 | + | + | 0 | + | + | 0 |
| Ascusbbf_1238C | 0 | − | + | 0 | 0 | + | + | + | + | 0 |
| Ascusbbf_1238C | 0 | 0 | 0 | 0 | 0 | + | 0 | 0 | 0 | 0 |
| Ascusbbf_1238C | 0 | 0 | + | + | + | + | + | 0 | + | 0 |
| Ascusbbf_1238C | 0 | 0 | 0 | + | 0 | + | 0 | 0 | 0 | 0 |
| Ascusbbf_1238D | 0 | − | + | − | + | + | + | 0 | 0 | 0 |
| Ascusbbf_1238D | 0 | 0 | + | + | + | + | + | 0 | + | 0 |
| Ascusbbf_1238D | 0 | 0 | 0 | + | 0 | + | 0 | 0 | 0 | 0 |
| Ascusbbf_1273A | 0 | 0 | 0 | 0 | + | − | 0 | 0 | + | 0 |
| Ascusbbf_1273A | 0 | 0 | + | + | + | + | + | 0 | + | 0 |
| Ascusbbf_1273A | 0 | 0 | 0 | + | 0 | + | 0 | 0 | + | 0 |
| Ascusbbf_1273B | 0 | 0 | 0 | + | 0 | + | 0 | 0 | + | 0 |
| Ascusbbf_1273C | 0 | 0 | + | + | + | + | + | 0 | + | 0 |
| Ascusbbf_1273C | 0 | 0 | 0 | + | 0 | + | 0 | 0 | + | 0 |
| Ascusbbf_1273D | 0 | 0 | + | + | + | + | + | 0 | + | 0 |
| Ascusbbf_1273D | 0 | 0 | 0 | + | 0 | + | 0 | 0 | + | 0 |
| Ascusbbf_130A | 0 | 0 | 0 | 0 | + | − | 0 | 0 | + | 0 |
| Ascusbbf_130A | 0 | − | + | − | − | + | − | + | − | 0 |
| Ascusbbf_130A | 0 | 0 | 0 | + | 0 | + | 0 | 0 | + | 0 |
| Ascusbbf_130A | 0 | 0 | 0 | + | 0 | + | 0 | 0 | + | 0 |
| Ascusbbf_130B | 0 | 0 | 0 | 0 | + | − | 0 | 0 | + | 0 |
| Ascusbbf_130C | 0 | 0 | 0 | 0 | + | − | 0 | 0 | + | 0 |
| Ascusbbf_130C | 0 | − | + | − | − | + | − | + | − | 0 |
| Ascusbbf_130D | 0 | 0 | 0 | 0 | + | − | 0 | 0 | + | 0 |
| Ascusbbf_130D | 0 | − | + | − | − | + | − | + | − | 0 |
| Ascusbbf_130E | 0 | 0 | 0 | 0 | + | − | 0 | 0 | + | 0 |
| Ascusbbf_130F | 0 | 0 | 0 | 0 | + | − | 0 | 0 | + | 0 |
| Ascusbbf_130F | 0 | − | + | − | − | + | − | + | − | 0 |
| Ascusbbf_130G | 0 | 0 | + | + | + | + | + | 0 | + | 0 |
| Ascusbbf_1325058A | 0 | 0 | 0 | 0 | 0 | + | + | + | − | 0 |
| Ascusbbf_1325058A | 0 | 0 | 0 | 0 | + | − | 0 | 0 | + | 0 |
| Ascusbbf_1325058A | 0 | 0 | 0 | + | 0 | + | 0 | 0 | + | 0 |
| Ascusbbf_1325058A | 0 | 0 | 0 | + | 0 | + | 0 | 0 | + | 0 |
| Ascusbbf_1325058B | 0 | 0 | 0 | 0 | + | + | 0 | + | + | 0 |
| Ascusbbf_1325058B | 0 | − | + | 0 | 0 | + | + | 0 | + | 0 |
| Ascusbbf_1325058B | 0 | 0 | 0 | 0 | + | − | 0 | 0 | + | 0 |
| Ascusbbf_1325058B | 0 | − | + | − | − | + | − | + | − | 0 |
| Ascusbbf_1325058B | 0 | 0 | + | + | + | + | + | 0 | + | 0 |
| Ascusbbf_1325058C | 0 | 0 | 0 | 0 | + | − | 0 | 0 | + | 0 |
| Ascusbbf_1325058D | 0 | 0 | 0 | 0 | + | − | 0 | 0 | + | 0 |
| Ascusbbf_1325058E | 0 | − | + | − | − | + | − | + | − | 0 |
| Ascusbbf_1325058F | 0 | 0 | + | + | + | + | + | 0 | + | 0 |
| Ascusbbf_13543A | 0 | − | + | − | + | + | + | 0 | 0 | 0 |
| Ascusbbf_13543B | 0 | 0 | 0 | 0 | + | + | 0 | + | + | 0 |
| Ascusbbf_13543B | 0 | 0 | 0 | 0 | 0 | + | 0 | 0 | 0 | 0 |
| Ascusbbf_13543C | 0 | 0 | 0 | 0 | + | + | 0 | + | + | 0 |
| Ascusbbf_13543C | 0 | − | + | 0 | 0 | + | + | 0 | + | 0 |
| Ascusbbf_13543C | 0 | 0 | 0 | 0 | 0 | + | 0 | 0 | 0 | 0 |
| Ascusbbf_13543C | 0 | 0 | 0 | + | 0 | + | 0 | 0 | + | 0 |
| Ascusbbf_13543C | 0 | 0 | 0 | + | 0 | + | 0 | 0 | + | 0 |
| Ascusbbf_13543D | 0 | 0 | 0 | 0 | + | + | 0 | + | + | 0 |
| Ascusbbf_13543D | 0 | 0 | 0 | 0 | 0 | + | 0 | 0 | 0 | 0 |
| Ascusbbf_13543E | 0 | − | + | − | + | + | + | 0 | 0 | 0 |
| Ascusbbf_13543E | 0 | 0 | 0 | 0 | + | + | 0 | + | + | 0 |
| Ascusbbf_13543E | 0 | − | + | 0 | 0 | + | + | 0 | + | 0 |
| Ascusbbf_13543E | 0 | 0 | 0 | + | 0 | + | 0 | 0 | + | 0 |
| Ascusbbf_13543E | 0 | 0 | 0 | + | 0 | + | 0 | 0 | + | 0 |
| Ascusbbf_13717A | 0 | 0 | + | + | + | + | + | 0 | + | 0 |
| Ascusbbf_13717A | 0 | 0 | 0 | + | 0 | + | 0 | 0 | + | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_13717B | 0 | 0 | + | + | + | + | + | 0 | + | 0 |
| Ascusbbf_13717B | 0 | 0 | 0 | + | 0 | + | 0 | 0 | + | 0 |
| Ascusbbf_13717C | 0 | 0 | + | + | + | + | + | 0 | + | 0 |
| Ascusbbf_13717C | 0 | 0 | 0 | + | 0 | + | 0 | 0 | + | 0 |
| Ascusbbf_1372985A | 0 | 0 | 0 | 0 | 0 | + | + | + | − | 0 |
| Ascusbbf_1372985A | + | − | + | − | 0 | + | + | + | − | 0 |
| Ascusbbf_1372985B | 0 | − | + | − | + | + | + | 0 | 0 | 0 |
| Ascusbbf_1372985B | 0 | 0 | 0 | 0 | 0 | + | + | + | − | 0 |
| Ascusbbf_1372985B | 0 | − | + | 0 | 0 | + | + | 0 | + | 0 |
| Ascusbbf_1372985C | 0 | − | + | − | + | + | + | 0 | 0 | 0 |
| Ascusbbf_1372985C | 0 | 0 | 0 | 0 | 0 | + | + | + | − | 0 |
| Ascusbbf_1372985D | 0 | 0 | 0 | 0 | − | − | 0 | + | 0 | 0 |
| Ascusbbf_1372985D | 0 | 0 | 0 | 0 | + | + | 0 | + | + | 0 |
| Ascusbbf_1372985D | 0 | − | + | 0 | 0 | + | + | + | + | 0 |
| Ascusbbf_1372985D | 0 | 0 | 0 | 0 | + | − | 0 | 0 | + | 0 |
| Ascusbbf_1372985D | 0 | 0 | 0 | 0 | 0 | + | 0 | 0 | 0 | 0 |
| Ascusbbf_1372985E | 0 | 0 | 0 | 0 | − | − | 0 | + | 0 | 0 |
| Ascusbbf_1372985E | 0 | 0 | 0 | 0 | + | + | 0 | + | + | 0 |
| Ascusbbf_1372985E | 0 | 0 | 0 | 0 | + | 0 | 0 | 0 | + | 0 |
| Ascusbbf_1372985E | 0 | 0 | 0 | 0 | 0 | + | 0 | 0 | 0 | 0 |
| Ascusbbf_1372985F | 0 | 0 | 0 | 0 | 0 | + | + | + | − | 0 |
| Ascusbbf_1372985I | 0 | − | + | − | + | + | + | 0 | 0 | 0 |
| Ascusbbf_1372985I | 0 | 0 | 0 | 0 | 0 | + | + | + | − | 0 |
| Ascusbbf_1372985L | 0 | 0 | 0 | 0 | 0 | + | + | + | − | 0 |
| Ascusbbf_1372985M | 0 | 0 | 0 | 0 | 0 | + | + | + | − | 0 |
| Ascusbbf_1372985N | 0 | 0 | 0 | 0 | 0 | + | + | + | − | 0 |
| Ascusbbf_1372985O | 0 | 0 | 0 | 0 | 0 | + | + | + | − | 0 |
| Ascusbbf_1372985P | 0 | 0 | 0 | 0 | 0 | + | + | + | − | 0 |
| Ascusbbf_1372985Q | 0 | 0 | 0 | 0 | 0 | + | + | + | − | 0 |
| Ascusbbf_1372985R | 0 | 0 | 0 | 0 | 0 | + | + | + | − | 0 |
| Ascusbbf_1372985S | 0 | 0 | 0 | 0 | + | + | 0 | + | + | 0 |
| Ascusbbf_1372985S | 0 | 0 | 0 | 0 | + | − | 0 | 0 | + | 0 |
| Ascusbbf_1372985S | 0 | 0 | 0 | 0 | 0 | + | 0 | 0 | 0 | 0 |
| Ascusbbf_1372985T | 0 | 0 | 0 | 0 | + | + | 0 | + | + | 0 |
| Ascusbbf_1372985T | 0 | 0 | 0 | 0 | + | − | 0 | 0 | + | 0 |
| Ascusbbf_1372985T | 0 | 0 | 0 | 0 | 0 | + | 0 | 0 | 0 | 0 |
| Ascusbbf_14146A | 0 | − | + | − | + | + | + | 0 | 0 | 0 |
| Ascusbbf_14146A | 0 | 0 | 0 | 0 | 0 | + | + | + | − | 0 |
| Ascusbbf_14146A | 0 | − | + | 0 | 0 | + | + | + | + | 0 |
| Ascusbbf_14146A | 0 | 0 | + | + | + | + | + | 0 | + | 0 |
| Ascusbbf_14146A | 0 | 0 | 0 | + | 0 | + | 0 | 0 | 0 | 0 |
| Ascusbbf_14146A | + | − | + | − | 0 | + | + | + | − | 0 |
| Ascusbbf_14146A | + | − | + | + | 0 | + | 0 | 0 | − | 0 |
| Ascusbbf_14146A | + | − | + | + | − | + | 0 | 0 | 0 | + |
| Ascusbbf_14146A | + | − | + | − | + | + | + | 0 | − | 0 |
| Ascusbbf_14146B | 0 | − | + | − | + | + | + | 0 | 0 | 0 |
| Ascusbbf_14146B | 0 | 0 | 0 | 0 | + | + | 0 | + | + | 0 |
| Ascusbbf_14146B | 0 | − | + | 0 | 0 | + | + | + | + | 0 |
| Ascusbbf_14146B | 0 | 0 | + | + | + | + | + | 0 | + | 0 |
| Ascusbbf_14146B | 0 | 0 | 0 | + | 0 | + | 0 | 0 | 0 | 0 |
| Ascusbbf_14146C | 0 | 0 | 0 | 0 | 0 | + | + | + | − | 0 |
| Ascusbbf_14146D | 0 | − | + | − | + | + | + | 0 | 0 | 0 |
| Ascusbbf_14146D | 0 | 0 | 0 | 0 | 0 | + | + | + | − | 0 |
| Ascusbbf_14146D | 0 | − | + | − | + | + | + | + | + | 0 |
| Ascusbbf_14146D | 0 | 0 | + | + | + | + | + | 0 | + | 0 |
| Ascusbbf_14146D | 0 | 0 | 0 | + | 0 | + | 0 | 0 | 0 | 0 |
| Ascusbbf_14146E | 0 | − | + | − | + | + | + | 0 | 0 | 0 |
| Ascusbbf_14146E | 0 | 0 | 0 | 0 | 0 | + | + | + | − | 0 |
| Ascusbbf_14146F | 0 | 0 | 0 | 0 | 0 | + | + | + | − | 0 |
| Ascusbbf_14146G | 0 | − | + | − | + | + | + | + | + | 0 |
| Ascusbbf_14146G | 0 | 0 | 0 | + | 0 | + | 0 | 0 | + | 0 |
| Ascusbbf_14146G | 0 | 0 | 0 | + | 0 | + | 0 | 0 | + | 0 |
| Ascusbbf_148A | 0 | 0 | 0 | 0 | + | − | 0 | 0 | + | 0 |
| Ascusbbf_148A | 0 | 0 | + | + | + | + | + | 0 | + | 0 |
| Ascusbbf_148A | 0 | 0 | 0 | + | 0 | + | 0 | 0 | + | 0 |
| Ascusbbf_148B | 0 | 0 | 0 | 0 | + | − | 0 | 0 | + | 0 |
| Ascusbbf_148B | 0 | 0 | + | + | + | + | + | 0 | + | 0 |
| Ascusbbf_148B | 0 | 0 | 0 | + | 0 | + | 0 | 0 | + | 0 |
| Ascusbbf_148C | 0 | 0 | 0 | 0 | + | − | 0 | 0 | + | 0 |
| Ascusbbf_148C | 0 | − | + | − | − | + | − | + | − | 0 |
| Ascusbbf_148C | 0 | 0 | + | + | + | + | + | 0 | + | 0 |
| Ascusbbf_148C | 0 | 0 | 0 | + | 0 | + | 0 | 0 | + | 0 |
| Ascusbbf_148D | 0 | 0 | + | + | + | + | + | 0 | + | 0 |
| Ascusbbf_148D | 0 | 0 | 0 | + | 0 | + | 0 | 0 | + | 0 |
| Ascusbbf_148E | 0 | 0 | 0 | + | 0 | + | 0 | 0 | + | 0 |
| Ascusbbf_148F | 0 | 0 | 0 | + | 0 | + | 0 | 0 | + | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_148F | 0 | 0 | 0 | + | 0 | + | 0 | 0 | + | 0 |
| Ascusbbf_148G | 0 | 0 | 0 | + | 0 | + | 0 | 0 | + | 0 |
| Ascusbbf_148G | 0 | 0 | 0 | + | 0 | + | 0 | 0 | + | 0 |
| Ascusbbf_148H | 0 | 0 | 0 | + | 0 | + | 0 | 0 | + | 0 |
| Ascusbbf_148H | 0 | 0 | 0 | + | 0 | + | 0 | 0 | + | 0 |
| Ascusbbf_1517A | 0 | − | + | − | + | − | + | 0 | 0 | 0 |
| Ascusbbf_1517A | 0 | 0 | 0 | 0 | − | − | 0 | + | 0 | 0 |
| Ascusbbf_1517A | 0 | 0 | 0 | 0 | + | + | 0 | + | + | 0 |
| Ascusbbf_1517A | 0 | − | + | 0 | 0 | + | + | + | + | 0 |
| Ascusbbf_1517A | 0 | 0 | 0 | + | 0 | + | 0 | 0 | + | 0 |
| Ascusbbf_1517A | 0 | 0 | 0 | + | 0 | + | 0 | 0 | 0 | 0 |
| Ascusbbf_1517B | 0 | 0 | 0 | 0 | − | − | 0 | + | 0 | 0 |
| Ascusbbf_1517B | 0 | 0 | 0 | 0 | + | + | 0 | + | + | 0 |
| Ascusbbf_1517B | 0 | − | + | 0 | 0 | + | + | + | + | 0 |
| Ascusbbf_1517B | 0 | 0 | + | + | + | + | + | 0 | + | 0 |
| Ascusbbf_1517B | 0 | + | 0 | + | 0 | + | 0 | 0 | 0 | 0 |
| Ascusbbf_1517C | 0 | 0 | 0 | 0 | − | − | 0 | + | 0 | 0 |
| Ascusbbf_1517C | 0 | − | + | 0 | 0 | + | + | 0 | + | 0 |
| Ascusbbf_1517C | 0 | 0 | 0 | 0 | + | − | 0 | 0 | + | 0 |
| Ascusbbf_1517C | 0 | − | + | − | − | + | − | + | − | 0 |
| Ascusbbf_1517C | 0 | 0 | 0 | + | 0 | + | 0 | 0 | + | 0 |
| Ascusbbf_1517C | 0 | 0 | 0 | + | 0 | + | 0 | 0 | + | 0 |
| Ascusbbf_1517D | 0 | − | + | − | + | + | + | 0 | 0 | 0 |
| Ascusbbf_1517D | 0 | 0 | 0 | 0 | − | − | 0 | + | 0 | 0 |
| Ascusbbf_1517D | 0 | − | + | 0 | 0 | + | + | + | + | 0 |
| Ascusbbf_1517D | 0 | 0 | 0 | 0 | + | − | 0 | 0 | + | 0 |
| Ascusbbf_1517D | 0 | − | + | − | − | + | − | + | − | 0 |
| Ascusbbf_1517D | 0 | 0 | 0 | + | 0 | + | 0 | 0 | + | 0 |
| Ascusbbf_1517D | 0 | 0 | 0 | + | 0 | + | 0 | 0 | 0 | 0 |
| Ascusbbf_1517E | 0 | − | + | − | + | + | + | 0 | 0 | 0 |
| Ascusbbf_1517E | 0 | 0 | 0 | 0 | + | + | 0 | + | + | 0 |
| Ascusbbf_1517E | 0 | 0 | 0 | 0 | 0 | + | 0 | 0 | 0 | 0 |
| Ascusbbf_1517F | 0 | − | + | 0 | 0 | + | + | 0 | + | 0 |
| Ascusbbf_1517G | 0 | − | + | 0 | 0 | + | + | 0 | + | 0 |
| Ascusbbf_1517H | 0 | − | + | 0 | 0 | + | + | + | + | 0 |
| Ascusbbf_1517I | 0 | 0 | 0 | 0 | + | − | 0 | 0 | + | 0 |
| Ascusbbf_152A | 0 | 0 | + | + | + | + | + | 0 | + | 0 |
| Ascusbbf_152B | 0 | 0 | + | + | + | + | + | 0 | + | 0 |
| Ascusbbf_152C | 0 | 0 | + | + | + | + | + | 0 | + | 0 |
| Ascusbbf_154A | 0 | − | + | − | 0 | + | + | + | − | 0 |
| Ascusbbf_154A | + | − | + | + | + | + | 0 | 0 | + | + |
| Ascusbbf_154B | 0 | − | + | − | + | + | + | + | + | 0 |
| Ascusbbf_154B | 0 | 0 | 0 | 0 | + | − | 0 | 0 | + | 0 |
| Ascusbbf_154B | 0 | − | + | − | − | + | − | + | − | 0 |
| Ascusbbf_154B | 0 | 0 | 0 | + | 0 | + | 0 | 0 | + | 0 |
| Ascusbbf_154B | 0 | 0 | 0 | + | 0 | + | 0 | 0 | + | 0 |
| Ascusbbf_154B | + | − | + | + | + | + | 0 | 0 | + | + |
| Ascusbbf_154D | 0 | 0 | 0 | 0 | − | − | 0 | + | 0 | 0 |
| Ascusbbf_154D | 0 | 0 | 0 | 0 | 0 | + | + | + | − | 0 |
| Ascusbbf_154D | 0 | − | + | − | + | + | + | + | + | 0 |
| Ascusbbf_154D | 0 | 0 | 0 | + | 0 | + | 0 | 0 | + | 0 |
| Ascusbbf_154D | 0 | 0 | 0 | + | 0 | + | 0 | 0 | + | 0 |
| Ascusbbf_154E | 0 | 0 | 0 | 0 | − | − | 0 | + | 0 | 0 |
| Ascusbbf_154E | 0 | 0 | 0 | 0 | + | + | 0 | + | + | 0 |
| Ascusbbf_154E | 0 | 0 | 0 | 0 | + | − | 0 | 0 | + | 0 |
| Ascusbbf_154E | 0 | 0 | 0 | 0 | 0 | + | 0 | 0 | 0 | 0 |
| Ascusbbf_154E | 0 | 0 | 0 | + | 0 | + | 0 | 0 | 0 | 0 |
| Ascusbbf_154F | 0 | − | + | − | + | + | + | 0 | 0 | 0 |
| Ascusbbf_154F | 0 | 0 | 0 | 0 | − | − | 0 | + | 0 | 0 |
| Ascusbbf_154F | 0 | 0 | 0 | 0 | + | + | 0 | + | + | 0 |
| Ascusbbf_154F | 0 | − | + | 0 | 0 | + | + | 0 | + | 0 |
| Ascusbbf_154F | 0 | 0 | 0 | 0 | + | − | 0 | 0 | + | 0 |
| Ascusbbf_154F | 0 | 0 | 0 | 0 | 0 | + | 0 | 0 | 0 | 0 |
| Ascusbbf_154F | 0 | 0 | 0 | + | 0 | + | 0 | 0 | 0 | 0 |
| Ascusbbf_154G | 0 | − | + | − | + | + | + | 0 | 0 | 0 |
| Ascusbbf_154G | 0 | 0 | 0 | 0 | 0 | + | + | + | − | 0 |
| Ascusbbf_154G | 0 | − | + | − | + | + | + | + | + | 0 |
| Ascusbbf_154G | 0 | 0 | 0 | 0 | + | − | 0 | 0 | + | 0 |
| Ascusbbf_154G | 0 | − | + | − | − | + | − | + | − | 0 |
| Ascusbbf_154G | 0 | 0 | 0 | + | 0 | + | 0 | 0 | + | 0 |
| Ascusbbf_154G | 0 | 0 | 0 | + | 0 | + | 0 | 0 | + | 0 |
| Ascusbbf_154G | 0 | − | 0 | + | + | + | − | 0 | + | 0 |
| Ascusbbf_154H | 0 | 0 | 0 | 0 | + | − | 0 | 0 | + | 0 |
| Ascusbbf_154H | 0 | − | + | − | − | + | − | + | − | 0 |
| Ascusbbf_154I | 0 | 0 | 0 | 0 | + | − | 0 | 0 | + | 0 |
| Ascusbbf_154I | 0 | − | + | − | − | + | − | + | − | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_154M | 0 | − | + | − | + | + | + | + | + | 0 |
| Ascusbbf_15806A | 0 | 0 | 0 | 0 | + | − | 0 | 0 | + | 0 |
| Ascusbbf_15806B | 0 | 0 | 0 | 0 | + | − | 0 | 0 | + | 0 |
| Ascusbbf_15806B | 0 | 0 | 0 | + | 0 | + | 0 | 0 | + | 0 |
| Ascusbbf_15806B | 0 | 0 | 0 | + | 0 | + | 0 | 0 | + | 0 |
| Ascusbbf_1629A | 0 | − | + | − | + | + | + | 0 | 0 | 0 |
| Ascusbbf_1629B | 0 | 0 | 0 | 0 | − | − | 0 | + | 0 | 0 |
| Ascusbbf_1629B | 0 | 0 | 0 | 0 | 0 | + | + | + | − | 0 |
| Ascusbbf_1629C | 0 | 0 | 0 | 0 | − | − | 0 | + | 0 | 0 |
| Ascusbbf_1629C | 0 | 0 | 0 | 0 | + | + | 0 | + | + | 0 |
| Ascusbbf_1629C | 0 | − | + | 0 | 0 | + | + | 0 | + | 0 |
| Ascusbbf_1629C | 0 | 0 | 0 | 0 | + | − | 0 | 0 | + | 0 |
| Ascusbbf_1629C | 0 | 0 | 0 | 0 | 0 | + | 0 | 0 | 0 | 0 |
| Ascusbbf_1629D | 0 | − | + | − | + | + | + | 0 | 0 | 0 |
| Ascusbbf_1629D | 0 | 0 | 0 | 0 | − | − | 0 | + | 0 | 0 |
| Ascusbbf_1629D | 0 | 0 | 0 | 0 | + | + | 0 | + | + | 0 |
| Ascusbbf_1629D | 0 | 0 | 0 | 0 | + | − | 0 | 0 | + | 0 |
| Ascusbbf_1629D | 0 | 0 | 0 | 0 | 0 | + | 0 | 0 | 0 | 0 |
| Ascusbbf_1629E | 0 | 0 | 0 | 0 | + | + | 0 | + | + | 0 |
| Ascusbbf_1629E | 0 | 0 | 0 | 0 | 0 | + | 0 | 0 | 0 | 0 |
| Ascusbbf_1629F | 0 | − | + | − | − | + | − | + | − | 0 |
| Ascusbbf_1629G | 0 | 0 | 0 | 0 | 0 | + | 0 | 0 | 0 | 0 |
| Ascusbbf_1697A | 0 | 0 | 0 | 0 | + | − | 0 | 0 | + | 0 |
| Ascusbbf_1697B | 0 | − | + | − | − | + | − | + | − | 0 |
| Ascusbbf_1697C | 0 | − | + | − | − | + | − | + | − | 0 |
| Ascusbbf_1821A | 0 | 0 | 0 | 0 | + | − | 0 | 0 | + | 0 |
| Ascusbbf_1821B | 0 | 0 | 0 | 0 | + | − | 0 | 0 | + | 0 |
| Ascusbbf_1821B | 0 | − | + | − | − | + | − | + | − | 0 |
| Ascusbbf_1821C | 0 | 0 | 0 | 0 | + | − | 0 | 0 | + | 0 |
| Ascusbbf_1821C | 0 | − | + | − | − | + | − | + | − | 0 |
| Ascusbbf_1821D | 0 | 0 | 0 | 0 | + | − | 0 | 0 | + | 0 |
| Ascusbbf_1821D | 0 | − | + | − | − | + | − | + | − | 0 |
| Ascusbbf_19022A | 0 | − | + | − | + | + | + | 0 | 0 | 0 |
| Ascusbbf_19022A | 0 | 0 | 0 | 0 | − | − | 0 | + | 0 | 0 |
| Ascusbbf_19022A | 0 | 0 | 0 | 0 | 0 | + | + | + | − | 0 |
| Ascusbbf_19022B | 0 | 0 | 0 | 0 | − | − | 0 | + | 0 | 0 |
| Ascusbbf_19022B | 0 | 0 | 0 | 0 | + | + | 0 | + | + | 0 |
| Ascusbbf_19022B | 0 | − | + | − | + | + | + | + | + | 0 |
| Ascusbbf_19022B | 0 | 0 | 0 | 0 | 0 | + | 0 | 0 | 0 | 0 |
| Ascusbbf_19022C | 0 | − | + | − | + | + | + | + | + | 0 |
| Ascusbbf_19022C | 0 | 0 | 0 | + | 0 | + | 0 | 0 | 0 | 0 |
| Ascusbbf_1A | 0 | 0 | 0 | 0 | − | − | 0 | + | 0 | 0 |
| Ascusbbf_1A | 0 | 0 | 0 | 0 | 0 | + | + | + | − | 0 |
| Ascusbbf_1A | 0 | − | + | 0 | 0 | + | + | 0 | + | 0 |
| Ascusbbf_1A | 0 | 0 | 0 | + | 0 | + | 0 | 0 | 0 | 0 |
| Ascusbbf_1B | 0 | 0 | 0 | 0 | − | − | 0 | + | 0 | 0 |
| Ascusbbf_1B | 0 | 0 | 0 | 0 | + | + | 0 | + | + | 0 |
| Ascusbbf_1B | 0 | − | + | 0 | 0 | + | + | 0 | + | 0 |
| Ascusbbf_1B | 0 | 0 | 0 | 0 | + | − | 0 | 0 | + | 0 |
| Ascusbbf_1B | 0 | 0 | 0 | 0 | 0 | + | 0 | 0 | 0 | 0 |
| Ascusbbf_1B | 0 | 0 | 0 | + | 0 | + | 0 | 0 | 0 | 0 |
| Ascusbbf_1C | 0 | 0 | 0 | 0 | − | − | 0 | + | 0 | 0 |
| Ascusbbf_1C | 0 | 0 | 0 | 0 | + | + | 0 | + | + | 0 |
| Ascusbbf_1C | 0 | − | + | 0 | 0 | + | + | 0 | + | 0 |
| Ascusbbf_1C | 0 | 0 | 0 | 0 | 0 | + | 0 | 0 | 0 | 0 |
| Ascusbbf_1D | 0 | − | + | − | + | + | + | 0 | 0 | 0 |
| Ascusbbf_1D | 0 | 0 | 0 | 0 | − | − | 0 | + | 0 | 0 |
| Ascusbbf_1D | 0 | 0 | 0 | 0 | + | + | 0 | + | + | 0 |
| Ascusbbf_1D | 0 | − | + | 0 | 0 | + | + | 0 | + | 0 |
| Ascusbbf_1D | 0 | 0 | 0 | 0 | + | − | 0 | 0 | + | 0 |
| Ascusbbf_1D | 0 | 0 | 0 | 0 | 0 | + | 0 | 0 | 0 | 0 |
| Ascusbbf_1D | 0 | 0 | + | + | + | + | + | 0 | + | 0 |
| Ascusbbf_1D | 0 | 0 | 0 | + | 0 | + | 0 | 0 | 0 | 0 |
| Ascusbbf_1E | 0 | − | + | − | + | + | + | 0 | 0 | 0 |
| Ascusbbf_1E | 0 | 0 | 0 | 0 | − | − | 0 | + | 0 | 0 |
| Ascusbbf_1E | 0 | − | + | − | + | + | + | + | + | 0 |
| Ascusbbf_1F | 0 | − | + | − | + | + | + | 0 | 0 | 0 |
| Ascusbbf_1F | 0 | 0 | 0 | 0 | − | − | 0 | + | 0 | 0 |
| Ascusbbf_1F | 0 | 0 | 0 | 0 | 0 | + | + | + | − | 0 |
| Ascusbbf_1F | 0 | − | + | 0 | 0 | + | + | + | + | 0 |
| Ascusbbf_1F | 0 | 0 | 0 | 0 | 0 | + | 0 | 0 | 0 | 0 |
| Ascusbbf_1F | 0 | 0 | 0 | + | 0 | + | 0 | 0 | + | 0 |
| Ascusbbf_1F | 0 | 0 | 0 | + | 0 | + | 0 | 0 | + | 0 |
| Ascusbbf_1G | 0 | − | + | − | + | + | + | 0 | 0 | 0 |
| Ascusbbf_1G | 0 | 0 | 0 | 0 | − | − | 0 | + | 0 | 0 |
| Ascusbbf_1G | 0 | 0 | 0 | 0 | + | + | 0 | + | + | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_1G | 0 | − | + | 0 | 0 | + | + | + | + | 0 |
| Ascusbbf_1G | 0 | 0 | 0 | 0 | + | − | 0 | 0 | + | 0 |
| Ascusbbf_1G | 0 | 0 | 0 | 0 | 0 | + | 0 | 0 | 0 | 0 |
| Ascusbbf_1G | 0 | 0 | 0 | + | 0 | + | 0 | 0 | 0 | 0 |
| Ascusbbf_1H | 0 | − | + | − | + | + | + | 0 | 0 | 0 |
| Ascusbbf_1H | 0 | 0 | 0 | 0 | − | − | 0 | + | 0 | 0 |
| Ascusbbf_1H | 0 | 0 | 0 | 0 | + | + | 0 | + | + | 0 |
| Ascusbbf_1H | 0 | 0 | 0 | 0 | 0 | + | 0 | 0 | 0 | 0 |
| Ascusbbf_1I | 0 | − | + | − | + | + | + | 0 | 0 | 0 |
| Ascusbbf_1I | 0 | 0 | 0 | 0 | − | − | 0 | + | 0 | 0 |
| Ascusbbf_1I | 0 | 0 | 0 | 0 | + | + | 0 | + | + | 0 |
| Ascusbbf_1I | 0 | − | + | 0 | 0 | + | + | + | + | 0 |
| Ascusbbf_1I | 0 | 0 | 0 | 0 | 0 | + | 0 | 0 | 0 | 0 |
| Ascusbbf_1I | 0 | 0 | 0 | + | 0 | + | 0 | 0 | 0 | 0 |
| Ascusbbf_1J | 0 | − | + | − | + | + | + | 0 | 0 | 0 |
| Ascusbbf_1J | 0 | 0 | 0 | 0 | − | − | 0 | + | 0 | 0 |
| Ascusbbf_1J | 0 | 0 | 0 | 0 | 0 | + | + | + | − | 0 |
| Ascusbbf_1J | 0 | − | + | 0 | 0 | + | + | 0 | + | 0 |
| Ascusbbf_1J | 0 | 0 | 0 | 0 | + | − | 0 | 0 | + | 0 |
| Ascusbbf_1J | 0 | 0 | 0 | 0 | 0 | + | 0 | 0 | 0 | 0 |
| Ascusbbf_1K | 0 | 0 | 0 | 0 | + | + | 0 | + | + | 0 |
| Ascusbbf_1K | 0 | − | + | 0 | 0 | + | + | + | + | 0 |
| Ascusbbf_1K | 0 | 0 | 0 | 0 | + | + | 0 | 0 | + | 0 |
| Ascusbbf_1K | 0 | 0 | 0 | 0 | 0 | + | 0 | 0 | 0 | 0 |
| Ascusbbf_201A | 0 | − | + | − | + | + | + | + | + | 0 |
| Ascusbbf_201B | 0 | 0 | 0 | 0 | + | + | 0 | + | + | 0 |
| Ascusbbf_201B | 0 | − | + | − | + | + | + | + | + | 0 |
| Ascusbbf_201B | 0 | 0 | 0 | 0 | 0 | + | 0 | 0 | 0 | 0 |
| Ascusbbf_201B | 0 | 0 | 0 | + | 0 | + | 0 | 0 | + | 0 |
| Ascusbbf_201B | 0 | 0 | 0 | + | 0 | + | 0 | 0 | + | 0 |
| Ascusbbf_201C | 0 | − | + | − | + | + | + | 0 | 0 | 0 |
| Ascusbbf_201D | 0 | − | + | − | + | + | + | 0 | 0 | 0 |
| Ascusbbf_201D | 0 | 0 | 0 | 0 | + | + | 0 | + | + | 0 |
| Ascusbbf_201D | 0 | − | + | 0 | 0 | + | + | 0 | + | 0 |
| Ascusbbf_201D | 0 | 0 | 0 | + | 0 | + | 0 | 0 | + | 0 |
| Ascusbbf_201D | 0 | 0 | 0 | + | 0 | + | 0 | 0 | + | 0 |
| Ascusbbf_201E | 0 | 0 | 0 | 0 | − | − | 0 | + | 0 | 0 |
| Ascusbbf_201E | 0 | 0 | 0 | 0 | + | + | 0 | + | + | 0 |
| Ascusbbf_201F | 0 | 0 | 0 | 0 | − | − | 0 | + | 0 | 0 |
| Ascusbbf_201G | 0 | − | + | − | + | + | + | 0 | 0 | 0 |
| Ascusbbf_201G | 0 | 0 | 0 | 0 | 0 | + | + | + | − | 0 |
| Ascusbbf_201G | 0 | 0 | 0 | 0 | 0 | + | 0 | 0 | 0 | 0 |
| Ascusbbf_201H | 0 | − | + | − | + | + | + | 0 | 0 | 0 |
| Ascusbbf_201H | 0 | 0 | 0 | 0 | + | + | 0 | + | + | 0 |
| Ascusbbf_201H | 0 | − | + | 0 | 0 | + | + | 0 | + | 0 |
| Ascusbbf_201H | 0 | 0 | 0 | 0 | 0 | + | 0 | 0 | 0 | 0 |
| Ascusbbf_201I | 0 | − | + | − | + | + | + | 0 | 0 | 0 |
| Ascusbbf_201I | 0 | 0 | 0 | 0 | + | + | 0 | + | + | 0 |
| Ascusbbf_201I | 0 | − | + | 0 | 0 | + | + | 0 | + | 0 |
| Ascusbbf_201I | 0 | 0 | 0 | 0 | 0 | + | 0 | 0 | 0 | 0 |
| Ascusbbf_201I | 0 | 0 | 0 | + | 0 | + | 0 | 0 | + | 0 |
| Ascusbbf_201I | 0 | 0 | 0 | + | 0 | + | 0 | 0 | + | 0 |
| Ascusbbf_201J | 0 | − | + | − | + | + | + | 0 | 0 | 0 |
| Ascusbbf_201J | 0 | − | + | 0 | 0 | + | + | 0 | + | 0 |
| Ascusbbf_201J | 0 | 0 | 0 | 0 | + | − | 0 | 0 | + | 0 |
| Ascusbbf_201K | 0 | − | + | 0 | 0 | + | + | 0 | + | 0 |
| Ascusbbf_201K | 0 | 0 | 0 | 0 | + | − | 0 | 0 | + | 0 |
| Ascusbbf_201K | 0 | 0 | 0 | + | 0 | + | 0 | 0 | + | 0 |
| Ascusbbf_201K | 0 | 0 | 0 | + | 0 | + | 0 | 0 | 0 | 0 |
| Ascusbbf_201L | 0 | − | + | − | + | + | + | + | + | 0 |
| Ascusbbf_201L | 0 | 0 | 0 | + | 0 | + | 0 | 0 | 0 | 0 |
| Ascusbbf_20584A | 0 | 0 | 0 | 0 | + | − | 0 | 0 | + | 0 |
| Ascusbbf_20584B | 0 | 0 | 0 | + | 0 | + | 0 | 0 | + | 0 |
| Ascusbbf_20584B | 0 | 0 | 0 | + | 0 | + | 0 | 0 | + | 0 |
| Ascusbbf_22558A | 0 | 0 | 0 | + | 0 | + | 0 | 0 | + | 0 |
| Ascusbbf_22558A | 0 | 0 | 0 | + | 0 | + | 0 | 0 | + | 0 |
| Ascusbbf_22558B | 0 | 0 | + | + | + | + | + | 0 | + | 0 |
| Ascusbbf_22558B | 0 | 0 | 0 | + | 0 | + | 0 | 0 | + | 0 |
| Ascusbbf_2297A | 0 | 0 | 0 | 0 | + | − | 0 | 0 | + | 0 |
| Ascusbbf_2297A | 0 | − | + | − | − | + | − | + | − | 0 |
| Ascusbbf_2297A | 0 | 0 | 0 | + | 0 | + | 0 | 0 | + | 0 |
| Ascusbbf_2297A | 0 | 0 | 0 | + | 0 | + | 0 | 0 | + | 0 |
| Ascusbbf_2297B | 0 | 0 | 0 | 0 | + | − | 0 | 0 | + | 0 |
| Ascusbbf_2297B | 0 | 0 | 0 | + | 0 | + | 0 | 0 | + | 0 |
| Ascusbbf_2297B | 0 | 0 | 0 | + | 0 | + | 0 | 0 | + | 0 |
| Ascusbbf_2297C | 0 | 0 | 0 | 0 | + | − | 0 | 0 | + | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_2297C | 0 | 0 | 0 | + | 0 | + | 0 | 0 | + | 0 |
| Ascusbbf_2297C | 0 | 0 | 0 | + | 0 | + | 0 | 0 | + | 0 |
| Ascusbbf_2297D | 0 | 0 | 0 | 0 | + | − | 0 | 0 | + | 0 |
| Ascusbbf_2297D | 0 | 0 | + | + | + | + | + | 0 | + | 0 |
| Ascusbbf_2297D | 0 | 0 | 0 | + | 0 | + | 0 | 0 | + | 0 |
| Ascusbbf_2297E | 0 | 0 | 0 | 0 | + | − | 0 | 0 | + | 0 |
| Ascusbbf_2297E | 0 | 0 | 0 | + | 0 | + | 0 | 0 | + | 0 |
| Ascusbbf_2297E | 0 | 0 | 0 | + | 0 | + | 0 | 0 | + | 0 |
| Ascusbbf_2297F | 0 | 0 | + | + | + | + | + | 0 | + | 0 |
| Ascusbbf_2297F | 0 | 0 | 0 | + | 0 | + | 0 | 0 | + | 0 |
| Ascusbbf_2297G | 0 | 0 | + | + | + | + | + | 0 | + | 0 |
| Ascusbbf_2297G | 0 | 0 | 0 | + | 0 | + | 0 | 0 | + | 0 |
| Ascusbbf_2297H | 0 | 0 | 0 | + | 0 | + | 0 | 0 | + | 0 |
| Ascusbbf_2297H | 0 | 0 | 0 | + | 0 | + | 0 | 0 | + | 0 |
| Ascusbbf_23033A | 0 | 0 | 0 | + | 0 | + | 0 | 0 | + | 0 |
| Ascusbbf_23033A | 0 | 0 | 0 | + | 0 | + | 0 | 0 | + | 0 |
| Ascusbbf_23033B | 0 | 0 | 0 | + | 0 | + | 0 | 0 | + | 0 |
| Ascusbbf_23033B | 0 | 0 | 0 | + | 0 | + | 0 | 0 | + | 0 |
| Ascusbbf_23033C | 0 | 0 | 0 | + | 0 | + | 0 | 0 | + | 0 |
| Ascusbbf_23033C | 0 | 0 | 0 | + | 0 | + | 0 | 0 | + | 0 |
| Ascusbbf_23033D | 0 | 0 | 0 | + | 0 | + | 0 | 0 | + | 0 |
| Ascusbbf_23033D | 0 | 0 | 0 | + | 0 | + | 0 | 0 | + | 0 |
| Ascusbbf_23134A | 0 | 0 | 0 | 0 | + | − | 0 | 0 | + | 0 |
| Ascusbbf_23A | 0 | 0 | 0 | + | 0 | + | 0 | 0 | + | 0 |
| Ascusbbf_23A | 0 | 0 | 0 | + | 0 | + | 0 | 0 | + | 0 |
| Ascusbbf_24302A | 0 | 0 | 0 | 0 | 0 | + | + | + | − | 0 |
| Ascusbbf_24302A | 0 | − | + | + | + | + | 0 | 0 | + | 0 |
| Ascusbbf_24302A | − | − | − | + | − | + | 0 | + | − | + |
| Ascusbbf_24302A | 0 | 0 | 0 | − | 0 | 0 | − | + | − | 0 |
| Ascusbbf_24302B | 0 | − | + | − | + | + | + | 0 | 0 | 0 |
| Ascusbbf_24302B | 0 | 0 | 0 | 0 | − | − | 0 | + | 0 | 0 |
| Ascusbbf_24302B | 0 | 0 | 0 | 0 | 0 | + | + | + | − | 0 |
| Ascusbbf_24302B | 0 | 0 | 0 | 0 | + | − | 0 | 0 | + | 0 |
| Ascusbbf_24302B | − | − | − | − | − | + | 0 | + | − | + |
| Ascusbbf_24302C | 0 | − | + | − | + | + | + | 0 | 0 | 0 |
| Ascusbbf_24302C | 0 | 0 | 0 | 0 | − | − | 0 | + | 0 | 0 |
| Ascusbbf_24302C | 0 | 0 | 0 | 0 | 0 | + | + | + | − | 0 |
| Ascusbbf_24302C | 0 | 0 | 0 | + | 0 | + | 0 | 0 | + | 0 |
| Ascusbbf_24302C | 0 | 0 | 0 | + | 0 | + | 0 | 0 | 0 | 0 |
| Ascusbbf_24302C | 0 | − | + | + | + | − | + | + | + | 0 |
| Ascusbbf_24302D | 0 | 0 | 0 | 0 | 0 | + | + | + | − | 0 |
| Ascusbbf_24302D | 0 | 0 | 0 | 0 | + | − | 0 | 0 | + | 0 |
| Ascusbbf_24302E | 0 | − | + | − | + | + | + | 0 | 0 | 0 |
| Ascusbbf_24302E | 0 | 0 | 0 | 0 | 0 | + | + | + | − | 0 |
| Ascusbbf_24302E | 0 | − | 0 | − | 0 | + | − | + | + | 0 |
| Ascusbbf_24302F | 0 | − | + | − | + | + | + | 0 | 0 | 0 |
| Ascusbbf_24302F | 0 | 0 | 0 | 0 | 0 | + | + | + | − | 0 |
| Ascusbbf_24302F | 0 | − | + | 0 | 0 | + | + | 0 | + | 0 |
| Ascusbbf_24302F | 0 | 0 | 0 | 0 | + | − | 0 | 0 | + | 0 |
| Ascusbbf_24302F | 0 | − | + | − | − | + | − | + | − | 0 |
| Ascusbbf_24302F | 0 | 0 | 0 | + | 0 | + | 0 | 0 | 0 | 0 |
| Ascusbbf_24302G | 0 | − | + | − | + | + | + | 0 | 0 | 0 |
| Ascusbbf_24302G | 0 | 0 | 0 | 0 | 0 | + | + | + | − | 0 |
| Ascusbbf_24302G | 0 | 0 | 0 | 0 | + | − | 0 | 0 | + | 0 |
| Ascusbbf_24302G | 0 | − | + | + | + | + | 0 | 0 | + | 0 |
| Ascusbbf_24302G | 0 | 0 | 0 | + | 0 | + | 0 | 0 | + | 0 |
| Ascusbbf_24302G | 0 | 0 | 0 | + | 0 | + | 0 | 0 | + | 0 |
| Ascusbbf_24302H | 0 | 0 | 0 | 0 | + | + | 0 | + | + | 0 |
| Ascusbbf_24302H | 0 | 0 | 0 | + | 0 | + | 0 | 0 | 0 | 0 |
| Ascusbbf_24302I | 0 | 0 | 0 | 0 | + | + | 0 | + | + | 0 |
| Ascusbbf_24302I | 0 | − | + | + | + | + | 0 | 0 | + | 0 |
| Ascusbbf_24302I | 0 | 0 | 0 | + | 0 | + | 0 | 0 | + | 0 |
| Ascusbbf_24302I | 0 | 0 | 0 | + | 0 | + | 0 | 0 | 0 | 0 |
| Ascusbbf_24302J | 0 | 0 | + | + | + | + | + | 0 | + | 0 |
| Ascusbbf_24302J | 0 | 0 | 0 | + | 0 | + | 0 | 0 | 0 | 0 |
| Ascusbbf_24422A | 0 | 0 | 0 | + | 0 | + | 0 | 0 | + | 0 |
| Ascusbbf_24422A | 0 | 0 | 0 | + | 0 | + | 0 | 0 | + | 0 |
| Ascusbbf_2600A | + | − | + | − | 0 | + | + | + | − | 0 |
| Ascusbbf_2600B | 0 | − | + | − | + | + | + | 0 | 0 | 0 |
| Ascusbbf_2600B | 0 | 0 | 0 | 0 | − | − | 0 | + | 0 | 0 |
| Ascusbbf_2600B | 0 | 0 | 0 | 0 | + | + | 0 | + | + | 0 |
| Ascusbbf_2600B | 0 | − | + | 0 | 0 | + | + | + | + | 0 |
| Ascusbbf_2600C | 0 | − | + | − | + | + | + | 0 | 0 | 0 |
| Ascusbbf_2600C | 0 | 0 | 0 | 0 | − | − | 0 | + | 0 | 0 |
| Ascusbbf_2600C | 0 | 0 | 0 | 0 | + | + | 0 | + | + | 0 |
| Ascusbbf_2600C | 0 | − | + | 0 | 0 | + | + | 0 | + | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_2600D | 0 | 0 | 0 | 0 | 0 | + | + | + | − | 0 |
| Ascusbbf_2600E | 0 | − | + | − | + | + | + | 0 | 0 | 0 |
| Ascusbbf_2600E | 0 | 0 | 0 | 0 | 0 | + | + | + | − | 0 |
| Ascusbbf_2600F | 0 | − | + | − | + | + | + | 0 | 0 | 0 |
| Ascusbbf_2600F | 0 | 0 | 0 | 0 | 0 | + | + | + | − | 0 |
| Ascusbbf_2600G | 0 | 0 | 0 | 0 | 0 | + | + | + | − | 0 |
| Ascusbbf_2600H | 0 | − | + | 0 | 0 | + | + | 0 | + | 0 |
| Ascusbbf_2624A | 0 | − | + | − | + | + | + | 0 | 0 | 0 |
| Ascusbbf_2624A | 0 | 0 | 0 | 0 | 0 | + | + | + | − | 0 |
| Ascusbbf_2624A | 0 | − | + | 0 | 0 | + | + | 0 | + | 0 |
| Ascusbbf_2624A | 0 | 0 | + | + | + | + | + | 0 | + | 0 |
| Ascusbbf_2624A | 0 | 0 | 0 | + | 0 | + | 0 | 0 | + | 0 |
| Ascusbbf_2624B | 0 | 0 | 0 | 0 | 0 | + | + | + | − | 0 |
| Ascusbbf_2624B | 0 | − | + | − | + | + | + | + | + | 0 |
| Ascusbbf_2624B | 0 | − | + | − | − | + | − | + | − | 0 |
| Ascusbbf_2624B | 0 | 0 | + | + | + | + | + | 0 | + | 0 |
| Ascusbbf_2624B | 0 | 0 | 0 | + | 0 | + | 0 | 0 | + | 0 |
| Ascusbbf_2624C | 0 | − | + | − | + | + | + | + | + | 0 |
| Ascusbbf_2624C | 0 | 0 | 0 | + | 0 | + | 0 | 0 | + | 0 |
| Ascusbbf_2624C | 0 | 0 | 0 | + | 0 | + | 0 | 0 | + | 0 |
| Ascusbbf_2624D | 0 | − | + | − | + | + | + | + | + | 0 |
| Ascusbbf_2624D | 0 | 0 | + | + | + | + | + | 0 | + | 0 |
| Ascusbbf_2624D | 0 | 0 | 0 | + | 0 | + | 0 | 0 | + | 0 |
| Ascusbbf_2624E | 0 | − | + | − | + | + | + | + | + | 0 |
| Ascusbbf_2624E | 0 | 0 | + | + | + | + | + | 0 | + | 0 |
| Ascusbbf_2624F | 0 | 0 | + | + | + | + | + | 0 | + | 0 |
| Ascusbbf_2624F | 0 | 0 | 0 | + | 0 | + | 0 | 0 | + | 0 |
| Ascusbbf_2624G | 0 | 0 | + | + | + | + | + | 0 | + | 0 |
| Ascusbbf_2624G | 0 | 0 | 0 | + | 0 | + | 0 | 0 | + | 0 |
| Ascusbbf_269A | 0 | − | + | − | + | + | + | 0 | 0 | 0 |
| Ascusbbf_269A | 0 | 0 | 0 | 0 | + | + | 0 | + | + | 0 |
| Ascusbbf_269A | 0 | − | + | − | + | + | + | + | + | 0 |
| Ascusbbf_269A | 0 | 0 | 0 | 0 | 0 | + | 0 | 0 | 0 | 0 |
| Ascusbbf_269B | 0 | − | + | − | + | + | + | 0 | 0 | 0 |
| Ascusbbf_269C | 0 | − | + | − | + | + | + | 0 | 0 | 0 |
| Ascusbbf_269C | 0 | − | + | − | + | + | + | + | + | 0 |
| Ascusbbf_269D | 0 | 0 | 0 | 0 | + | + | 0 | + | + | 0 |
| Ascusbbf_269D | 0 | 0 | 0 | 0 | 0 | + | 0 | 0 | 0 | 0 |
| Ascusbbf_269E | 0 | − | + | − | + | + | + | 0 | 0 | 0 |
| Ascusbbf_269E | 0 | 0 | 0 | 0 | + | + | 0 | + | + | 0 |
| Ascusbbf_269E | 0 | 0 | 0 | 0 | 0 | + | 0 | 0 | 0 | 0 |
| Ascusbbf_269F | 0 | − | + | − | + | + | + | 0 | 0 | 0 |
| Ascusbbf_269G | 0 | − | + | − | + | + | + | 0 | 0 | 0 |
| Ascusbbf_2770A | 0 | − | + | 0 | 0 | + | + | 0 | + | 0 |
| Ascusbbf_2770A | 0 | 0 | 0 | 0 | + | − | 0 | 0 | + | 0 |
| Ascusbbf_2770A | 0 | − | + | − | − | + | − | + | − | 0 |
| Ascusbbf_2770A | 0 | 0 | + | + | + | + | + | 0 | + | 0 |
| Ascusbbf_2770B | 0 | 0 | 0 | 0 | + | − | 0 | 0 | + | 0 |
| Ascusbbf_2770B | 0 | − | + | − | − | + | − | + | − | 0 |
| Ascusbbf_2770C | 0 | 0 | 0 | 0 | + | − | 0 | 0 | + | 0 |
| Ascusbbf_27932A | 0 | 0 | 0 | 0 | − | − | 0 | + | 0 | 0 |
| Ascusbbf_27932B | 0 | 0 | 0 | 0 | − | − | 0 | + | 0 | 0 |
| Ascusbbf_27932B | 0 | 0 | 0 | 0 | + | + | 0 | + | + | 0 |
| Ascusbbf_27932B | 0 | 0 | 0 | 0 | 0 | + | 0 | 0 | 0 | 0 |
| Ascusbbf_27932C | 0 | 0 | 0 | 0 | − | − | 0 | + | 0 | 0 |
| Ascusbbf_27932C | 0 | 0 | 0 | 0 | + | − | 0 | 0 | + | 0 |
| Ascusbbf_27932C | 0 | 0 | 0 | + | 0 | + | 0 | 0 | 0 | 0 |
| Ascusbbf_28350A | 0 | 0 | 0 | 0 | + | + | 0 | + | + | 0 |
| Ascusbbf_28350A | 0 | 0 | 0 | 0 | 0 | + | 0 | 0 | 0 | 0 |
| Ascusbbf_28350B | 0 | 0 | 0 | 0 | + | + | 0 | + | + | 0 |
| Ascusbbf_28350B | 0 | 0 | 0 | 0 | 0 | + | 0 | 0 | 0 | 0 |
| Ascusbbf_28350C | 0 | 0 | 0 | 0 | + | + | 0 | + | + | 0 |
| Ascusbbf_28350C | 0 | 0 | 0 | 0 | 0 | + | 0 | 0 | 0 | 0 |
| Ascusbbf_29797A | 0 | 0 | 0 | + | 0 | + | 0 | 0 | + | 0 |
| Ascusbbf_29797A | 0 | 0 | 0 | + | 0 | + | 0 | 0 | + | 0 |
| Ascusbbf_318A | 0 | 0 | 0 | 0 | + | − | 0 | 0 | + | 0 |
| Ascusbbf_318A | 0 | − | + | − | − | + | − | + | − | 0 |
| Ascusbbf_318B | 0 | 0 | 0 | 0 | + | − | 0 | 0 | + | 0 |
| Ascusbbf_318C | 0 | 0 | 0 | 0 | + | − | 0 | 0 | + | 0 |
| Ascusbbf_318C | 0 | − | + | − | − | + | − | + | − | 0 |
| Ascusbbf_318D | 0 | − | + | − | + | + | + | + | + | 0 |
| Ascusbbf_318D | 0 | − | + | − | − | + | − | + | − | 0 |
| Ascusbbf_318D | 0 | 0 | + | + | + | + | + | 0 | + | 0 |
| Ascusbbf_318D | 0 | 0 | 0 | + | 0 | + | 0 | 0 | + | 0 |
| Ascusbbf_318E | 0 | − | + | − | + | + | + | + | + | 0 |
| Ascusbbf_318E | 0 | − | + | − | − | + | − | + | − | 0 |

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_318E | 0 | 0 | 0 | + | 0 | + | 0 | 0 | + | 0 |
| Ascusbbf_318E | 0 | 0 | 0 | + | 0 | + | 0 | 0 | 0 | 0 |
| Ascusbbf_32877A | + | − | + | − | 0 | + | + | + | − | 0 |
| Ascusbbf_3427A | 0 | 0 | 0 | 0 | + | + | 0 | + | + | 0 |
| Ascusbbf_3427A | 0 | 0 | 0 | 0 | + | − | 0 | 0 | + | 0 |
| Ascusbbf_3427A | 0 | 0 | 0 | 0 | 0 | + | 0 | 0 | 0 | 0 |
| Ascusbbf_3427B | 0 | 0 | 0 | 0 | + | + | 0 | + | + | 0 |
| Ascusbbf_3427B | 0 | − | + | 0 | 0 | + | + | 0 | + | 0 |
| Ascusbbf_3427B | 0 | 0 | 0 | 0 | + | − | 0 | 0 | + | 0 |
| Ascusbbf_3427B | 0 | 0 | 0 | 0 | 0 | + | 0 | 0 | 0 | 0 |
| Ascusbbf_3427B | 0 | 0 | 0 | + | 0 | + | 0 | 0 | + | 0 |
| Ascusbbf_3427B | 0 | 0 | 0 | + | 0 | + | 0 | 0 | + | 0 |
| Ascusbbf_3427C | 0 | − | + | − | + | + | + | + | + | 0 |
| Ascusbbf_3427C | 0 | 0 | 0 | 0 | + | − | 0 | 0 | + | 0 |
| Ascusbbf_3427C | 0 | − | + | − | − | + | − | + | − | 0 |
| Ascusbbf_3427C | 0 | 0 | 0 | + | 0 | + | 0 | 0 | + | 0 |
| Ascusbbf_3427C | 0 | 0 | 0 | + | 0 | + | 0 | 0 | + | 0 |
| Ascusbbf_3427D | 0 | − | + | − | − | + | − | + | − | 0 |
| Ascusbbf_3427E | 0 | 0 | 0 | + | 0 | + | 0 | 0 | 0 | 0 |
| Ascusbbf_372A | 0 | − | + | − | + | + | + | 0 | 0 | 0 |
| Ascusbbf_372A | 0 | 0 | 0 | 0 | − | − | 0 | + | 0 | 0 |
| Ascusbbf_372A | 0 | 0 | 0 | 0 | + | + | 0 | + | + | 0 |
| Ascusbbf_372A | 0 | − | + | 0 | 0 | + | + | + | + | 0 |
| Ascusbbf_372A | 0 | 0 | 0 | 0 | + | − | 0 | 0 | + | 0 |
| Ascusbbf_372A | 0 | 0 | 0 | 0 | 0 | + | 0 | 0 | 0 | 0 |
| Ascusbbf_372A | 0 | 0 | 0 | + | 0 | + | 0 | 0 | 0 | 0 |
| Ascusbbf_372B | 0 | − | + | − | + | + | + | 0 | 0 | 0 |
| Ascusbbf_372C | 0 | 0 | 0 | 0 | − | − | 0 | + | 0 | 0 |
| Ascusbbf_372C | 0 | 0 | 0 | 0 | + | + | 0 | + | + | 0 |
| Ascusbbf_372C | 0 | 0 | 0 | 0 | + | − | 0 | 0 | + | 0 |
| Ascusbbf_372C | 0 | 0 | 0 | 0 | 0 | + | 0 | 0 | 0 | 0 |
| Ascusbbf_372D | 0 | − | + | − | + | + | + | 0 | 0 | 0 |
| Ascusbbf_372D | 0 | 0 | 0 | 0 | − | − | 0 | + | 0 | 0 |
| Ascusbbf_372D | 0 | 0 | 0 | 0 | 0 | + | + | + | − | 0 |
| Ascusbbf_372E | 0 | − | + | − | + | + | + | 0 | 0 | 0 |
| Ascusbbf_372E | 0 | 0 | 0 | 0 | − | − | 0 | + | 0 | 0 |
| Ascusbbf_372E | 0 | 0 | 0 | 0 | + | + | 0 | + | + | 0 |
| Ascusbbf_372E | 0 | − | + | − | + | + | + | + | + | 0 |
| Ascusbbf_372E | 0 | 0 | 0 | 0 | + | − | 0 | 0 | + | 0 |
| Ascusbbf_372E | 0 | 0 | 0 | 0 | 0 | + | 0 | 0 | 0 | 0 |
| Ascusbbf_372F | 0 | − | + | − | + | + | + | 0 | 0 | 0 |
| Ascusbbf_372F | 0 | 0 | 0 | 0 | 0 | + | + | + | − | 0 |
| Ascusbbf_372F | 0 | 0 | 0 | 0 | 0 | + | 0 | 0 | 0 | 0 |
| Ascusbbf_372G | 0 | − | + | − | + | + | + | 0 | 0 | 0 |
| Ascusbbf_372G | 0 | − | + | − | + | + | + | + | + | 0 |
| Ascusbbf_374A | 0 | 0 | + | + | + | + | + | 0 | + | 0 |
| Ascusbbf_374A | 0 | 0 | 0 | + | 0 | + | 0 | 0 | + | 0 |
| Ascusbbf_374B | 0 | 0 | + | + | + | + | + | 0 | + | 0 |
| Ascusbbf_374B | 0 | 0 | 0 | + | 0 | + | 0 | 0 | + | 0 |
| Ascusbbf_374C | 0 | 0 | + | + | + | + | + | 0 | + | 0 |
| Ascusbbf_374C | 0 | 0 | 0 | + | 0 | + | 0 | 0 | + | 0 |
| Ascusbbf_3819A | + | − | 0 | + | + | + | + | 0 | − | 0 |
| Ascusbbf_3819A | 0 | 0 | 0 | + | 0 | + | 0 | 0 | + | 0 |
| Ascusbbf_3875A | 0 | − | + | − | + | + | + | 0 | 0 | 0 |
| Ascusbbf_3875A | 0 | 0 | 0 | 0 | + | + | 0 | + | + | 0 |
| Ascusbbf_3875A | 0 | − | + | 0 | 0 | + | + | 0 | 0 | 0 |
| Ascusbbf_3875B | 0 | 0 | 0 | 0 | − | − | 0 | + | 0 | 0 |
| Ascusbbf_3875B | 0 | − | + | 0 | 0 | + | + | + | + | 0 |
| Ascusbbf_3875C | 0 | − | + | − | + | + | + | 0 | 0 | 0 |
| Ascusbbf_3875C | 0 | 0 | 0 | 0 | 0 | + | + | + | − | 0 |
| Ascusbbf_3875D | 0 | 0 | 0 | 0 | 0 | + | + | + | − | 0 |
| Ascusbbf_39159A | 0 | 0 | 0 | 0 | 0 | + | + | + | − | 0 |
| Ascusbbf_39159B | 0 | 0 | 0 | 0 | 0 | + | + | + | − | 0 |
| Ascusbbf_39159C | 0 | − | + | − | − | + | − | + | − | 0 |
| Ascusbbf_39159D | 0 | − | + | − | + | + | + | + | + | 0 |
| Ascusbbf_3A | 0 | − | + | − | + | + | + | 0 | 0 | 0 |
| Ascusbbf_3A | 0 | 0 | 0 | 0 | − | − | 0 | + | 0 | 0 |
| Ascusbbf_3A | 0 | 0 | 0 | 0 | + | + | 0 | + | + | 0 |
| Ascusbbf_3A | 0 | 0 | 0 | 0 | + | − | 0 | 0 | + | 0 |
| Ascusbbf_3A | 0 | 0 | 0 | 0 | 0 | + | 0 | 0 | 0 | 0 |
| Ascusbbf_3A | 0 | 0 | 0 | + | 0 | + | 0 | 0 | 0 | 0 |
| Ascusbbf_3B | 0 | 0 | 0 | 0 | − | − | 0 | + | 0 | 0 |
| Ascusbbf_3B | 0 | 0 | 0 | 0 | + | + | 0 | + | + | 0 |
| Ascusbbf_3B | 0 | 0 | 0 | 0 | + | − | 0 | 0 | + | 0 |
| Ascusbbf_3B | 0 | 0 | 0 | 0 | 0 | + | 0 | 0 | 0 | 0 |
| Ascusbbf_3B | 0 | 0 | 0 | + | 0 | + | 0 | 0 | 0 | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_3C | 0 | 0 | 0 | 0 | − | − | 0 | + | 0 | 0 |
| Ascusbbf_3C | 0 | 0 | 0 | 0 | + | + | 0 | + | + | 0 |
| Ascusbbf_3C | 0 | 0 | 0 | 0 | + | − | 0 | 0 | + | 0 |
| Ascusbbf_3C | 0 | 0 | 0 | 0 | 0 | + | 0 | 0 | 0 | 0 |
| Ascusbbf_3D | 0 | 0 | 0 | 0 | − | − | 0 | + | 0 | 0 |
| Ascusbbf_3E | 0 | − | + | 0 | 0 | + | + | 0 | + | 0 |
| Ascusbbf_3F | 0 | − | + | 0 | 0 | + | + | + | + | 0 |
| Ascusbbf_3G | 0 | 0 | 0 | 0 | 0 | + | 0 | 0 | 0 | 0 |
| Ascusbbf_41015A | 0 | − | + | − | + | + | + | 0 | 0 | 0 |
| Ascusbbf_41015A | 0 | 0 | 0 | 0 | + | + | 0 | + | + | 0 |
| Ascusbbf_41015A | 0 | 0 | 0 | 0 | 0 | + | 0 | 0 | 0 | 0 |
| Ascusbbf_41015B | 0 | − | + | − | + | + | + | 0 | 0 | 0 |
| Ascusbbf_41015C | 0 | 0 | 0 | 0 | 0 | + | + | + | − | 0 |
| Ascusbbf_41015D | 0 | − | + | − | + | + | + | + | + | 0 |
| Ascusbbf_41015E | 0 | − | + | − | + | + | + | + | + | 0 |
| Ascusbbf_416A | 0 | 0 | 0 | 0 | + | − | 0 | 0 | + | 0 |
| Ascusbbf_416B | 0 | 0 | 0 | 0 | + | − | 0 | 0 | + | 0 |
| Ascusbbf_416B | 0 | 0 | + | + | + | + | + | 0 | + | 0 |
| Ascusbbf_416B | 0 | 0 | 0 | + | 0 | + | 0 | 0 | + | 0 |
| Ascusbbf_416C | 0 | 0 | 0 | 0 | + | − | 0 | 0 | + | 0 |
| Ascusbbf_416C | 0 | − | + | − | − | + | − | + | − | 0 |
| Ascusbbf_416D | 0 | 0 | 0 | 0 | + | − | 0 | 0 | + | 0 |
| Ascusbbf_416D | 0 | − | + | − | − | + | − | + | − | 0 |
| Ascusbbf_416E | 0 | 0 | 0 | 0 | + | − | 0 | 0 | + | 0 |
| Ascusbbf_416F | 0 | 0 | 0 | 0 | + | − | 0 | 0 | + | 0 |
| Ascusbbf_416F | 0 | 0 | + | + | + | + | + | 0 | + | 0 |
| Ascusbbf_416F | 0 | 0 | 0 | + | 0 | + | 0 | 0 | + | 0 |
| Ascusbbf_416G | 0 | − | + | − | − | + | − | + | − | 0 |
| Ascusbbf_4317A | 0 | 0 | 0 | 0 | 0 | + | + | + | − | 0 |
| Ascusbbf_4317B | 0 | 0 | 0 | 0 | 0 | + | + | + | − | 0 |
| Ascusbbf_4317C | 0 | − | + | 0 | 0 | + | + | 0 | + | 0 |
| Ascusbbf_4317D | 0 | 0 | 0 | + | 0 | + | 0 | 0 | + | 0 |
| Ascusbbf_4317D | 0 | 0 | 0 | + | 0 | + | 0 | 0 | + | 0 |
| Ascusbbf_4317E | 0 | 0 | + | + | + | + | + | 0 | + | 0 |
| Ascusbbf_4317E | 0 | 0 | 0 | + | 0 | + | 0 | 0 | + | 0 |
| Ascusbbf_4323A | 0 | 0 | 0 | + | 0 | + | 0 | 0 | + | 0 |
| Ascusbbf_4323A | 0 | 0 | 0 | + | 0 | + | 0 | 0 | + | 0 |
| Ascusbbf_4323B | 0 | 0 | 0 | + | 0 | + | 0 | 0 | + | 0 |
| Ascusbbf_4323B | 0 | 0 | 0 | + | 0 | + | 0 | 0 | + | 0 |
| Ascusbbf_4323C | 0 | 0 | 0 | + | 0 | + | 0 | 0 | + | 0 |
| Ascusbbf_4323C | 0 | 0 | 0 | + | 0 | + | 0 | 0 | + | 0 |
| Ascusbbf_4323D | 0 | 0 | 0 | + | 0 | + | 0 | 0 | + | 0 |
| Ascusbbf_4323D | 0 | 0 | 0 | + | 0 | + | 0 | 0 | + | 0 |
| Ascusbbf_43679A | 0 | 0 | 0 | 0 | − | − | 0 | + | 0 | 0 |
| Ascusbbf_43679A | 0 | 0 | 0 | 0 | + | + | 0 | + | + | 0 |
| Ascusbbf_43679A | 0 | 0 | 0 | 0 | 0 | + | 0 | 0 | 0 | 0 |
| Ascusbbf_43679B | 0 | 0 | 0 | 0 | 0 | + | + | + | − | 0 |
| Ascusbbf_43679C | 0 | 0 | 0 | 0 | 0 | + | + | + | − | 0 |
| Ascusbbf_43679D | 0 | 0 | 0 | 0 | 0 | + | + | + | − | 0 |
| Ascusbbf_43679E | 0 | 0 | 0 | 0 | + | + | 0 | + | + | 0 |
| Ascusbbf_43679E | 0 | 0 | 0 | 0 | 0 | + | 0 | 0 | 0 | 0 |
| Ascusbbf_43679F | 0 | − | + | − | − | + | − | + | − | 0 |
| Ascusbbf_4691A | 0 | 0 | 0 | + | 0 | + | 0 | 0 | + | 0 |
| Ascusbbf_4691A | 0 | 0 | 0 | + | 0 | + | 0 | 0 | + | 0 |
| Ascusbbf_4691B | 0 | 0 | 0 | + | 0 | + | 0 | 0 | + | 0 |
| Ascusbbf_4691B | 0 | 0 | 0 | + | 0 | + | 0 | 0 | + | 0 |
| Ascusbbf_4691C | 0 | 0 | 0 | + | 0 | + | 0 | 0 | + | 0 |
| Ascusbbf_4691C | 0 | 0 | 0 | + | 0 | + | 0 | 0 | + | 0 |
| Ascusbbf_4883A | 0 | − | + | 0 | 0 | + | + | 0 | + | 0 |
| Ascusbbf_4883A | 0 | 0 | 0 | 0 | + | − | 0 | 0 | + | 0 |
| Ascusbbf_4883B | 0 | 0 | 0 | 0 | + | − | 0 | 0 | + | 0 |
| Ascusbbf_4883B | 0 | 0 | 0 | + | 0 | + | 0 | 0 | + | 0 |
| Ascusbbf_4883B | 0 | 0 | 0 | + | 0 | + | 0 | 0 | + | 0 |
| Ascusbbf_4883C | 0 | 0 | 0 | 0 | + | − | 0 | 0 | + | 0 |
| Ascusbbf_4883C | 0 | − | + | − | − | + | − | + | − | 0 |
| Ascusbbf_4883C | 0 | 0 | + | + | + | + | + | 0 | + | 0 |
| Ascusbbf_4883D | 0 | 0 | 0 | 0 | + | − | 0 | 0 | + | 0 |
| Ascusbbf_4883D | 0 | − | + | − | − | + | − | + | − | 0 |
| Ascusbbf_4883D | 0 | 0 | + | + | + | + | + | 0 | + | 0 |
| Ascusbbf_4883E | 0 | − | + | − | − | + | − | + | − | 0 |
| Ascusbbf_4936A | 0 | 0 | 0 | 0 | + | + | 0 | + | + | 0 |
| Ascusbbf_4936A | 0 | 0 | 0 | 0 | 0 | + | 0 | 0 | 0 | 0 |
| Ascusbbf_4936B | 0 | 0 | 0 | 0 | + | + | 0 | + | + | 0 |
| Ascusbbf_4A | + | − | + | − | 0 | + | + | + | − | 0 |
| Ascusbbf_4A | + | − | + | − | 0 | + | + | 0 | + | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_4B | 0 | 0 | 0 | 0 | − | − | 0 | + | 0 | 0 |
| Ascusbbf_4B | 0 | 0 | 0 | 0 | + | + | 0 | + | + | 0 |
| Ascusbbf_4B | 0 | − | + | 0 | 0 | + | + | + | + | 0 |
| Ascusbbf_4B | 0 | 0 | 0 | 0 | + | − | 0 | 0 | + | 0 |
| Ascusbbf_4B | 0 | − | + | + | + | + | 0 | 0 | + | 0 |
| Ascusbbf_4B | 0 | 0 | 0 | + | 0 | + | 0 | 0 | 0 | 0 |
| Ascusbbf_4C | 0 | 0 | 0 | 0 | 0 | + | + | + | − | 0 |
| Ascusbbf_4C | 0 | 0 | + | + | + | + | + | 0 | + | 0 |
| Ascusbbf_4D | 0 | 0 | 0 | 0 | − | − | 0 | + | 0 | 0 |
| Ascusbbf_4D | 0 | 0 | 0 | 0 | + | + | 0 | + | + | 0 |
| Ascusbbf_4D | 0 | − | + | − | + | + | + | + | + | 0 |
| Ascusbbf_4D | 0 | − | + | + | + | + | 0 | 0 | + | 0 |
| Ascusbbf_4D | 0 | 0 | + | + | + | + | + | 0 | + | 0 |
| Ascusbbf_4D | 0 | 0 | 0 | + | 0 | + | 0 | 0 | 0 | 0 |
| Ascusbbf_4E | 0 | 0 | 0 | 0 | − | − | 0 | + | 0 | 0 |
| Ascusbbf_4E | 0 | 0 | 0 | 0 | + | + | 0 | + | + | 0 |
| Ascusbbf_4E | 0 | 0 | 0 | 0 | 0 | + | 0 | 0 | 0 | 0 |
| Ascusbbf_4E | 0 | 0 | 0 | + | 0 | + | 0 | 0 | 0 | 0 |
| Ascusbbf_4F | 0 | − | + | − | + | + | + | 0 | 0 | 0 |
| Ascusbbf_4F | 0 | 0 | 0 | 0 | − | − | 0 | + | 0 | 0 |
| Ascusbbf_4F | 0 | 0 | 0 | 0 | + | + | 0 | + | + | 0 |
| Ascusbbf_4F | 0 | − | + | 0 | 0 | + | + | 0 | + | 0 |
| Ascusbbf_4F | 0 | − | + | + | + | + | 0 | 0 | + | 0 |
| Ascusbbf_4F | 0 | 0 | + | + | + | + | + | 0 | + | 0 |
| Ascusbbf_4F | 0 | 0 | 0 | + | 0 | + | 0 | 0 | 0 | 0 |
| Ascusbbf_4F | 0 | − | + | + | − | + | 0 | 0 | 0 | 0 |
| Ascusbbf_4G | 0 | 0 | 0 | 0 | + | + | 0 | + | + | 0 |
| Ascusbbf_4G | 0 | − | + | 0 | 0 | + | + | + | + | 0 |
| Ascusbbf_4G | 0 | 0 | 0 | 0 | + | − | 0 | 0 | + | 0 |
| Ascusbbf_4G | 0 | 0 | 0 | 0 | 0 | + | 0 | 0 | 0 | 0 |
| Ascusbbf_4G | 0 | 0 | 0 | + | 0 | + | 0 | 0 | + | 0 |
| Ascusbbf_4G | 0 | 0 | 0 | + | 0 | + | 0 | 0 | 0 | 0 |
| Ascusbbf_4H | 0 | 0 | 0 | 0 | + | + | 0 | + | + | 0 |
| Ascusbbf_4H | 0 | − | + | 0 | 0 | + | + | 0 | + | 0 |
| Ascusbbf_4H | 0 | 0 | 0 | 0 | + | − | 0 | 0 | + | 0 |
| Ascusbbf_4H | 0 | 0 | 0 | 0 | 0 | + | 0 | 0 | 0 | 0 |
| Ascusbbf_4H | 0 | 0 | 0 | + | 0 | + | 0 | 0 | + | 0 |
| Ascusbbf_4H | 0 | 0 | 0 | + | 0 | + | 0 | 0 | + | 0 |
| Ascusbbf_4I | 0 | 0 | 0 | 0 | + | + | 0 | + | + | 0 |
| Ascusbbf_4I | 0 | 0 | 0 | 0 | + | − | 0 | 0 | + | 0 |
| Ascusbbf_4I | 0 | 0 | 0 | 0 | 0 | + | 0 | 0 | 0 | 0 |
| Ascusbbf_4I | 0 | 0 | 0 | + | 0 | + | 0 | 0 | 0 | 0 |
| Ascusbbf_4J | 0 | 0 | 0 | 0 | + | + | 0 | + | + | 0 |
| Ascusbbf_4J | 0 | 0 | 0 | 0 | 0 | + | 0 | 0 | 0 | 0 |
| Ascusbbf_4K | 0 | 0 | + | + | + | + | + | 0 | 0 | 0 |
| Ascusbbf_5005A | 0 | 0 | 0 | 0 | + | − | 0 | 0 | + | 0 |
| Ascusbbf_5005A | 0 | − | + | − | − | + | − | + | − | 0 |
| Ascusbbf_5005A | 0 | 0 | 0 | + | 0 | + | 0 | 0 | + | 0 |
| Ascusbbf_5005A | 0 | 0 | 0 | + | 0 | + | 0 | 0 | + | 0 |
| Ascusbbf_5005B | 0 | − | + | − | − | + | − | + | − | 0 |
| Ascusbbf_50658A | 0 | − | + | − | − | + | − | + | − | 0 |
| Ascusbbf_5131A | 0 | 0 | 0 | 0 | + | − | 0 | 0 | + | 0 |
| Ascusbbf_5131A | 0 | − | + | − | − | + | − | + | − | 0 |
| Ascusbbf_5131A | 0 | 0 | 0 | + | 0 | + | 0 | 0 | + | 0 |
| Ascusbbf_5131A | 0 | 0 | 0 | + | 0 | + | 0 | 0 | + | 0 |
| Ascusbbf_5131B | 0 | 0 | 0 | 0 | + | − | 0 | 0 | + | 0 |
| Ascusbbf_5131B | 0 | 0 | 0 | + | + | + | + | 0 | 0 | 0 |
| Ascusbbf_5131C | 0 | 0 | 0 | 0 | + | − | 0 | 0 | + | 0 |
| Ascusbbf_5131C | 0 | 0 | 0 | + | 0 | + | 0 | 0 | + | 0 |
| Ascusbbf_5131C | 0 | 0 | 0 | + | 0 | + | 0 | 0 | + | 0 |
| Ascusbbf_5131D | 0 | 0 | 0 | 0 | + | − | 0 | 0 | + | 0 |
| Ascusbbf_5131D | 0 | 0 | 0 | + | 0 | + | 0 | 0 | + | 0 |
| Ascusbbf_5131D | 0 | 0 | 0 | + | 0 | + | 0 | 0 | + | 0 |
| Ascusbbf_5131E | 0 | 0 | 0 | + | 0 | + | 0 | 0 | + | 0 |
| Ascusbbf_5131F | 0 | 0 | + | + | + | + | + | 0 | + | 0 |
| Ascusbbf_5131G | 0 | 0 | + | + | + | + | + | 0 | + | 0 |
| Ascusbbf_5131G | 0 | 0 | 0 | + | 0 | + | 0 | 0 | + | 0 |
| Ascusbbf_5131H | 0 | 0 | + | + | + | + | + | 0 | + | 0 |
| Ascusbbf_5131H | 0 | 0 | 0 | + | 0 | + | 0 | 0 | + | 0 |
| Ascusbbf_52330A | 0 | − | + | − | + | + | + | 0 | 0 | 0 |
| Ascusbbf_5251A | 0 | 0 | + | − | + | + | + | 0 | 0 | 0 |
| Ascusbbf_5251A | 0 | 0 | 0 | 0 | + | − | 0 | 0 | + | 0 |
| Ascusbbf_5251A | 0 | − | + | − | − | + | − | + | − | 0 |
| Ascusbbf_5251B | 0 | − | + | − | + | + | + | 0 | 0 | 0 |
| Ascusbbf_5251B | 0 | 0 | 0 | 0 | 0 | + | + | + | − | 0 |
| Ascusbbf_5251C | 0 | 0 | 0 | 0 | 0 | + | + | + | − | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_5251C | 0 | 0 | 0 | 0 | + | − | 0 | 0 | + | 0 |
| Ascusbbf_5251C | 0 | − | + | − | − | + | − | + | − | 0 |
| Ascusbbf_5251C | 0 | 0 | + | + | + | + | + | 0 | + | 0 |
| Ascusbbf_5251C | 0 | 0 | 0 | + | 0 | + | 0 | 0 | + | 0 |
| Ascusbbf_5251D | 0 | − | + | − | + | + | + | 0 | 0 | 0 |
| Ascusbbf_5251D | 0 | 0 | 0 | 0 | 0 | + | + | + | − | 0 |
| Ascusbbf_5251D | 0 | 0 | 0 | 0 | + | − | 0 | 0 | + | 0 |
| Ascusbbf_5251E | 0 | 0 | 0 | 0 | + | − | 0 | 0 | + | 0 |
| Ascusbbf_5251E | 0 | − | + | − | − | + | − | + | − | 0 |
| Ascusbbf_5251E | 0 | 0 | 0 | + | 0 | + | 0 | 0 | + | 0 |
| Ascusbbf_5251E | 0 | 0 | 0 | + | 0 | + | 0 | 0 | + | 0 |
| Ascusbbf_5251F | 0 | 0 | 0 | + | 0 | + | 0 | 0 | + | 0 |
| Ascusbbf_5251G | 0 | 0 | + | + | + | + | + | 0 | + | 0 |
| Ascusbbf_5251G | 0 | 0 | 0 | + | 0 | + | 0 | 0 | + | 0 |
| Ascusbbf_52548A | 0 | 0 | 0 | + | 0 | + | 0 | 0 | + | 0 |
| Ascusbbf_52548A | 0 | 0 | 0 | + | 0 | + | 0 | 0 | + | 0 |
| Ascusbbf_52548B | 0 | 0 | 0 | + | 0 | + | 0 | 0 | + | 0 |
| Ascusbbf_52548B | 0 | 0 | 0 | + | 0 | + | 0 | 0 | 0 | 0 |
| Ascusbbf_54068A | + | − | + | − | 0 | + | + | + | − | 0 |
| Ascusbbf_54068B | 0 | − | + | − | + | + | + | 0 | 0 | 0 |
| Ascusbbf_54068C | 0 | − | + | − | + | + | + | 0 | 0 | 0 |
| Ascusbbf_54068C | 0 | 0 | 0 | 0 | − | − | 0 | + | 0 | 0 |
| Ascusbbf_54068C | 0 | 0 | 0 | 0 | + | + | 0 | + | + | 0 |
| Ascusbbf_54068C | 0 | − | + | 0 | 0 | + | + | + | + | 0 |
| Ascusbbf_54068C | 0 | 0 | 0 | 0 | + | − | 0 | 0 | + | 0 |
| Ascusbbf_54068D | 0 | − | + | − | + | + | + | 0 | 0 | 0 |
| Ascusbbf_54068D | 0 | 0 | 0 | 0 | + | + | 0 | + | + | 0 |
| Ascusbbf_54068D | 0 | − | + | 0 | 0 | + | + | 0 | + | 0 |
| Ascusbbf_54068D | 0 | 0 | 0 | 0 | + | − | 0 | 0 | + | 0 |
| Ascusbbf_54068D | 0 | − | + | − | − | + | − | + | − | 0 |
| Ascusbbf_5429A | 0 | 0 | 0 | 0 | − | − | 0 | + | 0 | 0 |
| Ascusbbf_5429A | 0 | 0 | 0 | 0 | + | + | 0 | + | + | 0 |
| Ascusbbf_5429A | 0 | 0 | 0 | 0 | + | − | 0 | 0 | + | 0 |
| Ascusbbf_5429A | 0 | 0 | 0 | 0 | 0 | + | 0 | 0 | 0 | 0 |
| Ascusbbf_5429A | 0 | 0 | 0 | + | 0 | + | 0 | 0 | 0 | 0 |
| Ascusbbf_5429B | 0 | 0 | 0 | 0 | − | − | 0 | + | 0 | 0 |
| Ascusbbf_5429B | 0 | 0 | 0 | 0 | + | + | 0 | + | + | 0 |
| Ascusbbf_5429B | 0 | 0 | 0 | 0 | + | − | 0 | 0 | + | 0 |
| Ascusbbf_5429B | 0 | 0 | 0 | 0 | 0 | + | 0 | 0 | 0 | 0 |
| Ascusbbf_5429B | 0 | 0 | 0 | + | 0 | + | 0 | 0 | 0 | 0 |
| Ascusbbf_5429C | 0 | − | + | − | + | + | + | 0 | 0 | 0 |
| Ascusbbf_5429C | 0 | − | + | 0 | 0 | + | + | 0 | + | 0 |
| Ascusbbf_5429D | 0 | 0 | 0 | 0 | + | − | 0 | 0 | + | 0 |
| Ascusbbf_5575A | + | − | + | − | 0 | + | + | + | − | 0 |
| Ascusbbf_5575A | 0 | − | 0 | 0 | 0 | + | 0 | + | + | 0 |
| Ascusbbf_5575B | + | − | + | − | 0 | + | + | + | − | 0 |
| Ascusbbf_5575B | 0 | − | 0 | 0 | 0 | + | 0 | + | + | 0 |
| Ascusbbf_5575C | 0 | − | + | − | + | + | + | 0 | 0 | 0 |
| Ascusbbf_5575C | 0 | − | + | 0 | 0 | + | + | + | + | 0 |
| Ascusbbf_5575C | 0 | 0 | 0 | 0 | 0 | + | 0 | 0 | 0 | 0 |
| Ascusbbf_5575D | 0 | − | + | − | − | 0 | 0 | + | + | 0 |
| Ascusbbf_5575D | 0 | − | + | 0 | 0 | + | + | + | + | 0 |
| Ascusbbf_5575D | 0 | − | + | + | + | + | 0 | 0 | + | 0 |
| Ascusbbf_5575D | 0 | − | + | − | − | 0 | 0 | + | + | 0 |
| Ascusbbf_5575E | 0 | − | + | − | + | + | + | 0 | 0 | 0 |
| Ascusbbf_5575E | 0 | − | + | 0 | 0 | + | + | + | + | 0 |
| Ascusbbf_5575E | 0 | 0 | 0 | 0 | + | − | 0 | 0 | + | 0 |
| Ascusbbf_5575E | 0 | 0 | 0 | + | 0 | + | 0 | 0 | 0 | 0 |
| Ascusbbf_5575F | 0 | − | + | − | + | + | + | 0 | 0 | 0 |
| Ascusbbf_5575F | 0 | − | + | 0 | 0 | + | + | + | + | 0 |
| Ascusbbf_5575F | 0 | 0 | 0 | 0 | + | − | 0 | 0 | + | 0 |
| Ascusbbf_5575G | 0 | − | + | − | + | + | + | 0 | 0 | 0 |
| Ascusbbf_5575G | 0 | − | + | 0 | 0 | + | + | + | + | 0 |
| Ascusbbf_5575G | 0 | 0 | 0 | 0 | + | − | 0 | 0 | + | 0 |
| Ascusbbf_5575G | 0 | − | + | + | + | + | 0 | 0 | + | 0 |
| Ascusbbf_5575H | 0 | − | + | − | + | + | + | 0 | 0 | 0 |
| Ascusbbf_5575H | 0 | − | + | 0 | 0 | + | + | + | + | 0 |
| Ascusbbf_5575H | 0 | − | + | − | − | + | − | + | − | 0 |
| Ascusbbf_5588A | 0 | 0 | 0 | 0 | − | − | 0 | + | 0 | 0 |
| Ascusbbf_5588A | 0 | 0 | 0 | 0 | 0 | + | + | + | − | 0 |
| Ascusbbf_5588A | 0 | 0 | + | 0 | 0 | + | + | 0 | 0 | 0 |
| Ascusbbf_5588A | 0 | 0 | 0 | 0 | + | − | 0 | 0 | + | 0 |
| Ascusbbf_5588A | 0 | − | + | − | − | + | − | + | − | 0 |
| Ascusbbf_5588B | 0 | 0 | 0 | 0 | − | − | 0 | + | 0 | 0 |
| Ascusbbf_5588B | 0 | − | + | 0 | 0 | + | + | 0 | + | 0 |
| Ascusbbf_5588C | 0 | 0 | 0 | 0 | − | − | 0 | + | 0 | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_5588C | 0 | 0 | 0 | 0 | 0 | + | + | + | − | 0 |
| Ascusbbf_5588C | 0 | − | + | 0 | 0 | + | + | 0 | + | 0 |
| Ascusbbf_5588C | 0 | 0 | 0 | 0 | + | − | 0 | 0 | + | 0 |
| Ascusbbf_5588C | 0 | − | + | − | − | + | − | + | − | 0 |
| Ascusbbf_5588C | 0 | 0 | 0 | + | 0 | + | 0 | 0 | + | 0 |
| Ascusbbf_5588C | 0 | 0 | 0 | + | 0 | + | 0 | 0 | + | 0 |
| Ascusbbf_5588D | 0 | 0 | 0 | 0 | − | − | 0 | + | 0 | 0 |
| Ascusbbf_5588D | 0 | 0 | 0 | 0 | + | + | 0 | + | + | 0 |
| Ascusbbf_5588D | 0 | − | + | 0 | 0 | + | + | 0 | + | 0 |
| Ascusbbf_5588D | 0 | 0 | 0 | 0 | + | + | 0 | 0 | + | 0 |
| Ascusbbf_5588D | 0 | 0 | 0 | 0 | 0 | + | 0 | 0 | 0 | 0 |
| Ascusbbf_5588D | 0 | 0 | + | + | + | + | + | 0 | + | 0 |
| Ascusbbf_5588D | 0 | 0 | 0 | + | 0 | + | 0 | 0 | 0 | 0 |
| Ascusbbf_5588E | 0 | − | + | 0 | 0 | + | + | 0 | + | 0 |
| Ascusbbf_5588F | 0 | − | + | 0 | 0 | + | + | 0 | + | 0 |
| Ascusbbf_5588G | 0 | − | + | 0 | 0 | + | + | 0 | + | 0 |
| Ascusbbf_5588H | 0 | 0 | 0 | 0 | + | − | 0 | 0 | + | 0 |
| Ascusbbf_5588H | 0 | 0 | + | + | + | + | + | 0 | + | 0 |
| Ascusbbf_56782A | 0 | − | + | − | + | + | + | 0 | 0 | 0 |
| Ascusbbf_56782A | 0 | 0 | 0 | 0 | + | + | 0 | + | + | 0 |
| Ascusbbf_56782A | 0 | − | + | 0 | 0 | + | + | + | + | 0 |
| Ascusbbf_56782A | 0 | 0 | 0 | 0 | + | − | 0 | 0 | + | 0 |
| Ascusbbf_56782A | 0 | 0 | 0 | 0 | 0 | + | 0 | 0 | 0 | 0 |
| Ascusbbf_56782A | 0 | 0 | 0 | + | 0 | + | 0 | 0 | + | 0 |
| Ascusbbf_56782A | 0 | 0 | 0 | + | 0 | + | 0 | 0 | + | 0 |
| Ascusbbf_56782B | 0 | 0 | + | + | + | + | + | 0 | + | 0 |
| Ascusbbf_56782C | 0 | 0 | + | + | + | + | + | 0 | + | 0 |
| Ascusbbf_5699A | 0 | 0 | 0 | 0 | + | − | 0 | 0 | + | 0 |
| Ascusbbf_5699A | 0 | − | + | − | − | + | − | + | − | 0 |
| Ascusbbf_5699B | 0 | 0 | 0 | 0 | + | − | 0 | 0 | + | 0 |
| Ascusbbf_5699B | 0 | − | + | − | − | + | − | + | − | 0 |
| Ascusbbf_5699C | 0 | 0 | 0 | 0 | + | − | 0 | 0 | + | 0 |
| Ascusbbf_5699C | 0 | − | + | − | − | + | − | + | − | 0 |
| Ascusbbf_5699D | 0 | − | + | − | − | + | − | + | − | 0 |
| Ascusbbf_5699D | 0 | 0 | + | + | + | + | + | 0 | + | 0 |
| Ascusbbf_57294A | 0 | 0 | 0 | 0 | + | + | 0 | + | + | 0 |
| Ascusbbf_57294A | + | − | + | − | 0 | + | + | + | − | 0 |
| Ascusbbf_57294B | 0 | − | + | − | + | + | + | 0 | 0 | 0 |
| Ascusbbf_57294B | 0 | 0 | 0 | 0 | 0 | + | 0 | 0 | 0 | 0 |
| Ascusbbf_57294C | 0 | − | + | − | + | + | + | 0 | 0 | 0 |
| Ascusbbf_57294C | 0 | 0 | 0 | + | 0 | + | 0 | 0 | 0 | 0 |
| Ascusbbf_6012A | + | − | + | − | 0 | + | + | + | − | 0 |
| Ascusbbf_6012B | 0 | 0 | 0 | 0 | − | − | 0 | + | 0 | 0 |
| Ascusbbf_6012B | 0 | 0 | 0 | 0 | 0 | + | + | + | − | 0 |
| Ascusbbf_6012B | 0 | 0 | 0 | 0 | + | − | 0 | 0 | + | 0 |
| Ascusbbf_6012B | 0 | 0 | 0 | 0 | 0 | + | 0 | 0 | 0 | 0 |
| Ascusbbf_6012C | 0 | 0 | 0 | 0 | − | − | 0 | + | 0 | 0 |
| Ascusbbf_6012C | 0 | 0 | 0 | 0 | + | + | 0 | + | + | 0 |
| Ascusbbf_6012C | 0 | 0 | 0 | 0 | + | − | 0 | 0 | + | 0 |
| Ascusbbf_6012C | 0 | − | + | − | − | + | − | + | − | 0 |
| Ascusbbf_6012D | 0 | 0 | 0 | 0 | 0 | + | + | + | − | 0 |
| Ascusbbf_6012D | 0 | 0 | 0 | 0 | + | − | 0 | 0 | + | 0 |
| Ascusbbf_6012E | 0 | 0 | 0 | 0 | 0 | + | + | + | − | 0 |
| Ascusbbf_6087A | 0 | 0 | 0 | + | 0 | + | 0 | 0 | + | 0 |
| Ascusbbf_6087A | 0 | 0 | 0 | + | 0 | + | 0 | 0 | + | 0 |
| Ascusbbf_6087B | 0 | 0 | 0 | + | 0 | + | 0 | 0 | + | 0 |
| Ascusbbf_6087B | 0 | 0 | 0 | + | 0 | + | 0 | 0 | + | 0 |
| Ascusbbf_6087C | 0 | 0 | 0 | + | 0 | + | 0 | 0 | + | 0 |
| Ascusbbf_6087C | 0 | 0 | 0 | + | 0 | + | 0 | 0 | + | 0 |
| Ascusbbf_6115A | 0 | − | + | − | + | + | + | 0 | 0 | 0 |
| Ascusbbf_6115A | 0 | 0 | 0 | 0 | 0 | + | + | + | − | 0 |
| Ascusbbf_6115B | 0 | 0 | 0 | 0 | + | + | 0 | + | + | 0 |
| Ascusbbf_6115B | 0 | 0 | 0 | 0 | 0 | + | 0 | 0 | 0 | 0 |
| Ascusbbf_6115C | 0 | 0 | 0 | 0 | + | + | 0 | + | + | 0 |
| Ascusbbf_6115C | 0 | 0 | 0 | 0 | 0 | + | 0 | 0 | 0 | 0 |
| Ascusbbf_6115D | 0 | 0 | 0 | 0 | + | + | 0 | + | + | 0 |
| Ascusbbf_6176A | 0 | 0 | 0 | 0 | 0 | + | + | + | − | 0 |
| Ascusbbf_6176A | 0 | − | + | 0 | 0 | + | + | 0 | + | 0 |
| Ascusbbf_6176A | 0 | 0 | 0 | 0 | + | − | 0 | 0 | + | 0 |
| Ascusbbf_6176A | 0 | − | + | − | − | + | − | + | − | 0 |
| Ascusbbf_6176A | 0 | 0 | 0 | + | 0 | + | 0 | 0 | + | 0 |
| Ascusbbf_6176B | 0 | 0 | 0 | 0 | 0 | + | + | + | − | 0 |
| Ascusbbf_6176B | 0 | − | + | 0 | 0 | + | + | 0 | + | 0 |
| Ascusbbf_6176B | 0 | 0 | 0 | 0 | + | − | 0 | 0 | + | 0 |
| Ascusbbf_6176B | 0 | − | + | − | − | + | − | + | − | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_6176B | 0 | 0 | 0 | + | 0 | + | 0 | 0 | + | 0 |
| Ascusbbf_6176B | 0 | 0 | 0 | + | 0 | + | 0 | 0 | + | 0 |
| Ascusbbf_6176C | 0 | 0 | 0 | 0 | + | + | 0 | + | + | 0 |
| Ascusbbf_6176C | 0 | 0 | 0 | 0 | + | − | 0 | 0 | + | 0 |
| Ascusbbf_6176C | 0 | 0 | 0 | 0 | 0 | + | 0 | 0 | 0 | 0 |
| Ascusbbf_6176D | 0 | 0 | 0 | 0 | + | − | 0 | 0 | + | 0 |
| Ascusbbf_6176D | 0 | 0 | 0 | + | 0 | + | 0 | 0 | + | 0 |
| Ascusbbf_6176D | 0 | 0 | 0 | + | 0 | + | 0 | 0 | + | 0 |
| Ascusbbf_6176E | 0 | 0 | 0 | 0 | + | − | 0 | 0 | + | 0 |
| Ascusbbf_6176E | 0 | 0 | 0 | + | 0 | + | 0 | 0 | + | 0 |
| Ascusbbf_6176E | 0 | 0 | 0 | + | 0 | + | 0 | 0 | + | 0 |
| Ascusbbf_6176F | 0 | 0 | 0 | 0 | + | − | 0 | 0 | + | 0 |
| Ascusbbf_6176G | 0 | 0 | 0 | 0 | + | − | 0 | 0 | + | 0 |
| Ascusbbf_6176G | 0 | − | + | − | − | + | − | + | − | 0 |
| Ascusbbf_6176G | 0 | 0 | 0 | + | 0 | + | 0 | 0 | + | 0 |
| Ascusbbf_6176G | 0 | 0 | 0 | + | 0 | + | 0 | 0 | 0 | 0 |
| Ascusbbf_6176H | 0 | 0 | 0 | 0 | + | − | 0 | 0 | + | 0 |
| Ascusbbf_6176H | 0 | 0 | 0 | + | 0 | + | 0 | 0 | + | 0 |
| Ascusbbf_6176H | 0 | 0 | 0 | + | 0 | + | 0 | 0 | + | 0 |
| Ascusbbf_6176I | 0 | − | + | − | − | + | − | + | − | 0 |
| Ascusbbf_6176I | 0 | 0 | 0 | + | 0 | + | 0 | 0 | + | 0 |
| Ascusbbf_6176I | 0 | 0 | 0 | + | 0 | + | 0 | 0 | + | 0 |
| Ascusbbf_63954A | 0 | 0 | 0 | 0 | + | − | 0 | 0 | + | 0 |
| Ascusbbf_667A | 0 | − | + | − | + | + | + | + | + | 0 |
| Ascusbbf_667A | 0 | 0 | 0 | 0 | + | − | 0 | 0 | + | 0 |
| Ascusbbf_667A | 0 | − | + | − | − | + | − | + | − | 0 |
| Ascusbbf_667A | 0 | 0 | 0 | + | 0 | + | 0 | 0 | 0 | 0 |
| Ascusbbf_667B | 0 | − | + | − | + | + | + | + | + | 0 |
| Ascusbbf_667B | 0 | 0 | 0 | 0 | + | − | 0 | 0 | + | 0 |
| Ascusbbf_6906A | 0 | 0 | + | + | + | + | + | 0 | + | 0 |
| Ascusbbf_6906A | 0 | 0 | 0 | + | 0 | + | 0 | 0 | + | 0 |
| Ascusbbf_6906B | 0 | 0 | + | + | + | + | + | 0 | + | 0 |
| Ascusbbf_6906C | 0 | 0 | + | + | + | + | + | 0 | + | 0 |
| Ascusbbf_6906C | 0 | 0 | 0 | + | 0 | + | 0 | 0 | + | 0 |
| Ascusbbf_6906D | 0 | 0 | + | + | + | + | + | 0 | + | 0 |
| Ascusbbf_6906E | 0 | 0 | + | + | + | + | + | 0 | + | 0 |
| Ascusbbf_6906E | 0 | 0 | 0 | + | 0 | + | 0 | 0 | + | 0 |
| Ascusbbf_69A | 0 | − | + | − | + | + | + | 0 | 0 | 0 |
| Ascusbbf_69A | 0 | 0 | 0 | 0 | − | − | 0 | + | 0 | 0 |
| Ascusbbf_69A | 0 | 0 | 0 | 0 | + | + | 0 | + | + | 0 |
| Ascusbbf_69A | 0 | − | + | 0 | 0 | + | + | 0 | + | 0 |
| Ascusbbf_69A | 0 | 0 | 0 | 0 | + | − | 0 | 0 | + | 0 |
| Ascusbbf_69A | 0 | 0 | 0 | 0 | 0 | + | 0 | 0 | 0 | 0 |
| Ascusbbf_69A | 0 | 0 | + | + | + | + | + | 0 | + | 0 |
| Ascusbbf_69A | 0 | 0 | 0 | + | 0 | + | 0 | 0 | + | 0 |
| Ascusbbf_69B | 0 | − | + | − | + | + | + | 0 | 0 | 0 |
| Ascusbbf_69B | 0 | 0 | 0 | 0 | − | − | 0 | + | 0 | 0 |
| Ascusbbf_69B | 0 | 0 | 0 | 0 | + | + | 0 | + | + | 0 |
| Ascusbbf_69B | 0 | − | + | 0 | 0 | + | + | 0 | + | 0 |
| Ascusbbf_69B | 0 | 0 | 0 | 0 | + | − | 0 | 0 | + | 0 |
| Ascusbbf_69B | 0 | − | + | − | − | + | − | + | − | 0 |
| Ascusbbf_69B | 0 | 0 | 0 | + | 0 | + | 0 | 0 | + | 0 |
| Ascusbbf_69B | 0 | 0 | 0 | + | 0 | + | 0 | 0 | + | 0 |
| Ascusbbf_69C | 0 | − | + | − | + | + | + | 0 | 0 | 0 |
| Ascusbbf_69C | 0 | 0 | 0 | 0 | − | − | 0 | + | 0 | 0 |
| Ascusbbf_69C | 0 | 0 | 0 | 0 | + | + | 0 | + | + | 0 |
| Ascusbbf_69C | 0 | − | + | 0 | 0 | + | + | 0 | + | 0 |
| Ascusbbf_69C | 0 | 0 | 0 | 0 | + | − | 0 | 0 | + | 0 |
| Ascusbbf_69C | 0 | 0 | 0 | 0 | 0 | + | 0 | 0 | 0 | 0 |
| Ascusbbf_69C | 0 | 0 | + | + | + | + | + | 0 | + | 0 |
| Ascusbbf_69C | 0 | 0 | 0 | + | 0 | + | 0 | 0 | + | 0 |
| Ascusbbf_69D | 0 | − | + | − | + | + | + | 0 | 0 | 0 |
| Ascusbbf_69D | 0 | 0 | 0 | 0 | − | − | 0 | + | 0 | 0 |
| Ascusbbf_69D | 0 | 0 | 0 | 0 | + | + | 0 | + | + | 0 |
| Ascusbbf_69D | 0 | 0 | 0 | 0 | + | − | 0 | 0 | + | 0 |
| Ascusbbf_69D | 0 | 0 | 0 | 0 | 0 | + | 0 | 0 | 0 | 0 |
| Ascusbbf_69D | 0 | 0 | + | + | + | + | + | 0 | + | 0 |
| Ascusbbf_69D | 0 | 0 | 0 | + | 0 | + | 0 | 0 | 0 | 0 |
| Ascusbbf_69E | 0 | − | + | − | + | + | + | 0 | 0 | 0 |
| Ascusbbf_69E | 0 | 0 | 0 | 0 | − | − | 0 | + | 0 | 0 |
| Ascusbbf_69E | 0 | 0 | 0 | 0 | + | + | 0 | + | + | 0 |
| Ascusbbf_69E | 0 | − | + | 0 | 0 | + | + | 0 | + | 0 |
| Ascusbbf_69E | 0 | 0 | 0 | 0 | + | − | 0 | 0 | + | 0 |
| Ascusbbf_69E | 0 | 0 | 0 | 0 | 0 | + | 0 | 0 | 0 | 0 |
| Ascusbbf_69E | 0 | 0 | + | + | + | + | + | 0 | + | 0 |
| Ascusbbf_69E | 0 | 0 | 0 | + | 0 | + | 0 | 0 | 0 | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_69F | 0 | − | + | − | + | + | + | 0 | 0 | 0 |
| Ascusbbf_69F | 0 | 0 | 0 | 0 | − | − | 0 | + | 0 | 0 |
| Ascusbbf_69F | 0 | − | + | 0 | 0 | + | + | + | + | 0 |
| Ascusbbf_69F | 0 | 0 | 0 | 0 | + | − | 0 | 0 | + | 0 |
| Ascusbbf_69F | 0 | 0 | 0 | 0 | 0 | + | 0 | 0 | 0 | 0 |
| Ascusbbf_69F | 0 | 0 | + | + | + | + | + | 0 | + | 0 |
| Ascusbbf_69F | 0 | 0 | 0 | + | 0 | + | 0 | 0 | + | 0 |
| Ascusbbf_69G | 0 | − | + | − | + | + | + | 0 | 0 | 0 |
| Ascusbbf_69G | 0 | 0 | 0 | 0 | + | + | 0 | + | + | 0 |
| Ascusbbf_69G | 0 | − | + | 0 | 0 | + | + | 0 | + | 0 |
| Ascusbbf_69G | 0 | 0 | 0 | 0 | + | − | 0 | 0 | + | 0 |
| Ascusbbf_69G | 0 | 0 | 0 | 0 | 0 | + | 0 | 0 | 0 | 0 |
| Ascusbbf_69G | 0 | 0 | + | + | + | + | + | 0 | + | 0 |
| Ascusbbf_69G | 0 | 0 | 0 | + | 0 | + | 0 | 0 | 0 | 0 |
| Ascusbbf_69H | 0 | − | + | − | + | + | + | 0 | 0 | 0 |
| Ascusbbf_69H | 0 | 0 | 0 | 0 | + | + | 0 | + | + | 0 |
| Ascusbbf_69H | 0 | − | + | 0 | 0 | + | + | + | + | 0 |
| Ascusbbf_69H | 0 | 0 | 0 | 0 | + | − | 0 | 0 | + | 0 |
| Ascusbbf_69H | 0 | 0 | 0 | 0 | 0 | + | 0 | 0 | 0 | 0 |
| Ascusbbf_69H | 0 | 0 | 0 | + | 0 | + | 0 | 0 | + | 0 |
| Ascusbbf_69H | 0 | 0 | 0 | + | 0 | + | 0 | 0 | + | 0 |
| Ascusbbf_69I | 0 | − | + | − | + | + | + | 0 | 0 | 0 |
| Ascusbbf_69I | 0 | 0 | 0 | 0 | + | + | 0 | + | + | 0 |
| Ascusbbf_69I | 0 | − | + | 0 | 0 | + | + | 0 | + | 0 |
| Ascusbbf_69I | 0 | 0 | 0 | 0 | + | − | 0 | 0 | + | 0 |
| Ascusbbf_69I | 0 | 0 | + | + | + | + | + | 0 | + | 0 |
| Ascusbbf_69I | 0 | 0 | 0 | + | 0 | + | 0 | 0 | + | 0 |
| Ascusbbf_69J | 0 | − | + | − | + | + | + | 0 | 0 | 0 |
| Ascusbbf_69J | 0 | − | + | − | + | + | + | + | + | 0 |
| Ascusbbf_69J | 0 | 0 | 0 | + | 0 | + | 0 | 0 | + | 0 |
| Ascusbbf_69J | 0 | 0 | 0 | + | 0 | + | 0 | 0 | 0 | 0 |
| Ascusbbf_69K | 0 | − | + | − | + | + | + | 0 | 0 | 0 |
| Ascusbbf_69K | 0 | − | + | − | + | + | + | + | + | 0 |
| Ascusbbf_69L | 0 | − | + | − | + | + | + | 0 | 0 | 0 |
| Ascusbbf_69L | 0 | − | + | − | + | + | + | + | + | 0 |
| Ascusbbf_69M | 0 | − | + | − | + | + | + | 0 | 0 | 0 |
| Ascusbbf_69M | 0 | − | + | − | + | + | + | + | + | 0 |
| Ascusbbf_69N | 0 | − | + | − | + | + | + | 0 | 0 | 0 |
| Ascusbbf_69N | 0 | − | + | − | + | + | + | + | + | 0 |
| Ascusbbf_69O | 0 | − | + | − | + | + | + | 0 | 0 | 0 |
| Ascusbbf_69O | 0 | − | + | − | + | + | + | + | + | 0 |
| Ascusbbf_69P | 0 | − | + | − | + | + | + | 0 | 0 | 0 |
| Ascusbbf_6A | 0 | 0 | 0 | 0 | − | − | 0 | + | 0 | 0 |
| Ascusbbf_6A | 0 | 0 | 0 | 0 | + | + | 0 | + | + | 0 |
| Ascusbbf_6A | 0 | 0 | 0 | 0 | + | − | 0 | 0 | + | 0 |
| Ascusbbf_6A | 0 | 0 | 0 | 0 | 0 | + | 0 | 0 | 0 | 0 |
| Ascusbbf_6A | 0 | 0 | 0 | + | 0 | + | 0 | 0 | 0 | 0 |
| Ascusbbf_6B | 0 | 0 | 0 | 0 | − | − | 0 | + | 0 | 0 |
| Ascusbbf_6B | 0 | 0 | 0 | 0 | 0 | + | + | + | − | 0 |
| Ascusbbf_6B | 0 | − | + | − | + | + | + | + | + | 0 |
| Ascusbbf_6B | 0 | 0 | 0 | 0 | + | − | 0 | 0 | + | 0 |
| Ascusbbf_6B | 0 | − | + | − | − | + | − | + | − | 0 |
| Ascusbbf_6B | 0 | 0 | 0 | + | 0 | + | 0 | 0 | 0 | 0 |
| Ascusbbf_6B | 0 | − | 0 | + | + | + | 0 | + | − | 0 |
| Ascusbbf_6C | 0 | 0 | 0 | 0 | − | − | 0 | + | 0 | 0 |
| Ascusbbf_6C | 0 | 0 | 0 | 0 | 0 | + | + | + | − | 0 |
| Ascusbbf_6C | 0 | − | + | − | + | + | + | + | + | 0 |
| Ascusbbf_6C | 0 | 0 | 0 | 0 | + | − | 0 | 0 | + | 0 |
| Ascusbbf_6C | 0 | − | + | − | − | + | − | + | − | 0 |
| Ascusbbf_6C | 0 | 0 | 0 | + | 0 | + | 0 | 0 | 0 | 0 |
| Ascusbbf_6D | 0 | 0 | 0 | 0 | − | − | 0 | + | 0 | 0 |
| Ascusbbf_6D | 0 | 0 | 0 | 0 | + | + | 0 | + | + | 0 |
| Ascusbbf_6D | 0 | 0 | 0 | 0 | 0 | + | 0 | 0 | 0 | 0 |
| Ascusbbf_6D | 0 | 0 | 0 | + | 0 | + | 0 | 0 | 0 | 0 |
| Ascusbbf_6E | 0 | 0 | 0 | 0 | − | − | 0 | + | 0 | 0 |
| Ascusbbf_6E | 0 | 0 | 0 | 0 | 0 | + | + | + | − | 0 |
| Ascusbbf_6E | 0 | − | + | 0 | 0 | + | + | + | + | 0 |
| Ascusbbf_6E | 0 | 0 | 0 | 0 | + | − | 0 | 0 | + | 0 |
| Ascusbbf_6E | 0 | − | + | − | − | + | − | + | − | 0 |
| Ascusbbf_6E | 0 | 0 | 0 | + | 0 | + | 0 | 0 | 0 | 0 |
| Ascusbbf_6F | 0 | 0 | 0 | 0 | − | − | 0 | + | 0 | 0 |
| Ascusbbf_6F | 0 | 0 | 0 | + | 0 | + | 0 | 0 | 0 | 0 |
| Ascusbbf_6G | 0 | 0 | 0 | 0 | − | − | 0 | + | 0 | 0 |
| Ascusbbf_6G | 0 | 0 | 0 | 0 | 0 | + | + | + | − | 0 |
| Ascusbbf_6G | 0 | − | + | − | + | + | + | + | + | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_6G | 0 | 0 | 0 | 0 | + | − | 0 | 0 | + | 0 |
| Ascusbbf_6G | 0 | − | + | − | − | + | − | + | − | 0 |
| Ascusbbf_6G | 0 | 0 | 0 | + | 0 | + | 0 | 0 | 0 | 0 |
| Ascusbbf_6H | 0 | 0 | 0 | 0 | 0 | + | + | + | − | 0 |
| Ascusbbf_6H | 0 | − | + | 0 | 0 | + | + | + | + | 0 |
| Ascusbbf_6H | 0 | − | + | − | − | + | − | + | − | 0 |
| Ascusbbf_6I | 0 | 0 | 0 | 0 | + | + | 0 | + | + | 0 |
| Ascusbbf_6I | 0 | 0 | 0 | 0 | 0 | + | 0 | 0 | 0 | 0 |
| Ascusbbf_6J | 0 | 0 | 0 | 0 | + | + | 0 | + | + | 0 |
| Ascusbbf_6J | 0 | 0 | 0 | 0 | 0 | + | 0 | 0 | 0 | 0 |
| Ascusbbf_6K | 0 | − | + | 0 | 0 | + | + | 0 | + | 0 |
| Ascusbbf_6L | 0 | − | + | 0 | 0 | + | + | 0 | + | 0 |
| Ascusbbf_7003A | + | − | + | − | 0 | + | + | + | − | 0 |
| Ascusbbf_7003C | 0 | − | + | − | + | + | + | 0 | 0 | 0 |
| Ascusbbf_7046A | 0 | 0 | 0 | 0 | 0 | + | 0 | 0 | 0 | 0 |
| Ascusbbf_707A | 0 | 0 | 0 | 0 | + | − | 0 | 0 | + | 0 |
| Ascusbbf_707A | 0 | − | + | − | − | + | − | + | − | 0 |
| Ascusbbf_707A | 0 | 0 | + | + | + | + | + | 0 | + | 0 |
| Ascusbbf_707A | 0 | 0 | 0 | + | 0 | + | 0 | 0 | + | 0 |
| Ascusbbf_707B | 0 | 0 | 0 | 0 | + | − | 0 | 0 | + | 0 |
| Ascusbbf_707B | 0 | − | + | − | − | + | − | + | − | 0 |
| Ascusbbf_707B | 0 | 0 | 0 | + | 0 | + | 0 | 0 | + | 0 |
| Ascusbbf_707B | 0 | 0 | 0 | + | 0 | + | 0 | 0 | 0 | 0 |
| Ascusbbf_707C | 0 | 0 | 0 | 0 | + | − | 0 | 0 | + | 0 |
| Ascusbbf_707C | 0 | − | + | − | − | + | − | + | − | 0 |
| Ascusbbf_707D | 0 | 0 | 0 | 0 | + | − | 0 | 0 | + | 0 |
| Ascusbbf_707D | 0 | 0 | 0 | + | 0 | + | 0 | 0 | + | 0 |
| Ascusbbf_707D | 0 | 0 | 0 | + | 0 | + | 0 | 0 | + | 0 |
| Ascusbbf_707E | 0 | 0 | 0 | 0 | + | − | 0 | 0 | + | 0 |
| Ascusbbf_707E | 0 | 0 | 0 | + | 0 | + | 0 | 0 | + | 0 |
| Ascusbbf_707E | 0 | 0 | 0 | + | 0 | + | 0 | 0 | + | 0 |
| Ascusbbf_707F | 0 | 0 | 0 | 0 | + | − | 0 | 0 | + | 0 |
| Ascusbbf_707F | 0 | − | + | − | − | + | − | + | − | 0 |
| Ascusbbf_707F | 0 | 0 | + | + | + | + | + | 0 | + | 0 |
| Ascusbbf_707F | 0 | 0 | 0 | + | 0 | + | 0 | 0 | + | 0 |
| Ascusbbf_707G | 0 | 0 | 0 | 0 | + | − | 0 | 0 | + | 0 |
| Ascusbbf_707G | 0 | − | + | − | − | + | − | + | − | 0 |
| Ascusbbf_707G | 0 | 0 | 0 | + | 0 | + | 0 | 0 | + | 0 |
| Ascusbbf_707G | 0 | 0 | 0 | + | 0 | + | 0 | 0 | + | 0 |
| Ascusbbf_707H | 0 | 0 | 0 | 0 | + | − | 0 | 0 | + | 0 |
| Ascusbbf_707H | 0 | − | + | − | − | + | − | + | − | 0 |
| Ascusbbf_707H | 0 | 0 | 0 | + | 0 | + | 0 | 0 | + | 0 |
| Ascusbbf_707H | 0 | 0 | 0 | + | 0 | + | 0 | 0 | 0 | 0 |
| Ascusbbf_707I | 0 | 0 | + | + | + | + | + | 0 | + | 0 |
| Ascusbbf_707J | 0 | 0 | + | + | + | + | + | 0 | + | 0 |
| Ascusbbf_721A | 0 | 0 | + | + | + | + | + | 0 | + | 0 |
| Ascusbbf_721A | 0 | 0 | 0 | + | 0 | + | 0 | 0 | + | 0 |
| Ascusbbf_721B | 0 | 0 | 0 | + | 0 | + | 0 | 0 | + | 0 |
| Ascusbbf_721B | 0 | 0 | 0 | + | 0 | + | 0 | 0 | + | 0 |
| Ascusbbf_721C | 0 | 0 | 0 | + | 0 | + | 0 | 0 | + | 0 |
| Ascusbbf_721C | 0 | 0 | 0 | + | 0 | + | 0 | 0 | + | 0 |
| Ascusbbf_72889A | 0 | 0 | 0 | + | 0 | + | 0 | 0 | + | 0 |
| Ascusbbf_72889A | 0 | 0 | 0 | + | 0 | + | 0 | 0 | + | 0 |
| Ascusbbf_72889B | 0 | 0 | 0 | + | 0 | + | 0 | 0 | + | 0 |
| Ascusbbf_72889B | 0 | 0 | 0 | + | 0 | + | 0 | 0 | + | 0 |
| Ascusbbf_729A | 0 | 0 | 0 | 0 | + | − | 0 | 0 | + | 0 |
| Ascusbbf_729A | 0 | 0 | + | + | + | + | + | 0 | + | 0 |
| Ascusbbf_729A | 0 | 0 | 0 | + | 0 | + | 0 | 0 | + | 0 |
| Ascusbbf_729B | 0 | 0 | + | + | + | + | + | 0 | + | 0 |
| Ascusbbf_729B | 0 | 0 | 0 | + | 0 | + | 0 | 0 | + | 0 |
| Ascusbbf_729C | 0 | 0 | 0 | + | 0 | + | 0 | 0 | + | 0 |
| Ascusbbf_729C | 0 | 0 | 0 | + | 0 | + | 0 | 0 | + | 0 |
| Ascusbbf_729D | 0 | 0 | 0 | + | 0 | + | 0 | 0 | + | 0 |
| Ascusbbf_729D | 0 | 0 | 0 | + | 0 | + | 0 | 0 | + | 0 |
| Ascusbbf_729E | 0 | 0 | 0 | + | 0 | + | 0 | 0 | + | 0 |
| Ascusbbf_729E | 0 | 0 | 0 | + | 0 | + | 0 | 0 | + | 0 |
| Ascusbbf_729F | 0 | 0 | + | + | + | + | + | 0 | + | 0 |
| Ascusbbf_729F | 0 | 0 | 0 | + | 0 | + | 0 | 0 | + | 0 |
| Ascusbbf_7586A | 0 | 0 | 0 | 0 | 0 | + | + | + | − | 0 |
| Ascusbbf_7586B | 0 | 0 | 0 | 0 | + | + | 0 | + | + | 0 |
| Ascusbbf_7586B | 0 | − | + | 0 | 0 | + | + | + | + | 0 |
| Ascusbbf_7586B | 0 | 0 | 0 | 0 | 0 | + | 0 | 0 | 0 | 0 |
| Ascusbbf_7586C | 0 | 0 | 0 | 0 | + | + | 0 | + | + | 0 |
| Ascusbbf_7586C | 0 | − | + | 0 | + | + | 0 | 0 | + | 0 |
| Ascusbbf_7586C | 0 | 0 | 0 | 0 | 0 | + | 0 | 0 | 0 | 0 |
| Ascusbbf_7586D | 0 | − | + | − | + | + | + | + | + | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_775A | 0 | 0 | 0 | 0 | + | − | 0 | 0 | + | 0 |
| Ascusbbf_775A | 0 | − | + | − | − | + | − | + | − | 0 |
| Ascusbbf_775A | 0 | 0 | 0 | + | 0 | + | 0 | 0 | + | 0 |
| Ascusbbf_775A | 0 | 0 | 0 | + | 0 | + | 0 | 0 | + | 0 |
| Ascusbbf_775B | 0 | 0 | 0 | + | 0 | + | 0 | 0 | + | 0 |
| Ascusbbf_775B | 0 | 0 | 0 | + | 0 | + | 0 | 0 | + | 0 |
| Ascusbbf_8082A | 0 | − | + | − | + | + | + | 0 | 0 | 0 |
| Ascusbbf_8082A | 0 | 0 | 0 | 0 | − | − | 0 | + | 0 | 0 |
| Ascusbbf_8082A | 0 | 0 | 0 | 0 | + | + | 0 | + | + | 0 |
| Ascusbbf_8082A | 0 | − | + | 0 | 0 | + | + | 0 | + | 0 |
| Ascusbbf_8082A | 0 | 0 | 0 | 0 | 0 | + | 0 | 0 | 0 | 0 |
| Ascusbbf_8082A | 0 | 0 | 0 | + | 0 | + | 0 | 0 | 0 | 0 |
| Ascusbbf_8082B | 0 | 0 | 0 | 0 | − | − | 0 | + | 0 | 0 |
| Ascusbbf_8082B | 0 | 0 | 0 | 0 | 0 | + | + | + | − | 0 |
| Ascusbbf_8082B | 0 | − | + | 0 | 0 | + | + | 0 | + | 0 |
| Ascusbbf_8082B | 0 | 0 | 0 | 0 | 0 | + | 0 | 0 | 0 | 0 |
| Ascusbbf_8082C | 0 | − | + | − | + | + | + | 0 | 0 | 0 |
| Ascusbbf_8082C | 0 | 0 | 0 | 0 | − | − | 0 | + | 0 | 0 |
| Ascusbbf_8082C | 0 | 0 | 0 | 0 | + | + | 0 | + | + | 0 |
| Ascusbbf_8082C | 0 | − | + | 0 | 0 | + | + | 0 | + | 0 |
| Ascusbbf_8082C | 0 | 0 | 0 | 0 | 0 | + | 0 | 0 | 0 | 0 |
| Ascusbbf_8082C | 0 | 0 | 0 | + | 0 | + | 0 | 0 | 0 | 0 |
| Ascusbbf_8082D | 0 | − | + | − | + | + | + | 0 | 0 | 0 |
| Ascusbbf_8082D | 0 | 0 | 0 | 0 | − | − | 0 | + | 0 | 0 |
| Ascusbbf_8082D | 0 | 0 | 0 | 0 | + | + | 0 | + | + | 0 |
| Ascusbbf_8082D | 0 | − | + | 0 | 0 | + | + | + | + | 0 |
| Ascusbbf_8082D | 0 | 0 | 0 | 0 | 0 | + | 0 | 0 | 0 | 0 |
| Ascusbbf_8082D | 0 | 0 | 0 | + | 0 | + | 0 | 0 | 0 | 0 |
| Ascusbbf_8082E | 0 | − | + | − | + | + | + | 0 | 0 | 0 |
| Ascusbbf_8082E | 0 | 0 | 0 | 0 | 0 | + | + | + | − | 0 |
| Ascusbbf_8082F | 0 | − | + | − | + | + | + | 0 | 0 | 0 |
| Ascusbbf_8082F | 0 | 0 | 0 | 0 | + | + | 0 | + | + | 0 |
| Ascusbbf_8082F | 0 | − | + | 0 | 0 | + | + | 0 | + | 0 |
| Ascusbbf_8082G | 0 | − | + | − | + | + | + | 0 | 0 | 0 |
| Ascusbbf_8082G | 0 | − | + | 0 | 0 | + | + | 0 | + | 0 |
| Ascusbbf_8082H | 0 | − | + | − | + | + | + | 0 | 0 | 0 |
| Ascusbbf_8082H | 0 | − | + | 0 | 0 | + | + | 0 | + | 0 |
| Ascusbbf_8082I | 0 | − | + | − | + | + | + | 0 | 0 | 0 |
| Ascusbbf_8118A | 0 | 0 | 0 | + | 0 | + | 0 | 0 | + | 0 |
| Ascusbbf_8118B | 0 | 0 | + | + | + | + | + | 0 | + | 0 |
| Ascusbbf_8118B | 0 | 0 | 0 | + | 0 | + | 0 | 0 | + | 0 |
| Ascusbbf_8414A | 0 | 0 | 0 | + | 0 | + | 0 | 0 | + | 0 |
| Ascusbbf_8414A | 0 | 0 | 0 | + | 0 | + | 0 | 0 | + | 0 |
| Ascusbbf_8480A | 0 | 0 | + | + | + | + | + | 0 | + | 0 |
| Ascusbbf_8480A | 0 | 0 | 0 | + | 0 | + | 0 | 0 | + | 0 |
| Ascusbbf_8480B | 0 | 0 | + | + | + | + | + | 0 | + | 0 |
| Ascusbbf_850A | + | − | + | − | 0 | + | + | + | − | 0 |
| Ascusbbf_850B | 0 | − | + | − | + | + | + | 0 | 0 | 0 |
| Ascusbbf_850C | 0 | − | + | − | + | + | + | 0 | 0 | 0 |
| Ascusbbf_850C | 0 | 0 | 0 | 0 | − | − | 0 | + | 0 | 0 |
| Ascusbbf_850C | 0 | 0 | 0 | 0 | + | + | 0 | + | + | 0 |
| Ascusbbf_850C | 0 | 0 | 0 | 0 | + | − | 0 | 0 | + | 0 |
| Ascusbbf_850C | 0 | 0 | 0 | 0 | 0 | + | 0 | 0 | 0 | 0 |
| Ascusbbf_850D | 0 | 0 | 0 | 0 | − | − | 0 | + | 0 | 0 |
| Ascusbbf_850E | 0 | 0 | 0 | 0 | − | − | 0 | + | 0 | 0 |
| Ascusbbf_850E | 0 | 0 | 0 | 0 | + | + | 0 | + | + | 0 |
| Ascusbbf_850E | 0 | − | + | 0 | 0 | + | + | 0 | + | 0 |
| Ascusbbf_850E | 0 | 0 | 0 | 0 | + | − | 0 | 0 | + | 0 |
| Ascusbbf_850E | 0 | 0 | 0 | 0 | 0 | + | 0 | 0 | 0 | 0 |
| Ascusbbf_850F | 0 | − | + | − | + | + | + | 0 | 0 | 0 |
| Ascusbbf_850F | 0 | 0 | 0 | 0 | − | − | 0 | + | 0 | 0 |
| Ascusbbf_850F | 0 | 0 | 0 | 0 | + | + | 0 | + | + | 0 |
| Ascusbbf_850F | 0 | − | + | − | + | + | + | + | + | 0 |
| Ascusbbf_850F | 0 | 0 | 0 | 0 | + | − | 0 | 0 | + | 0 |
| Ascusbbf_850F | 0 | 0 | 0 | 0 | 0 | + | 0 | 0 | 0 | 0 |
| Ascusbbf_850G | 0 | − | + | − | + | + | + | 0 | 0 | 0 |
| Ascusbbf_850G | 0 | 0 | 0 | 0 | − | − | 0 | + | 0 | 0 |
| Ascusbbf_850G | 0 | 0 | 0 | 0 | + | + | 0 | + | + | 0 |
| Ascusbbf_850G | 0 | 0 | 0 | 0 | + | − | 0 | 0 | + | 0 |
| Ascusbbf_850G | 0 | 0 | 0 | 0 | 0 | + | 0 | 0 | 0 | 0 |
| Ascusbbf_850H | 0 | − | + | − | + | + | + | 0 | 0 | 0 |
| Ascusbbf_850H | 0 | 0 | 0 | 0 | 0 | + | + | + | − | 0 |
| Ascusbbf_850H | 0 | − | + | − | − | + | − | + | − | 0 |
| Ascusbbf_850I | 0 | − | + | − | + | + | + | 0 | 0 | 0 |
| Ascusbbf_850I | 0 | − | + | − | − | + | − | + | − | 0 |
| Ascusbbf_850J | 0 | − | + | − | + | + | + | 0 | 0 | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_850J | 0 | − | + | − | + | + | + | + | + | 0 |
| Ascusbbf_8600A | 0 | 0 | + | + | + | + | + | 0 | + | 0 |
| Ascusbbf_8600B | 0 | 0 | + | + | + | + | + | 0 | + | 0 |
| Ascusbbf_873A | 0 | − | + | − | + | + | + | 0 | 0 | 0 |
| Ascusbbf_873B | 0 | − | + | − | + | + | + | 0 | 0 | 0 |
| Ascusbbf_873B | 0 | 0 | 0 | 0 | + | + | 0 | + | + | 0 |
| Ascusbbf_873B | 0 | − | + | 0 | 0 | + | + | 0 | + | 0 |
| Ascusbbf_873B | 0 | 0 | 0 | 0 | + | − | 0 | 0 | + | 0 |
| Ascusbbf_873B | 0 | 0 | 0 | 0 | 0 | + | 0 | 0 | 0 | 0 |
| Ascusbbf_873B | 0 | 0 | 0 | + | 0 | + | 0 | 0 | 0 | 0 |
| Ascusbbf_873C | 0 | 0 | 0 | 0 | − | − | 0 | + | 0 | 0 |
| Ascusbbf_873C | 0 | 0 | 0 | 0 | + | + | 0 | + | + | 0 |
| Ascusbbf_873C | 0 | − | + | 0 | 0 | + | + | 0 | + | 0 |
| Ascusbbf_873C | 0 | − | + | − | − | + | − | + | − | 0 |
| Ascusbbf_873D | 0 | 0 | 0 | 0 | + | + | 0 | + | + | 0 |
| Ascusbbf_873D | 0 | − | + | − | + | + | + | + | + | 0 |
| Ascusbbf_873D | 0 | 0 | 0 | 0 | 0 | + | 0 | 0 | 0 | 0 |
| Ascusbbf_873E | 0 | − | + | − | + | + | + | 0 | 0 | 0 |
| Ascusbbf_873E | 0 | 0 | 0 | 0 | + | + | 0 | + | + | 0 |
| Ascusbbf_873E | 0 | − | + | 0 | 0 | + | + | 0 | + | 0 |
| Ascusbbf_873E | 0 | 0 | 0 | 0 | + | − | 0 | 0 | + | 0 |
| Ascusbbf_873E | 0 | 0 | 0 | 0 | 0 | + | 0 | 0 | 0 | 0 |
| Ascusbbf_873F | 0 | − | + | − | + | + | + | 0 | 0 | 0 |
| Ascusbbf_873F | 0 | 0 | 0 | 0 | + | + | 0 | + | + | 0 |
| Ascusbbf_873F | 0 | − | + | 0 | 0 | + | + | 0 | + | 0 |
| Ascusbbf_873F | 0 | 0 | 0 | + | 0 | + | 0 | 0 | 0 | 0 |
| Ascusbbf_873G | 0 | − | + | − | + | + | + | + | + | 0 |
| Ascusbbf_876A | 0 | − | + | + | 0 | 0 | − | 0 | + | 0 |
| Ascusbbf_876A | + | − | + | − | 0 | + | + | + | − | 0 |
| Ascusbbf_876A | + | + | + | + | 0 | + | 0 | 0 | + | 0 |
| Ascusbbf_876B | 0 | − | + | 0 | 0 | + | + | 0 | + | 0 |
| Ascusbbf_876C | 0 | − | + | − | + | + | + | 0 | 0 | 0 |
| Ascusbbf_876C | 0 | 0 | 0 | 0 | − | − | 0 | + | 0 | 0 |
| Ascusbbf_876C | 0 | 0 | 0 | 0 | + | + | 0 | + | + | 0 |
| Ascusbbf_876C | 0 | − | + | 0 | 0 | + | + | + | + | 0 |
| Ascusbbf_876C | 0 | 0 | 0 | 0 | 0 | + | 0 | 0 | 0 | 0 |
| Ascusbbf_876D | 0 | − | + | − | + | + | + | 0 | 0 | 0 |
| Ascusbbf_876D | 0 | 0 | 0 | 0 | − | − | 0 | + | 0 | 0 |
| Ascusbbf_876D | 0 | 0 | 0 | 0 | + | + | 0 | + | + | 0 |
| Ascusbbf_876D | 0 | − | + | 0 | 0 | + | + | + | 0 | 0 |
| Ascusbbf_876D | 0 | 0 | 0 | 0 | 0 | + | 0 | 0 | 0 | 0 |
| Ascusbbf_876D | 0 | 0 | 0 | + | 0 | + | 0 | 0 | 0 | 0 |
| Ascusbbf_876F | 0 | − | + | − | + | + | + | 0 | 0 | 0 |
| Ascusbbf_876F | 0 | 0 | 0 | 0 | − | − | 0 | + | 0 | 0 |
| Ascusbbf_876F | 0 | 0 | 0 | 0 | + | + | 0 | + | + | 0 |
| Ascusbbf_876F | 0 | − | + | 0 | 0 | + | + | + | + | 0 |
| Ascusbbf_876F | 0 | − | + | + | + | + | 0 | 0 | + | 0 |
| Ascusbbf_876F | 0 | 0 | 0 | + | 0 | + | 0 | 0 | 0 | 0 |
| Ascusbbf_876G | 0 | − | + | − | + | + | + | 0 | 0 | 0 |
| Ascusbbf_876G | 0 | − | + | − | + | + | + | + | + | 0 |
| Ascusbbf_8941A | 0 | 0 | 0 | + | 0 | + | 0 | 0 | + | 0 |
| Ascusbbf_8941A | 0 | 0 | 0 | + | 0 | + | 0 | 0 | + | 0 |
| Ascusbbf_9031A | 0 | 0 | 0 | 0 | + | − | 0 | 0 | + | 0 |
| Ascusbbf_9031B | 0 | 0 | 0 | 0 | + | − | 0 | 0 | + | 0 |
| Ascusbbf_9031C | 0 | 0 | 0 | 0 | + | − | 0 | 0 | + | 0 |
| Ascusbbf_9031D | 0 | 0 | 0 | 0 | + | − | 0 | 0 | + | 0 |
| Ascusbbf_9031D | 0 | − | + | − | − | + | − | + | − | 0 |
| Ascusbbf_9031E | 0 | 0 | 0 | 0 | + | − | 0 | 0 | + | 0 |
| Ascusbbf_9031E | 0 | − | + | − | − | + | − | + | − | 0 |
| Ascusbbf_9031F | 0 | 0 | 0 | 0 | + | − | 0 | 0 | + | 0 |
| Ascusbbf_9031F | 0 | − | + | − | − | + | − | + | − | 0 |
| Ascusbbf_9031G | 0 | − | + | − | − | + | − | + | − | 0 |
| Ascusbbf_915A | 0 | 0 | 0 | + | 0 | + | 0 | 0 | + | 0 |
| Ascusbbf_915A | 0 | 0 | 0 | + | 0 | + | 0 | 0 | + | 0 |
| Ascusbbf_92A | 0 | 0 | 0 | 0 | − | − | 0 | + | 0 | 0 |
| Ascusbbf_92A | 0 | − | + | − | − | + | − | + | − | 0 |
| Ascusbbf_92B | 0 | 0 | 0 | 0 | − | − | 0 | + | 0 | 0 |
| Ascusbbf_92B | 0 | 0 | 0 | 0 | + | + | 0 | + | + | 0 |
| Ascusbbf_92B | 0 | 0 | 0 | 0 | + | − | 0 | 0 | + | 0 |
| Ascusbbf_92B | 0 | 0 | 0 | 0 | 0 | + | 0 | 0 | 0 | 0 |
| Ascusbbf_92C | 0 | 0 | 0 | 0 | − | − | 0 | + | 0 | 0 |
| Ascusbbf_92C | 0 | − | + | − | − | + | − | + | − | 0 |
| Ascusbbf_92D | 0 | 0 | 0 | 0 | − | − | 0 | + | 0 | 0 |
| Ascusbbf_92D | 0 | 0 | 0 | 0 | + | − | 0 | 0 | + | 0 |
| Ascusbbf_92D | 0 | 0 | 0 | 0 | 0 | + | 0 | 0 | 0 | 0 |
| Ascusbbf_92E | 0 | 0 | 0 | 0 | − | − | 0 | + | 0 | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_92F | 0 | 0 | 0 | 0 | − | − | 0 | + | 0 | 0 |
| Ascusbbf_92F | 0 | 0 | 0 | 0 | + | − | 0 | 0 | + | 0 |
| Ascusbbf_92F | 0 | 0 | 0 | 0 | 0 | + | 0 | 0 | 0 | 0 |
| Ascusbbf_92H | 0 | 0 | 0 | 0 | 0 | + | + | + | − | 0 |
| Ascusbbf_92H | 0 | 0 | 0 | 0 | + | − | 0 | 0 | + | 0 |
| Ascusbbf_92K | 0 | 0 | 0 | 0 | 0 | + | + | + | − | 0 |
| Ascusbbf_92K | 0 | 0 | + | + | + | + | + | 0 | + | 0 |
| Ascusbbf_92K | 0 | 0 | 0 | + | 0 | + | 0 | 0 | 0 | 0 |
| Ascusbbf_92L | 0 | − | + | − | − | + | − | + | − | 0 |
| Ascusbbf_930A | 0 | 0 | + | + | + | + | + | 0 | + | 0 |
| Ascusbbf_930A | 0 | 0 | 0 | + | 0 | + | 0 | 0 | 0 | 0 |
| Ascusbbf_930B | 0 | 0 | + | + | + | + | + | 0 | + | 0 |
| Ascusbbf_930B | 0 | 0 | 0 | + | 0 | + | 0 | 0 | + | 0 |
| Ascusbbf_944A | + | − | + | − | 0 | + | + | + | − | 0 |
| Ascusbbf_944B | 0 | 0 | 0 | 0 | + | + | 0 | + | + | 0 |
| Ascusbbf_944B | 0 | 0 | 0 | 0 | + | − | 0 | 0 | + | 0 |
| Ascusbbf_944B | 0 | 0 | + | + | + | + | + | 0 | + | 0 |
| Ascusbbf_944B | 0 | 0 | 0 | + | 0 | + | 0 | 0 | + | 0 |
| Ascusbbf_944C | 0 | 0 | 0 | 0 | + | − | 0 | 0 | + | 0 |
| Ascusbbf_944C | 0 | 0 | + | + | + | + | + | 0 | + | 0 |
| Ascusbbf_944D | 0 | 0 | 0 | 0 | + | − | 0 | 0 | + | 0 |
| Ascusbbf_944D | 0 | − | + | − | − | + | − | + | − | 0 |
| Ascusbbf_944E | 0 | 0 | 0 | 0 | + | − | 0 | 0 | + | 0 |
| Ascusbbf_944F | 0 | 0 | 0 | 0 | + | − | 0 | 0 | + | 0 |
| Ascusbbf_944G | 0 | 0 | 0 | 0 | + | − | 0 | 0 | + | 0 |
| Ascusbbf_944G | 0 | 0 | 0 | + | 0 | + | 0 | 0 | + | 0 |
| Ascusbbf_944G | 0 | 0 | 0 | + | 0 | + | 0 | 0 | + | 0 |
| Ascusbbf_951A | 0 | − | + | − | + | + | + | + | + | 0 |
| Ascusbbf_951A | + | − | + | − | 0 | + | + | + | − | 0 |
| Ascusbbf_951A | 0 | − | 0 | + | + | + | 0 | 0 | + | 0 |
| Ascusbbf_951B | 0 | 0 | + | − | + | + | + | 0 | 0 | 0 |
| Ascusbbf_951B | 0 | 0 | 0 | 0 | − | − | 0 | + | 0 | 0 |
| Ascusbbf_951B | 0 | 0 | 0 | 0 | + | + | 0 | + | + | 0 |
| Ascusbbf_951B | 0 | − | + | 0 | 0 | + | + | 0 | + | 0 |
| Ascusbbf_951B | 0 | 0 | 0 | 0 | + | − | 0 | 0 | + | 0 |
| Ascusbbf_951B | 0 | − | + | + | + | + | 0 | 0 | + | 0 |
| Ascusbbf_951B | 0 | 0 | 0 | + | 0 | + | 0 | 0 | + | 0 |
| Ascusbbf_951B | 0 | 0 | 0 | + | 0 | + | 0 | 0 | 0 | 0 |
| Ascusbbf_951B | − | − | − | + | − | + | + | + | − | 0 |
| Ascusbbf_951B | 0 | − | 0 | + | 0 | 0 | 0 | 0 | + | 0 |
| Ascusbbf_951B | 0 | − | 0 | + | 0 | 0 | 0 | 0 | + | 0 |
| Ascusbbf_951C | 0 | − | + | − | + | + | + | 0 | 0 | 0 |
| Ascusbbf_951C | 0 | 0 | 0 | 0 | − | − | 0 | + | 0 | 0 |
| Ascusbbf_951C | 0 | 0 | 0 | 0 | + | + | 0 | + | + | 0 |
| Ascusbbf_951C | 0 | − | + | 0 | 0 | + | + | 0 | + | 0 |
| Ascusbbf_951C | 0 | 0 | 0 | 0 | + | − | 0 | 0 | + | 0 |
| Ascusbbf_951C | 0 | − | + | + | + | + | 0 | 0 | + | 0 |
| Ascusbbf_951C | 0 | 0 | 0 | + | 0 | + | 0 | 0 | + | 0 |
| Ascusbbf_951C | 0 | 0 | 0 | + | 0 | + | 0 | 0 | 0 | 0 |
| Ascusbbf_951D | 0 | − | + | − | + | + | + | 0 | 0 | 0 |
| Ascusbbf_951D | 0 | 0 | 0 | 0 | − | − | 0 | + | 0 | 0 |
| Ascusbbf_951D | 0 | 0 | 0 | 0 | 0 | + | + | + | − | 0 |
| Ascusbbf_951D | 0 | − | + | 0 | 0 | + | + | + | + | 0 |
| Ascusbbf_951D | 0 | 0 | 0 | 0 | + | − | 0 | 0 | + | 0 |
| Ascusbbf_951E | 0 | − | + | − | + | + | + | 0 | 0 | 0 |
| Ascusbbf_951E | 0 | − | + | − | + | + | + | + | + | 0 |
| Ascusbbf_951E | 0 | 0 | 0 | + | 0 | + | 0 | 0 | + | 0 |
| Ascusbbf_951E | 0 | 0 | 0 | + | 0 | + | 0 | 0 | + | 0 |
| Ascusbbf_951F | 0 | − | + | − | + | + | + | 0 | 0 | 0 |
| Ascusbbf_951G | 0 | 0 | + | − | + | + | + | 0 | 0 | 0 |
| Ascusbbf_95A | 0 | 0 | 0 | 0 | + | − | 0 | 0 | + | 0 |
| Ascusbbf_95A | 0 | − | + | − | − | + | − | + | − | 0 |
| Ascusbbf_95B | 0 | 0 | 0 | 0 | + | − | 0 | 0 | + | 0 |
| Ascusbbf_95B | 0 | − | + | − | − | + | − | + | − | 0 |
| Ascusbbf_95B | 0 | 0 | + | + | + | + | + | 0 | + | 0 |
| Ascusbbf_95B | 0 | 0 | 0 | + | 0 | + | 0 | 0 | + | 0 |
| Ascusbbf_95C | 0 | 0 | 0 | 0 | + | − | 0 | 0 | + | 0 |
| Ascusbbf_95C | 0 | − | + | − | − | + | − | + | − | 0 |
| Ascusbbf_95D | 0 | 0 | 0 | 0 | + | − | 0 | 0 | + | 0 |
| Ascusbbf_95D | 0 | − | + | − | − | + | − | + | − | 0 |
| Ascusbbf_95D | 0 | 0 | + | + | + | + | + | 0 | + | 0 |
| Ascusbbf_95D | 0 | 0 | 0 | + | 0 | + | 0 | 0 | + | 0 |
| Ascusbbf_95E | 0 | 0 | 0 | + | 0 | + | 0 | 0 | + | 0 |
| Ascusbbf_95E | 0 | 0 | 0 | + | 0 | + | 0 | 0 | + | 0 |
| Ascusbbf_95F | 0 | 0 | 0 | + | 0 | + | 0 | 0 | + | 0 |
| Ascusbbf_95F | 0 | 0 | 0 | + | 0 | + | 0 | 0 | + | 0 |

-continued

| Strain ID | pyruvic | glucose | succinic | lactic | glycerol | acetic | propionic | butyric | ethanol | 1-Butanol |
|---|---|---|---|---|---|---|---|---|---|---|
| Ascusbbf_95G | 0 | 0 | 0 | + | 0 | + | 0 | 0 | + | 0 |
| Ascusbbf_95G | 0 | 0 | 0 | + | 0 | + | 0 | 0 | + | 0 |
| Ascusbbf_95H | 0 | 0 | 0 | + | 0 | + | 0 | 0 | + | 0 |
| Ascusbbf_95H | 0 | 0 | 0 | + | 0 | + | 0 | 0 | + | 0 |
| Ascusbbf_9770A | 0 | 0 | 0 | 0 | + | + | 0 | + | + | 0 |
| Ascusbbf_9770A | 0 | − | + | 0 | 0 | + | + | 0 | + | 0 |
| Ascusbbf_9770A | 0 | 0 | 0 | 0 | + | − | 0 | 0 | + | 0 |
| Ascusbbf_9770A | 0 | 0 | 0 | 0 | 0 | + | 0 | 0 | 0 | 0 |
| Ascusbbf_9770B | 0 | 0 | 0 | 0 | + | + | 0 | + | + | 0 |
| Ascusbbf_9770B | 0 | 0 | 0 | 0 | + | − | 0 | 0 | + | 0 |
| Ascusbbf_9770B | 0 | 0 | 0 | 0 | 0 | + | 0 | 0 | 0 | 0 |
| Ascusbbf_9770C | 0 | 0 | 0 | 0 | + | − | 0 | 0 | + | 0 |
| Ascusbbf_9770C | 0 | 0 | 0 | + | 0 | + | 0 | 0 | + | 0 |
| Ascusbbf_9770C | 0 | 0 | 0 | + | 0 | + | 0 | 0 | + | 0 |
| Ascusbbf_9770D | 0 | 0 | 0 | 0 | + | − | 0 | 0 | + | 0 |
| Ascusbbf_9770D | 0 | − | + | − | − | + | − | + | − | 0 |
| Ascusbbf_9770E | 0 | 0 | 0 | 0 | + | − | 0 | 0 | + | 0 |
| Ascusbbf_9770E | 0 | − | + | − | − | + | − | + | − | 0 |
| Ascusbbf_9770F | 0 | 0 | 0 | 0 | + | − | 0 | 0 | + | 0 |
| Ascusbbf_9770F | 0 | − | + | − | − | + | − | + | − | 0 |
| Ascusbbf_9770G | 0 | 0 | 0 | 0 | + | − | 0 | 0 | + | 0 |
| Ascusbbf_9770G | 0 | − | + | − | − | + | − | + | − | 0 |
| Ascusbbf_9770H | 0 | 0 | 0 | 0 | + | − | 0 | 0 | + | 0 |
| Ascusbbf_9770H | 0 | − | + | − | − | + | − | + | − | 0 |
| Ascusbbf_9770H | 0 | 0 | 0 | + | 0 | + | 0 | 0 | + | 0 |
| Ascusbbf_9770H | 0 | 0 | 0 | + | 0 | + | 0 | 0 | + | 0 |
| Ascusbbf_983757A | 0 | 0 | 0 | + | 0 | + | 0 | 0 | + | 0 |
| Ascusbbf_983757A | 0 | 0 | 0 | + | 0 | + | 0 | 0 | + | 0 |
| Ascusbbf_983757B | 0 | 0 | 0 | + | 0 | + | 0 | 0 | + | 0 |
| Ascusbbf_983757B | 0 | 0 | 0 | + | 0 | + | 0 | 0 | + | 0 |
| Ascusbbf_983757C | 0 | 0 | 0 | + | 0 | + | 0 | 0 | + | 0 |
| Ascusbbf_983757C | 0 | 0 | 0 | + | 0 | + | 0 | 0 | + | 0 |

Example XIII. Effects of Native Rumen Microorganism Supplementation on Feed Conversion Ratio of Heifers on High-Grain Diets Experimental Design:

Sixteen heifers were cannulated and blocked into two different groups: 8 control animals, and 8 experimental animals. The experimental group received live cells of six different rumen bacterial strains: Ascusbbf_24302, Ascusbbf_4, Ascusbbf_14146, Ascusbbf_154, Ascusbbf_1085, and Ascusbbf_876. Fresh cultures of each strain were prepared, and whole cells suspended in saline were directly administered to the rumen via cannula daily at a dose of 1E9 cells/strain/dose. Control animals received an equivalent volume of saline daily via cannula.

The ruminal pH was measured daily using an eCow eBolus. Animal weight was measured weekly and feed intakes were measured daily. Rumen content was sampled weekly to determine concentrations of VFAs and carbon dioxide in the rumen, and to determine colonization of administered strains. Venous blood was sampled for oximetry. Feed conversion ratio was calculated by dividing weight gain by the amount of feed consumed.

Animals were stepped up to the final ration diet over 4 weeks, using 4 intermediate step-up diets that gradually replaced corn silage with dry-rolled corn. The first two weeks (first two step up diets) were used to create a baseline for blocking the animals. After these two weeks, the animals were assigned into either the experimental or control group. Microbe administration began on day 14 and continued until day 56 (42 days of microbe administration). On day 48, all heifers underwent an acidosis challenge for 8 days. The acidosis challenge was induced by increasing the amount of corn in the diet of the animals.

The diet is as follows:

| Item, % of DM | Control Diet | Acidosis Challenge |
|---|---|---|
| Dry-rolled corn | 66 | 74 |
| Dried distiller's grains | 20 | 20 |
| Corn silage | 10 | 2 |
| Premix | 4 | 4 |

The diet also included a small amount of premix to add micronutrients, Rumensin, and Tylosin.

Results

Figure 32:
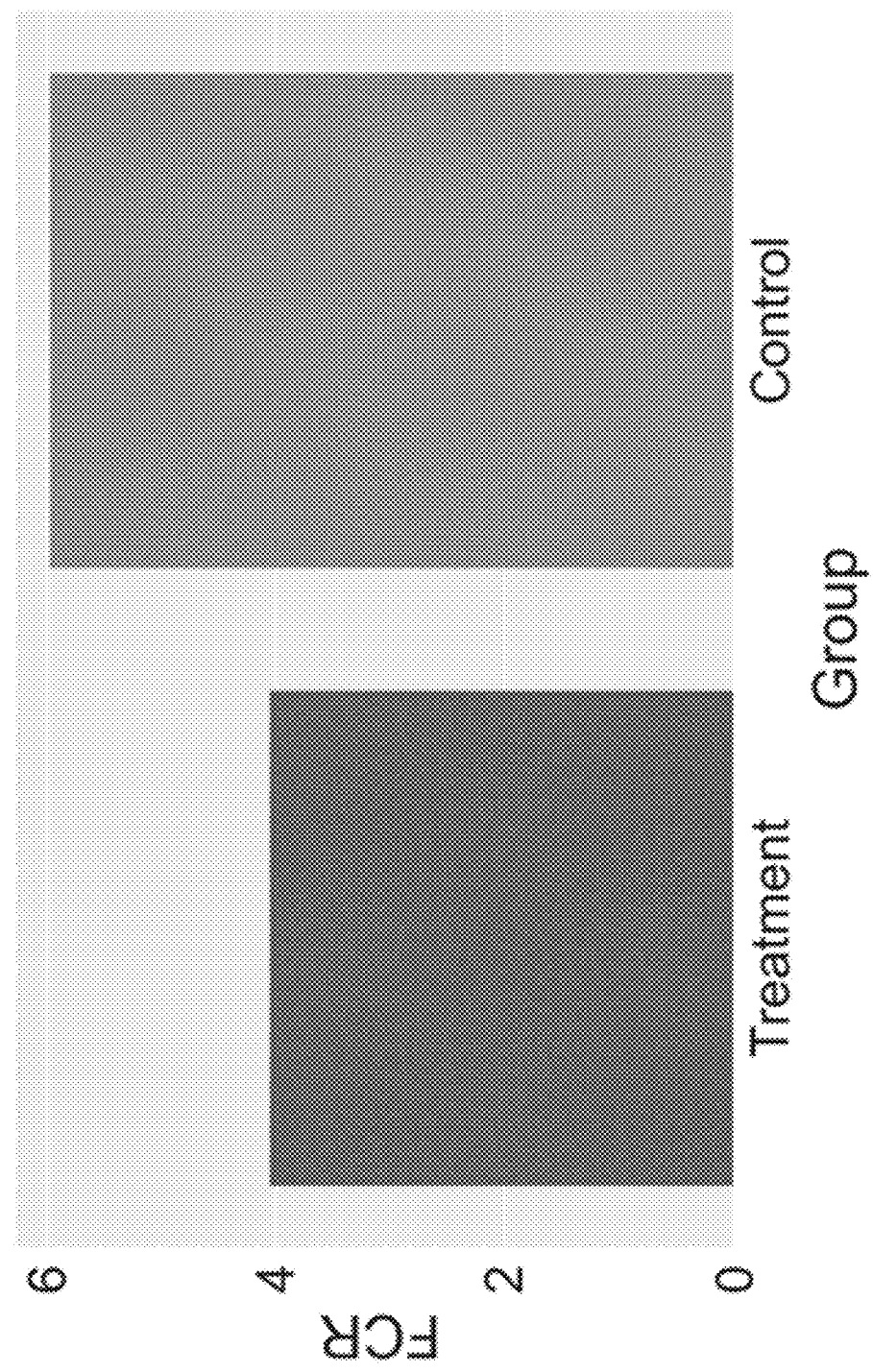
FIG. 32 depicts the feed conversion ratio (FCR) for animals that received microbes vs. animals that did not receive microbes.

Administration of microbes to heifers had a clear impact on the performance of the animal. Intakes and weights of the animals were measured throughout the step up and acidosis challenge. Feed conversion ratio (FCR) was calculated by dividing the amount of feed consumed by the animal over a specific amount of time by the weight gain of the animal over the same time period. Animals that received microbes exhibited improved feed conversion during the last phase of step up and the acidosis challenge as compared to control animals (FIG. 32). Animals in the control group required roughly 6 lbs of feed to create 1 lb of body weight, while experimental animals required roughly 4 lbs of feed to create 1 lb of body weight.

Numbered Embodiments of the Disclosure

1. A microbial composition comprising at least one microbial strain selected from Table 1 and/or Table 2.

2. A microbial composition comprising at least one microbial strain, wherein the at least one microbial strain comprises a 16S rRNA sequence selected from SEQ ID NOs: 1-100.

3. The microbial composition of claim 2, wherein the at least one microbial strain comprises Ascusbbf_6176.

4. The microbial composition of claim 2, wherein the at least one microbial strain comprises Ascusbbf_22143.

5. The microbial composition of claim 2, wherein the at least one microbial strain comprises Ascusbbf_4483.

6. The microbial composition of claim 2, wherein the at least one microbial strain comprises Ascusbbf_13543.

7. The microbial composition of claim 2, wherein the at least one microbial strain comprises Ascusbbf_152.

8. The microbial composition of claim 2, wherein the at least one microbial strain comprises Ascusbbf_707 and Ascusbbf_1238.

9. The microbial composition of claim 2, wherein the at least one microbial strain comprises Ascusbbf_4691, Ascusbbf_5588, and Ascusbbf_1238.

10. The microbial composition of any one of claims 1-9, wherein said microbial composition is encapsulated.

11. A composition comprising:
    (a) a microbial composition of any one of claims 1-10, and
    (b) an acceptable carrier.

12. The composition of claim 11, wherein the microbial composition is encapsulated.

13. The composition of claim 11, wherein the encapsulated microbial composition comprises a polymer selected from a saccharide polymer, agar polymer, agarose polymer, protein polymer, and lipid polymer.

14. The composition of claim 11, wherein the acceptable carrier is selected from the group consisting of: edible feed grade material, mineral mixture, water, glycol, molasses, and corn oil.

15. The composition of claim 11, wherein the at least two microbial strains forming the microbial composition are present in the composition at 102 to 1015 cells per gram of said composition.

16. The composition of claim 11, wherein said composition is (a) mixed with animal feed, (b) mixed with animal drinking water, or (c) administered onto animal feed.

17. A method of imparting at least one improved trait upon an animal, said method comprising administering the composition of claim 11 to said animal.

18. The method of claim 17, wherein said animal is a ruminant.

19. The method of claim 17, wherein said steer is an Angus breed of cattle, or a hybrid or cross thereof.

20. The method of claim 18, wherein the administration comprises (a) injecting the composition into rumen of the animal, (b) administering a bolus of the composition, or (c) drenching the animal with the composition.

21. The method of claim 17, wherein said composition is administered at least once per month.

22. The method of claim 21, wherein said composition is administered at least once per week.

23. The method of claim 22, wherein said composition is administered at least once per day.

24. The method of claim 17, wherein the administration occurs each time the animal is fed.

25. The method of claim 17, wherein the administration is a rectal administration.

26. The method of claim 25, wherein the rectal administration comprises inserting a suppository comprising the composition into the rectum of the animal.

27. The method of claim 17, wherein the administration is an oral administration.

28. The method of claim 27, wherein the oral administration comprises administering the composition in combination with the animal's feed, water, medicine, or vaccination.

29. The method of claim 27, wherein the oral administration comprises applying the composition in a gel or viscous solution to a body part of the animal, wherein the animal ingests the composition.

30. The method of claim 17, wherein the administration comprises spraying the composition onto the animal feed, and wherein the animal ingests the animal feed.

31. The method of claim 17, wherein said at least one improved trait is selected from the group consisting of: an increase in weight; an increase of musculature; an increase of fatty acid concentration in the gastrointestinal tract; an increase of fatty acid concentration in the rumen; a decrease in lactate concentration in the rumen; an improved efficiency in feed utilization and digestibility; an improved feed efficiency; an improved average daily gain; an improved dry matter intake; an increase in polysaccharide and lignin degradation; an increase in fat, starch, and/or protein digestion; an increase in fatty acid concentration in the rumen; pH balance in the rumen, an increase in vitamin availability; an increase in mineral availability; an increase in amino acid availability; a reduction in methane and/or nitrous oxide emissions; a reduction in manure production; an improved efficiency of nitrogen utilization; an improved efficiency of phosphorous utilization; an increased resistance to colonization of pathogenic microbes that colonize cattle; reduced mortality; increased production of antimicrobials; increased clearance of pathogenic microbes; increased resistance to colonization of pathogenic microbes that colonize cattle; increased resistance to colonization of pathogenic microbes that infect humans; and any combination thereof; reduced incidence and/or prevalence of acidosis or bloat; reduced body temperature; improved rumen wall integrity; faster adaptation to a high grain diet; improved tolerance of a high grain diet; wherein said increase or reduction is determined by comparing against an animal not having been administered said composition.

32. The method of claim 31, wherein said increase in weight is an increase by at least 0.1%.

33. The method of claim 31, wherein said reduction in manure production is a reduction by at least 0.1%.

34. The method of claim 31, wherein said increase in polysaccharide degradation is an increase in the degradation of lignin, cellulose, and/or hemicellulose.

35. The method of claim 31, wherein said increase in fatty acid concentration is an increase in acetic acid, propionic acid, and/or butyric acid.

36. The composition of claim 11, wherein the at least one microbial strain exhibit an increased utility that is not exhibited when said at least one microbial strain occurs alone, or when said at least one microbial strain is present at naturally occurring concentrations.

37. The composition of claim 11, wherein the at least one microbial strain exhibits a synergistic effect on imparting at least one improved trait in an animal.

38. A feedlot cattle feed supplement capable of increasing a desirable phenotypic trait in feedlot cattle, the feed supplement comprising:
    (a) a microbial composition of any one of claims 1-9 present at a concentration that does not occur naturally in said cattle, and
    (b) an acceptable carrier.

39. The feedlot cattle feed supplement of claim 38, wherein the microbial composition is encapsulated.

40. An isolated microbial strain selected from any one of the microbial strains in Table 1 and/or Table 2.

41. An isolated microbial strain selected from the group consisting of:
(a) Ascusbbf_6176A deposited as ATCC Accession Deposit No. PTA-125041;
(b) Ascusbbf_4883A deposited as ATCC Accession Deposit No. PTA-125042;
(c) Ascusbbf_13543A deposited as ATCC Accession Deposit No. PTA-125033;
(d) Ascusbbf_152A deposited as ATCC Accession Deposit No. PTA-125051;
(e) Ascusbbf_707A deposited as ATCC Accession Deposit No. PTA-125049;
(f) Ascusbbf_1238A deposited as ATCC Accession Deposit No. PTA-125033;
(g) Ascusbbf_5588A deposited as ATCC Accession Deposit No. PTA-125040; and
(h) Ascusbbf_4691A deposited as ATCC Accession Deposit No. PTA-125050.

42. An isolated microbial strain comprising a polynucleotide sequence sharing at least 90% sequence identity with any one of SEQ ID NOs:1-100.

43. A substantially pure culture of an isolated microbial strain according to any one of claims 40 to 42.

44. A method of modulating the microbiome of a cow, the method comprising administering the composition of claim 12.

45. The method of claim 44, wherein the administration of the composition imparts at least one improved trait upon the steer, bull, cow, or heifer.

46. The method of claim 45, wherein the at least one improved trait is selected from the group consisting of: an increase in weight; an increase of musculature; an increase of fatty acid concentration in the gastrointestinal tract; an increase of fatty acid concentration in the rumen; a decrease in lactate concentration in the rumen; an improved efficiency in feed utilization and digestibility; an improved feed efficiency; an improved average daily gain; an improved dry matter intake; an increase in polysaccharide and lignin degradation; an increase in fat, starch, and/or protein digestion; an increase in fatty acid concentration in the rumen; pH balance in the rumen, an increase in vitamin availability; an increase in mineral availability; an increase in amino acid availability; a reduction in methane and/or nitrous oxide emissions; a reduction in manure production; an improved efficiency of nitrogen utilization; an improved efficiency of phosphorous utilization; an increased resistance to colonization of pathogenic microbes that colonize cattle; reduced mortality; increased production of antimicrobials; increased clearance of pathogenic microbes; increased resistance to colonization of pathogenic microbes that colonize cattle; increased resistance to colonization of pathogenic microbes that infect humans; and any combination thereof; reduced incidence and/or prevalence of acidosis or bloat; reduced body temperature; improved rumen wall integrity; faster adaptation to a high grain diet; improved tolerance of a high grain diet; wherein said increase or reduction is determined by comparing against an animal not having been administered said composition.

47. The method of claim 46, wherein said increase in weight is an increase by at least 0.1%.

48. The method of claim 46, wherein said increase in feed efficiency is an increase by at least 0.1%.

49. The method of claim 46, wherein said increase in polysaccharide degradation is an increase in the degradation of lignin, cellulose, and/or hemicellulose.

50. The method of claim 46, wherein said increase in fat digestion, starch digestion, and/or protein digestion is an increase by at least 0.1%.

51. The method of claim 46, wherein said increase in fatty acid concentration is an increase in acetic acid, propionic acid, and/or butyric acid.

52. The method of claim 45, wherein the modulation of the microbiome is an increase in the proportion of the at least one microbial strain of the microbiome, wherein the increase is measured relative to a steer, bull, cow, or heifer that did not have the at least one microbial strain administered.

53. The method of claim 45, wherein the modulation of the microbiome is a decrease in the proportion of the microbial strains present in the microbiome prior to the administration of the composition, wherein the decrease is measured relative to the microbiome of the steer, bull, cow, or heifer prior to the administration of the composition.

54. A method of increasing resistance of cattle to the colonization of pathogenic microbes, the method comprising the administration of the composition of claim 11, wherein the pathogen is unable to colonize the gastrointestinal tract of the steer, bull, cow, or heifer.

55. The method of treating cattle for the presence of at least one pathogenic microbe, the method comprising the administration of the composition of claim 11.

56. The method of claim 55, wherein after administration of the composition the relative abundance of the at least one pathogenic microbe decreases to less than 5% relative abundance in the gastrointestinal tract.

57. The method of claim 56, wherein the relative abundance of the at least one pathogenic microbe decreases to least than 0.1% relative abundance in the gastrointestinal tract.

58. The method of claim 56, wherein the at least one pathogenic microbe is undetectable in the gastrointestinal tract.

59. The method of claim 58, wherein less than 10 days post administration of the composition the at least one pathogenic microbe is undetectable in the gastrointestinal tract.

60. The method of claim 58, wherein within 5-15 days post administration of the composition the at least one pathogenic microbe is undetectable in the gastrointestinal tract.

61. The method of any one of claims 54-61, wherein the at least one pathogenic microbe is selected from: *Clostridium perfringens, Clostridium botulinum, Salmonella typi, Salmonella typhimurium, Salmonella enterica, Salmonella pullorum, Erysipelothrix insidiosa, Campylobacter jejuni, Campylobacter coli, Campylobacter lari, Listeria monocytogenes, Streptococcus agalactiae, Streptococcus dysgalactiae, Corynebacterium bovis, Mycoplasma* sp., *Citrobacter* sp., *Enterobacter* sp., *Pseudomonas aeruginosa, Pasteurella* sp., *Bacillus cereus, Bacillus licheniformis, Streptococcus uberis, Staphylococcus aureus*, and *patho-* genic strains of enteropathogenic, enteroinvasive, or enterohemorrhagic *Escherichia coli*, and *Staphylococcus aureus*.

62. The method of claim 61, wherein the at least one pathogenic microbe is selected from enteropathogenic *E. coli*, enteroinvasive *E. coli*, or enterohemorrhagic *E. coli*.

64. The method of claim 17, wherein said composition is administered to the animal in a high grain diet adaptation phase.

65. The method of claim 17, wherein said composition is administered to the animal on a feed lot diet.

67. The method of claim 17, wherein said composition is administered to the animal on a grain intensive diet.

In aspects, the aforementioned microbial species—that is, a purified microbial population that comprises a bacteria with a 16S nucleic acid sequence, and/or a fungi with an ITS nucleic acid sequence, which is at least about 97% identical to a nucleic acid sequence selected from the group consisting of: SEQ ID NOs: 1-5,368—are members of a Markush group, as the present disclosure illustrates that the members belong to a class of microbes characterized by various physical and functional attributes, which can include any of the following: a) the ability to convert a carbon source into a volatile fatty acid such as acetate, butyrate, propionate, or combinations thereof; b) the ability to degrade a soluble or insoluble carbon source; c) the ability to impart a decreased methane output in feedlot cattle administered the microbe (s); d) the ability to modulate the microbiome of the gastrointestinal tract of feedlot cattle administered the microbe; e) the ability to be formulated into a shelf-stable composition; f) the ability to exhibit a decrease in feed conversion ratio and/or increase the weight gain, and/or increase the average daily gain in feedlot cattle having been administered the microbe(s); g) the ability to impart a decrease in pathogen-associated lesion formation in the gastrointestinal tract; h) the ability to impart a decrease in pathogenic microbes in the gastrointestinal tract; i) possessing a MIC score of at least about 0.4 if a bacteria. j) the ability to reduce acidosis and/or bloat in feedlot cattle administered the microbe; k) the ability to reduce carbon dioxide concentrations in the rumen of feedlot cattle administered the microbe; l) the ability to increase pH and/or improve the buffering capability of the rumen of feedlot cattle administered the microbe; and/or m) reduce lactate concentrations in the rumen of feedlot cattle administered the microbe. Thus, the members of the Markush group possess at least one property in common, which can be responsible for their function in the claimed relationship.

As used herein "shelf-stable" refers to a functional attribute and new utility acquired by the microbes formulated according to the disclosure, which enable said microbes to exist in a useful/active state outside of their natural environment in the gastrointestinal tract (i.e. a markedly different characteristic). Thus, shelf-stable is a functional attribute created by the formulations/compositions of the disclosure and denoting that the microbe formulated into a shelf-stable composition can exist outside the gastrointestinal tract and under ambient conditions for a period of time that can be determined depending upon the particular formulation utilized, but in general means that the microbes can be formulated to exist in a composition that is stable under ambient conditions for at least a few days and generally at least one week. Accordingly, a "shelf-stable feedlot cattle supplement" is a composition comprising one or more microbes of the disclosure, said microbes formulated in a composition, such that the composition is stable under ambient conditions for at least one week, meaning that the microbes comprised in the composition (e.g. whole cell, spore, or lysed cell) are able to impart one or more beneficial phenotypic properties to feedlot cattle when administered (e.g. increased weight gain, improved gastrointestinal health, and/or modulation of the gastrointestinal microbiome).

In some embodiments, the isolated microbial strains of the present disclosure further encompass mutants thereof. In some embodiments, the present disclosure further contemplates microbial strains having all of the identifying characteristics of the presently disclosed microbial strains.

TABLE 11

Budapest Treaty Deposits of the Disclosure

| Depository | Accession Number | Date of Deposit |
|---|---|---|
| NRRL | B-67550 | Feb. 7, 2018 |
| NRRL | B-67551 | Feb. 7, 2018 |
| NRRL | B-67552 | Feb. 7, 2018 |
| NRRL | B-67553 | Feb. 7, 2018 |
| NRRL | B-67554 | Feb. 7, 2018 |
| NRRL | B-67555 | Feb. 7, 2018 |
| ATCC | PTA-12942 | Feb. 14, 2018 |
| ATCC | PTA-125033 | Mar. 22, 2018 |
| ATCC | PTA-125040 | Mar. 29, 2018 |
| ATCC | PTA-125041 | Mar. 29, 2018 |
| ATCC | PTA-125042 | Mar. 29, 2018 |
| ATCC | PTA-125049 | Apr. 4, 2018 |
| ATCC | PTA-125050 | Apr. 4, 2018 |
| ATCC | PTA-125051 | Apr. 5, 2018 |
| ATCC | PTA-125052 | Apr. 5, 2018 |

INCORPORATION BY REFERENCE

All references, articles, publications, patents, patent publications, and patent applications cited herein are incorporated by reference in their entireties for all purposes.

However, mention of any reference, article, publication, patent, patent publication, and patent application cited herein is not, and should not be taken as, an acknowledgment or any form of suggestion that they constitute valid prior art or form part of the common general knowledge in any country in the world.

Ascus Biosciences, Inc. is the assignee/applicant of the following patents and/or patent publications that relate generally to the subject matter of microbial compositions, microbial ensembles, methods of making the compositions and ensembles, and methods of administering such: PCT Publication Nos. WO2016210251A1, WO2017120495A1, and WO2017181203A1; U.S. Pat. Nos. 9,540,676 and 9,938,558; and U.S. Pregrant Publication Nos. US20170342457A1, US20160376627A1, US20170107557A1, US20170196922A1, and US20170196921A1.

SEQUENCE LISTING (5993 sequences)

SEQ ID NO: 1 - DNA, 225 bp, Unknown
  Ascusbbf_6176, encodes 16S rRNA
agagtttgatcatggctcaggatgaacgctagctacaggcttaacacatgcaagtcgaggggcagcatgatctaagcttgcttagattgatggcgaccggcgcacgggtgagtaacgcgtatccaaccttccctatagtagaggatagcccggcgaaagtcggattaatactctatgttttccaatgcagacatctaagttggaacaaaggttcaccgctatagg

SEQ ID NO: 2 - DNA, 225 bp, Unknown
  Ascusbbf_22143, encodes 16S rRNA
agagtttgatcctggctcaggatgaacgctagctacaggcttaacacatgcaagtcgcggggcagcatgtaggttgcttgcaacctatgatggcgaccggcgcacgggtgcgtaacgcgtatccaaccttcccttcagcagggcacagcccgttgaaagacggattaattccctatgttctcctttgcgggcatctgatgaggagtaaaggctttagccgctgaa

SEQ ID NO: 3 - DNA, 225 bp, Unknown
  Ascusbbf_4883, encodes 16S rRNA
agagtttgatcatggctcaggatgaacgctagctacaggcttaacacatgcaagtcgaggggcagcatattggtagcttgctaccaatgatggcgaccggcgcacgggtgagtaacgcgtatccaaccttccccatagtagggcatagcccgtagaaatgcggattaataccctatgttttccgaagatgacatctgatttggaacaaaggttcaccgctatggg

SEQ ID NO: 4 - DNA, 225 bp, Unknown
  Ascusbbf_13543, encodes 16S rRNA
agagtttgatcatggctcaggacgaacgctggcggcgtgcttaacacatgcaagtcgaacgggattgattgaaagcttgcttttgagagatctagtggcaaacgggtgagtaacgcgtaggcaacctacccttgggatggggacaacaggacgaaagccctgctaataccgaatgaagcatcccttccgcatggaggggatatgaaagatggcctctacttgtaa

SEQ ID NO: 5 - DNA, 225 bp, Unknown
  Ascusbbf_152, encodes 16S rRNA
agagtttgatcatggctcaggacgaacgctggcggcgtgcttaacacatgcaagtcgaacgagaatccgtggaaagagttttcggacaatggaagcggaggaaagtggcggacgggtgagtaacgcgtgaggaacctgccttggagagggggacaacagctggaaacggctgctaataccgcatgatgcattggggtcgcatggctctgatgccaaagatttatc

SEQ ID NO: 6 - DNA, 225 bp, Unknown
  Ascusbbf_707, encodes 16S rRNA
agagtttgatcctggctcaggatgaacgctagctacaggcttaacacatgcaagtcgaggggcagcgagaggaaagcttgctttccttgtcggcgaccggcgcacgggtgagtaacgcgtatccaaccttccccttagtagggcatagcccggcgaaagtcggattaataccctatgttttccaatgaggacatctgagctggaacaaagatttatcgctaaggg

SEQ ID NO: 7 - DNA, 225 bp, Unknown
  Ascusbbf_1238, encodes 16S rRNA
agagtttgatcctggctcagaacgaacgctggtggagtgtcttatacatgcaagtcgagcgaggacgtagcaatacgagccgagcggcgaatgggtgagtaacgcgtaagcaatctgccccgcattccggaacaaccgtgccaacgcgcggctaatgccgggagccgtggcggtccacatgggccgttgacgaaagatttatcgatgcgggatgagcttgcgtcc

SEQ ID NO: 8 - DNA, 225 bp, Unknown
  Ascusbbf_5588, encodes 16S rRNA
agagtttgatcctggctcaggatgaacgctagctacaggcttaacacatgcaagtcgaggggcagcatgacgagtgcttgcacttgttgatggcgaccggcgcacgggtgcgtaacgcgtatcgaaccttccccttactcgggaatagcccggtgaaaaccgaattaatgcccgatatatatttagatggcatcagaagagtatgaaagatttatcggtaaggga

SEQ ID NO: 9 - DNA, 225 bp, Unknown
  Ascusbbf_4691, encodes 16S rRNA
agagtttgatcctggctcaggatgaacgctggcggcgtgcctaacacatgcaagtcgaacgaagcatcttcctcagagattcgtcgaagagggatttgacttagtggcggacgggtgagtaatgtatgagcaacctgcctttcagagggggacaacagttggaaacgactgctaataccgcataatgtatcgagggggcatccctttgataccaaaggagcaatc

SEQ ID NO: 10 - DNA, 225 bp, Unknown
  Ascusbbf_59499, encodes 16S rRNA
agagtttgatcctggctcaggatgaacgctggcggcgtgcctaacacatgcaagtcgaacgaagcacttttaccggagattcgtcgaaggtgaatttgacttagtggcggacgggtgagtaatgtatgagcaacctgcctttcagtgggggacaacagttggaaacgactgctaataccgcataacgtatcgagggggcatccccatgataccaaaggatttatt

SEQ ID NO: 11 - DNA, 225 bp, Unknown
  Ascusbbf_9770, encodes 16S rRNA
agagtttgatcatggctcaggatgaacgctggcggcgtgcctaatacatgcaagtcgagcgaggtagcttgctacctagcggcgaacgggtgagtaacacgtaggtaacctgcctttaagactgggatacccgagggaaacttcggctaataccggataacaacggggatggcatcatctccgcttgaaaggtgcgtttgcaccacttttagatggacctgcggc

SEQ ID NO: 12 - DNA, 225 bp, Unknown
  Ascusbbf_123632, encodes 16S rRNA
agagtttgatcatggctcagaacgaacgctggcggcgcgtcttaaccatgcaagtcggacggcaaggcgggagcttgctcctgccctagagtggcggactggtgagtaacacgtgggtgacgaaccctgctgactgggatagccgctagaaatagcggataataccggatacggccgtatgtatcagaagcatacggggaaagggagcttaggctccgcaggagg

SEQ ID NO: 13 - DNA, 225 bp, Unknown
  Ascusbbf_14146, encodes 16S rRNA
agagtttgatcctggctcaggatgaacgctagctacaggcttaacacatgcaagtcgaggggcagcattttagtttgcttgcaaactaaagatggcgaccggcgcacgggtgagtaacacgtatccaacctgccgataactcggggatagcctttcgaaagaaagattaatatccgatagtatattaaaaccgcatggttttactattaaagaatttcggttatc

SEQ ID NO: 14 - DNA, 225 bp, Unknown
  Ascusbbf_1103, encodes 16S rRNA
agagtttgatcatggctcaggatgaacgctggcggcgtgcttaacacatgcaagtcgaacggagtattgagaatgaagttttcggatggatttttcaatacttagtggcggacgggtgagtaacgcgtgggtaacctgcctcacacagggggataacagttggaaacgactgttaataccgcataagaccacagtaccgcatggtacaggggtaaaaactccggt

SEQ ID NO: 15 - DNA, 225 bp, Unknown
  Ascusbbf_498, encodes 16S rRNA
agagtttgatcatggctcaggatgaacgctggcggcgtgcctaacacatgcaagtcgagcggagagccgtaacggaagccttcgggcggaagatgcggttacttagcggcggacgggtgagtaacgcgtggataacctggctcatacagggggataacagagagaaatctctgctaataccgcataagcgcacagtgctgcatggcacagtgtgaaaagccgaga

SEQ ID NO: 16 - DNA, 225 bp, Unknown
  Ascusbbf_13717, encodes 16S rRNA
agagtttgatcctggctcaggatgaacgctagctacaggcttaacacatgcaagtcgaggggcagcatggaggttgcttgcaacttccgatggcgaccggcgcacgggtgagtaacacgtatccaaccttccccgcggtagggaacagcccgctgaaaggcggattaatgccctatggtctcctttgcaggcatctaacgaggagtaaagattgatcgccgcggg

SEQ ID NO: 17 - DNA, 225 bp, Unknown
  Ascusbbf_876, encodes 16S rRNA
agagtttgatcctggctcaggatgaacgctggcggcgtgcctaacacatgcaagtcgagcggagtgaagagagcttgcttttttcacttagcggcggatgggtgaggaacgcgtggggaacctgcctctcacagggggataacagctggaaacggctgttaataccgcatatgcacacagtgccgcatggcacagggtggaaagaaattcggtgagagatggacc

SEQ ID NO: 18 - DNA, 225 bp, Unknown
  Ascusbbf_612, encodes 16S rRNA
agagtttgatcatggctcaggatgaacgctagctacaggcttaacacatgcaagtcgaggggcagcatgaagtcagcttgctgactttgatggcgaccggcgcacgggtgcgtaacacgtatccaatctacccatctgctcggggatagcctttcgaaagaaagattaatacccgatggtttcgttttttcgcatgagaagatgaataaagatttatcggcgatg

SEQ ID NO: 19 - DNA, 225 bp, Unknown
  Ascusbbf_4936, encodes 16S rRNA
agagtttgatcatggctcaggacgaacgctggcggcgtgcttaacacatgcaagtcgaacggggcgattagaagcttgcttttatgagcctagtggcaaacgggtgagtaacgcgtaggcaacctgcctctaagatggggacaacagcccgaaagggctgctaataccgaatgttgtaagtaactcgcatgagagacttaccaaagatggcctctacttgtaagc

SEQ ID NO: 20 - DNA, 225 bp, Unknown
  Ascusbbf_6809, encodes 16S rRNA
agagtttgatcctggctcaggatgaacgctagctacaggcttaacacatgcaagtcgaggggcagcatgacgatagcttgctattgttgatggcgaccggcgcacgggtgagtaacgcgtatccaaccttcccatagctagggaataaccttgcgaaagtaagactaatgccctataatattctttgcagacatctaaagagaattaaagatttatcggctatgg

SEQ ID NO: 21 - DNA, 225 bp, Unknown
  Ascusbbf_113152, encodes 16S rRNA
agagtttgatcctggctcaggatgaacgctggcggcgtgcttaacacatgcaagtcgaacggactttacatgaagcctagcgattgtaaagttagtggcggacgggtgagtaacgcgtgaataacctgccctgtaccgggggacaacagttggaaacgactgctaataccgcataagcgcacggttccgcatggaacagtgtgaaaaactccggtggtacaggat

SEQ ID NO: 22 - DNA, 225 bp, Unknown
  Ascusbbf_18, encodes 16S rRNA
agagtttgatcctggctcaggacgaacgctggcggcgtgcctaacacatgcaagtcgaacggaactgcttcgaaggatttcttcggaatgacattgattcagtttagtggcggacgggtgagtaacgcgtgagtaacctgccttcaagagggggataacattctgaaaagaatgctaataccgcatgacatatgattgtcgcatggcagacatatcaaagattta

SEQ ID NO: 23 - DNA, 225 bp, Unknown
  Ascusbbf_9031, encodes 16S rRNA
agagtttgatcatggctcaggatgaacgctagctacaggcttaacacatgcaagtcgaggggcagcatggtcttagcttgctaagattgatggcgaccggcgcacgggtgagtaacgcgtatccaaccttccctatagtaggggatagcccgtagaaatgcggattaataccctatgttgtattttgaggacatctgacgaataccaaaggttcaccgctatagg

SEQ ID NO: 24 - DNA, 225 bp, Unknown
  Ascusbbf_11823, encodes 16S rRNA
agagtttgatcctggctcagaacgaatgctggcggtgcgtcttaagcatgcaagtcgaacggcaagggtagcttgctacccctagagtggcggactggtgagtaacgcgtaggtgatgtacctttcggatggggatagccagtagaaatattggataataccgaatacgatttcatatcttagaagtatgaaatgaaaagagctatggctctgccgatagaacgg

SEQ ID NO: 25 - DNA, 225 bp, Unknown
  Ascusbbf_1007, encodes 16S rRNA
agagtttgatcctggctcaggatgaacgctagcgacaggcttaacacatgcaagtcgaggggcagcgtggcggtagcaatactgccgacggcgaccggcgcactggtgagtaacacgtatgcaacctgcccctggttgggggataacccgcggaaacgcggcctaataccccgtatgcgccgaggccgcatgacttcggcgtgatagaacttcgtccagggatgg

SEQ ID NO: 26 - DNA, 225 bp, Unknown
  Ascusbbf_24422, encodes 16S rRNA
agagtttgatcctggctcaggatgaacgctagctacaggcttaacacatgcaagtcgaggggcagcatggggatggcttgccattcccgatggcgaccggcgcacgggtgagtaacgcgtatccaacctgcccgcaaccgcggaatagcccgccgaaaggcggattaatgccgcatgagctcgcgtgaggacatctgcccgcgagcaaaggttcgttccggttgc

SEQ ID NO: 27 - DNA, 225 bp, Unknown
  Ascusbbf_951, encodes 16S rRNA
agagtttgatcctggctcaggatgaacgctggcggcgcgcctaacacatgcaagtcgaacggttaaagcaccttcgggtgtgtataaagtggcgaacggctgagtaacacgtgggcaacctgcccctcgcaccgggatagcctcgggaaaccgtggttaataccggatactccgggacccccgcatgggggtgccgggaaagccctgacggcgagggatgggccc

SEQ ID NO: 28 - DNA, 225 bp, Unknown
  Ascusbbf_80169, encodes 16S rRNA
agagtttgatcctggctcaggatgaacgctggcggcgtgcctaacacatgcaagtcgaacgaagcgattttgcggaagttttcggatggaagtaaaattgactgagtggcggacgggtgagtaacgcgtgggtaacctgcctcacactgggggacaacagttagaaatgactgctaataccgcataagcgcacagtaccgcatggtacggtgtgaaaaactccgg

SEQ ID NO: 29 - DNA, 225 bp, Unknown
  Ascusbbf_5699, encodes 16S rRNA
agagtttgatcatggctcagaacgaacgctggcggcgcgtcttaagcatgcaagtcgagcgggattgggtagcttgctatccatgagagcggcggactggtgagtaacgcgtgggtgacgtaccctttagacggggatagctcctagaaataggaggtaataccggatacgatagtgagtgtcagaggctcattatgaaaggttcttttgaaccgctgaaggagc

SEQ ID NO: 30 - DNA, 225 bp, Unknown
  Ascusbbf_130, encodes 16S rRNA
agagtttgatcatggctcaggatgaacgctagctacaggcttaacacatgcaagtcgaggggcagcatgaagtttgcttgcaaactttgatggcgaccggcgcacgggtgagtaacgcgtatccaaccttccccttactagggaatagcccggcgaaagtcggattaatgccctatgttctcctttgcgggcatctaacgaggagcaaagattcatcggtaaggg

SEQ ID NO: 31 - DNA, 225 bp, Unknown
  Ascusbbf_10109, encodes 16S rRNA
agagtttgatcctggctcaggacgaacgctggcggcgtgcttaacacatgcaagtcgaacggagaatttgcttcggtgaattcttagtggcgaacgggtgagtaacgcgtaggcaacctgccctctggttggggacaacattccgaaagggatgctaataccgaatgtgctcacacttccgcatggaggtgtgaggaaagatggcctctacttgtaagctatcgc

SEQ ID NO: 32 - DNA, 225 bp, Unknown
  Ascusbbf_29797, encodes 16S rRNA
agagtttgatcctggctcaggatgaacgctagcgacaggcttaacacatgcaagtcgaggggcagcatgggaggtggcaacaccacccgatggcgaccggcgcactggtgagtaacacgtatgcaacctgccccctacagggggataatccagagaaatttggtctaataccccgtagtcagcgagagggcatcctctcactgggaaagctccggcggtagggga

SEQ ID NO: 33 - DNA, 225 bp, Unknown
  Ascusbbf_24410, encodes 16S rRNA
agagtttgatcctggctcaggacgaacgctggcggcgtgcttaacacatgcaagtcgaacgaggattacgagattgagagcttcggcaggattgatcgtaattcgagtggcggacgggtgagtaacgcgtgagcaatctgtcccagacaggggaataacacttggaaacaggtgctaataccgcataagaccacagtatcgcatggtacaggggtaaaaggagga

SEQ ID NO: 34 - DNA, 225 bp, Unknown
  Ascusbbf_54068, encodes 16S rRNA
agagtttgatcctggctcaggatgaacgctggcggcgtgcctaacacatgcaagtcgaacggagtttttattgatttcttcggattgatatagaaacttagtggcggacgggtgagtaacacgtgggtaacctgccttacagagggggatagcagctggaaacggctgataataccgcataagcacacagtaccgcatggtacagggtgaaaagatttatcactg

SEQ ID NO: 35 - DNA, 225 bp, Unknown
  Ascusbbf_7003, encodes 16S rRNA
agagtttgatcctggctcaggatgaacgctggcggcgtgcctaacacatgcaagtcgaacgaggtaaatgagatgaagttttcggatggattcttatttaccgagtggcggacgggtgagtaacgcgtgggtaacctgcctcatacagggggataacgattggaaacgattgctaataccgcataagcgcacagtaccacatggtacagtgtgaaaaactccggt

SEQ ID NO: 36 - DNA, 225 bp, Unknown
  Ascusbbf_23, encodes 16S rRNA
agagtttgatcctggctcaggatgaacgctggcggcgtgcttaacacatgcaagtcgaacggagaactgcccttcgggacggttcttagtggcggacgggtgagtaacgcgtgaggaacctgccttggagtggggaataacggctggaaacggccgctaataccgcataatgcagttgggtcgcatggctctgactgccaaagatttattgctctgagatggcct

SEQ ID NO: 37 - DNA, 225 bp, Unknown
  Ascusbbf_1697, encodes 16S rRNA
agagtttgatcctggctcaggatgaacgctagctacaggcttaacacatgcaagtcgaggggcagcaggatcttagcttgctaagattgctggcgaccggcgcacgggtgagtaacgcgtatccaaccttccccttagtagggcatagcccgatgaaaatcggattaataccctatgttttccaatgaggacatctgagctggaacaaagattcatcgctaaggg

SEQ ID NO: 38 - DNA, 225 bp, Unknown
  Ascusbbf_24513, encodes 16S rRNA
agagtttgatcctggctcagaacgaacgctggcggcgcgtcttaagcatgcaagtcgagcgggattcatgtgcttgcacatgatgagagcggcggactggtgagtaacacgtaggtgacgtaccttgaggacggggacagccggcagaaatgccgggtaataccggataagctcgcgcgagccggaatcgcgcgaggaaaggagctaaggctccgcctccagagc

SEQ ID NO: 39 - DNA, 225 bp, Unknown
  Ascusbbf_7586, encodes 16S rRNA
agagtttgatcctggctcaggatgaacgctagctacaggcttaacacatgcaagtcgaggggcagcatgaggtttgcttgcaaaccttgatggcgaccggcgcacgggtgcgtaacgcgtatccaaccttccagctactagggaatagcccgttgaaagacggattaatgccctatgtgttcattagatggcatcagatgttgaacaaagattcatcggtagctg

SEQ ID NO: 40 - DNA, 225 bp, Unknown
  Ascusbbf_27854, encodes 16S rRNA
agagtttgatcctggctcaggatgaacgctagcgacaggcttaacacatgcaagtcgaggggcagcggggctgaaagcttgctttcagctgccggcgaccggcgcacgggtgagtaacacgtatgcaacctggccgtgacagatggataaccgggagaaattccgcctaatacagcataacaccactggatgacatcctccggtggtcaaaggaggcgactccgg

SEQ ID NO: 41 - DNA, 225 bp, Unknown
  Ascusbbf_1034, encodes 16S rRNA
agagtttgatcctggctcaggatgaacgctggcggcgtgcctaacacatgcaagtcgaacgaagcacttctggtttgagattcgtcaagaaccgggattgacttagtggcggacgggtgagtaatgtatgagcaacctgcctttcagagggggacaacagttggaaacgactgctaataccgcataatgtatttgggtggcatcacttggataccaaaggagcaa

SEQ ID NO: 42 - DNA, 225 bp, Unknown
  Ascusbbf_23134, encodes 16S rRNA
agagtttgatcatggctcaggatgaacgctagcggcaggcttaacacatgcaagtcgaggggcatcgcggtgtagcaatacactggcggcgaccggcggaagggtgcgtaacgcgtgagcaacatgcccgtggcagggggataatcgatggaaacgtcgtctaagaccccgtaacaactgggagcgcatgttcctggtttgaaagcttcggcggccacggattgg

SEQ ID NO: 43 - DNA, 225 bp, Unknown
  Ascusbbf_7027, encodes 16S rRNA
agagtttgatcatggctcagaatgaacgctggcggcaggcctaacacatgcaagtcgaacgcatccttcggggtgagtggcggacgggtgagtaacacgtgggaacgtaccctttgctacggaatagtctcgggaaactgggggtaataccgtatgtgccctacgggggaaagatttatcggcaaaggatcggcccgcgttggattaggtagttggtggggtaat

SEQ ID NO: 44 - DNA, 225 bp, Unknown
  Ascusbbf_43679, encodes 16S rRNA
agagtttgatcatggctcaggatgaacgctagcggcaggcttaacacatgcaagtcgaggggcagcgcggtgtagcaatacactggcggcgaccggcgcaagggtgcgtaacgcgtgagcgacatacccgtgactggggcataaccgatggaaacgtcgcctaattccccataatacaagggaccgcatgattccttgttgaaaacttcggtggtcacggattgg

SEQ ID NO: 45 - DNA, 225 bp, Unknown
  Ascusbbf_63954, encodes 16S rRNA
agagtttgatcctggctcaggatgaacgctagcggtaggcttaacacatgcaagtcgaggggcagcgtatcgagtagcaatacttgatgacggcgaccggcggatgggtgagtaacgcgtatgcaacctaccttgtacagggggatagacactggaaacggtgcgtaatatcccgtaatgttgtggagaggcatcttttcacaaagaaaggagcgatctggtata

SEQ ID NO: 46 - DNA, 225 bp, Unknown
  Ascusbbf_1517, encodes 16S rRNA
agagtttgatcatggctcaggacgaacgctggcggcgtgcctaacacatgcaagtcgaacggggattttgtttcggcagaatcctagtggcgaacgggtgagtaacgcgtaggcaacctgccctccggccggggacaacactccgaaaggggtgctaataccggatacgaagtctgtgccgcatggtacggatttgaaagatggcctctatttataagctatcgc

SEQ ID NO: 47 - DNA, 225 bp, Unknown
  Ascusbbf_104, encodes 16S rRNA
agagtttgatcctggctcaggataaacgctggcggcgtgcctaatacatgcaagtcgaacgaggaagacccagcttgctgggttgaccgagtggcgaacgggtgagtaatacataagcaacctgcccacggagaccgggataatctctggaaacggggactaaaaccggataggcagcaatgaggcatctcaatgctgttaaaggtgagagacactggtggatgg

SEQ ID NO: 48 - DNA, 225 bp, Unknown
  Ascusbbf_148, encodes 16S rRNA
agagtttgatcctggctcaggatgaacgctggcggcgtgcctaacacatgcaagtcgaacgagcgagagatgaaacctagtgattctcaagcgagtggcggacgggtgagtaacgcgtgggtaacctgccttacagagggggataacagtctgaaaagactgctaataccgcataagcacacagtaccgcatggtacagggtgaaaagatttatcactgtaagat

SEQ ID NO: 49 - DNA, 225 bp, Unknown
  Ascusbbf_944, encodes 16S rRNA
agagtttgatcctggctcaggatgaacgctagctacaggcttaacacatgcaagtcgaggggtaacatgaagaaagcttgctttctttgatgacgaccggcgcacgggtgagtatcgcgtatccaacctgcccataagtagggaatagccttgcgaaagtaagattaatgccctatggtttccattgaagacatctgagatggaataaagatttatcgcttatgg

SEQ ID NO: 50 - DNA, 225 bp, Unknown
  Ascusbbf_76009, encodes 16S rRNA
agagtttgatcctggctcaggatgaacgctggcggcgtgcctaacacatgcaagtcgaacgaagcttctcttatgattttttcggaatgattaagagaatgacttagtggcggacgggtgagtaacgcgtggataacctgccctttgcagggggataacagttagaaatgactgctaataccgcataagcgcacactaccgcatggtagagtgtgaaaagcgtat

SEQ ID NO: 51 - DNA, 225 bp, Unknown
  Ascusbbf_23033, encodes 16S rRNA
agagtttgatcctggctcaggatgaacgctggcggcgtgcttaatacatgcaagtcgaacggatgagatcaggcagcttgctgtctgattgatttagtggcgaacgggtgagtaatacgtaggcaacctgccccaaagcgggggatagcagttggaaacgactattaataccgcataggtaatcttgaggcatcttgagattattaaaggtgcgtttgcaccgct

SEQ ID NO: 52 - DNA, 225 bp, Unknown
  Ascusbbf_20389, encodes 16S rRNA
agagtttgatcctggctcaggacgaacgctggcggcgtgcttaacacatgcaagtcgaacgatgaagtggtgcttgcaccatggattagtggcgaacgggtgagtaacacgtgagtaacctgcccctaactttgggataactccgggaaaccggggctaataccggatatgagatttcaccgcatggtggggtttggaaagttttttcggttagggatgggctcg

SEQ ID NO: 53 - DNA, 225 bp, Unknown
  Ascusbbf_2600, encodes 16S rRNA
agagtttgatcctggctcagattgaacgctggcggcatgccttacacatgcaagtcgaacggcagcgggggagcttgctcctgccggcgagtggcgaacgggtgagtaatgcatcggaacgtgtcctgtcgtgggggataactggccgaaaggtcagctaataccgcatgagacccgagggtgaaagcgggggatcgcaagacctcgcgcgactggagcggccga

SEQ ID NO: 54 - DNA, 225 bp, Unknown
  Ascusbbf_8118, encodes 16S rRNA
agagtttgatcctggctcaggatgaacgctagctacaggcttaacacatgcaagtcgaggggcatcatgtgaggacttcggtcctttcgatggcgaccggcgaatgggtgagtaacacgtatccgacctgccctgtactggaggatagcctcccgaaagggaaattaatactccatgtgtcatgttgcttcatggtggcatgatgaaagatttatcggtacagga

SEQ ID NO: 55 - DNA, 225 bp, Unknown
  Ascusbbf_201, encodes 16S rRNA
agagtttgatcctggctcaggatgaacgctagctacaggcttaacacatgcaagtcgaggggcagcatatagatagcttgctatttatgatggcgaccggcgcacgggtgagtaacgcgtatccaaccttccctatactagagaatagcccggcgaaagtcggattaatgctctatgttcttctttgatggcatctgacgagaagcaaaggtttaccggtatagg

SEQ ID NO: 56 - DNA, 225 bp, Unknown
  Ascusbbf_6315, encodes 16S rRNA
agagtttgatcatggctcagaacgaacgctggcggcgcgtcttaagcatgcaagtcggacggcaagagaagtgcttgcacttctcctagagtggcggactggtgagtaacaggtgggtgacatacccttcagatggggatagccggtagaaataccgggtaataccgaatacgctcgtacatctcggaagtgtacgaggaaaggagctacggcttcgctgttgga

SEQ ID NO: 57 - DNA, 225 bp, Unknown
  Ascusbbf_10712, encodes 16S rRNA
agagtttgatcctggctcaggacgaacgctggcggcgtgcttaacacatgcaagtcgaacgagaagagatgagaagcttgcttcttatctcttcgagtggcaaacgggtgagtaacgcgtaagcaacctgcccttcagatggggacaacagctggaaacggctgctaataccgaatacgttctttttgtcgcatggcagagggaagaaagggaggctcttcggag

SEQ ID NO: 58 - DNA, 225 bp, Unknown
  Ascusbbf_6012, encodes 16S rRNA
agagtttgatcctggctcagattgaacgctggcggcaggcctaatacatgcaagtcgaacggcagcagggggagtgcttgcacttcccgctggcgagtggcggacgggtgagtagtgcctgggaagctgcctggcagagggggacaacagctggaaacggctgctgataccgcatattaccccgagggggaaaggagagatccgctgccggatgcgcccaggcgg

SEQ ID NO: 59 - DNA, 225 bp, Unknown
  Ascusbbf_2297, encodes 16S rRNA
agagtttgatcatggctcagaacgaacgctggcggcgcgtcttaagcatgcaagtcgagcggtaagttggaagcttgcttctaacctagagcggcggactggtgagtaacgcgtgggtgacgtacctctgtgacggggacagctcctagaaataggagataataccggatacgctgcatgttgtcagaggacatgcaggaaaggatcttttgattcgcacagaga

SEQ ID NO: 60 - DNA, 225 bp, Unknown
  Ascusbbf_9540, encodes 16S rRNA
agagtttgatcctggctcaggatgaacgctagctacaggcttaacacatgcaagtcgaggggcagcatggagtcagcttgctgactttgatggcgaccggcgcacgggtgcgtaacacgtatccaatctacccatggctctgggatagcctttcgaaagaaagattaataccggatggccttacggagagacatctctctgtaagtaaagatttatcggcgatgg

SEQ ID NO: 61 - DNA, 225 bp, Unknown
  Ascusbbf_873, encodes 16S rRNA
agagtttgatcctggctcaggacgaacgctggcggcgtgcttaacacatgcaagtcgaacgagaatctgtggatcgaggattcgtccaagtgaagcagaggacagtggcggacgggtgagtaacgcgtgaggaacctgcctttcagagggggacaacagttggaaacgactgctaataccgcatgacacattcgagcggcatcgcttgaatgtcaaagatttatc

SEQ ID NO: 62 - DNA, 225 bp, Unknown
  Ascusbbf_87102, encodes 16S rRNA
agagtttgatcctggctcaggatgaacgctagcgacaggcttaacacatgcaagtcgaggggcagcatgggaggtggcaacaccacccgatggcgaccggcgcactggtgagtaacacgtatgcgacctgcccccttcaggggaataacccggagaaatccggcctaatgccccatagtccgcggggactcattgccctgcggggaaaggtgagccggaagggga

SEQ ID NO: 63 - DNA, 225 bp, Unknown
  Ascusbbf_77105, encodes 16S rRNA
agagtttgatcatggctcagattgaacgctggcggcaggcctaacacatgcaagtcgagcggaagaagggagcttgctcccggattcagcggcggacgggtgagtaatgcctgggaatctgcctggtagtgggggataacgtccggaaacgggcgctaataccgcatacgtcctacgggagaaagcaggggatcttcggaccttgcgctatcagatgagcccagg

SEQ ID NO: 64 - DNA, 225 bp, Unknown
  Ascusbbf_269, encodes 16S rRNA
agagtttgatcctggctcaggacgaacgctggcggcgtgcttaacacatgcaagtcgaacggaaaggccccgctcgcggggtactcgagtggcgaacgggtgagtaacacgtgggtgatctgccctgcacttcgggataagcctgggaaactgggtctaataccggatatgacctccctttagtgtggggggtggaaagatttatcggtgcaggatgagcccgcg

SEQ ID NO: 65 - DNA, 225 bp, Unknown
  Ascusbbf_41015, encodes 16S rRNA
agagtttgatcctggctcaggatgaacgctggcggcgtgcttaacacatgcaagtcgaacgattaacccatcttcggatggttataaagtggcgaacgggtgagtaacacgtgaccaacctgcctttcacattgggataactaagggaaactgtagctaataccaaatactccggcacctccgcatggtagtgccgggaaagctccggcggtgaaagatggggtc

SEQ ID NO: 66 - DNA, 225 bp, Unknown
  Ascusbbf_32877, encodes 16S rRNA
agagtttgatcctggctcaggacgaacgctggcggcgtgcttaacacatgcaagtcgaacggagaactttcttcggaatgttcttagtggcgaacgggtgagtaacgcgtaggcaacctgccctctggttggggacaacattccgaaagggatgctaataccgaatgtgatccttctttcgcatgaaggaaggatgaaagatggcctctacttgtaagctatcgc

SEQ ID NO: 67 - DNA, 225 bp, Unknown
  Ascusbbf_57294, encodes 16S rRNA
agagtttgatcctggctcaggatgaacgctggcggcgtgcttaacacatgcaagtcgagcgaagcacttaagtctgattcttcggatgaagacttttgtgactgagcggcggacgggtgagtaacgcgtgggtaacctgcctcatacagggggataacagttagaaatgactgctaataccgcataagaccacggtaccgcatggtacagtggtaaaaactccgg

SEQ ID NO: 68 - DNA, 225 bp, Unknown
  Ascusbbf_27932, encodes 16S rRNA
agagtttgatcatggctcaggatgaacgctggcggcgtgcctaacacatgcaagtcgaacgaagtttgtttctacccgacggattatcttcggataagaagtcatttgaaacgcttagtggcggacgggtgagtaacgcgtgggcaacctgccctgcacagggggatagcagttggaaacgactggtaataccgcatatattgcatttgccgcatgacagatgca

SEQ ID NO: 69 - DNA, 225 bp, Unknown
  Ascusbbf_22558, encodes 16S rRNA
agagtttgatcatggctcaggacgaacgctggcggcgtgcttaacacatgcaagtcgaacggggcgaagaagagcttgctctttggagcctagtggcaaacgggtgagtaacgcgtaggcaacctgcccttcagatggggacaacacctcgaaaggggtgctaataccgaatgacgtatgctggtcgcatgaccggcataccaaaggccgggcaaccggtcactg

SEQ ID NO: 70 - DNA, 225 bp, Unknown
  Ascusbbf_983757, encodes 16S rRNA
agagtttgatcctggctcaggatgaacgctagctacaggcttaacacatgcaagtcgaggggcagcatgagggtagcaatacctttgatggcgaccggcgcacgggtgcgtaacacgtatccaatctacccatggctcgggaatagcctttcgaaagaaagattaatgcccgatggtctgcgattgagacatctcgattacagtaaagatttatcggcgatggat

SEQ ID NO: 71 - DNA, 225 bp, Unknown
  Ascusbbf_52330, encodes 16S rRNA
agagtttgatcatggctcaggatgaacgctggcggcgtgcctaacacatgcaagtcgaacggaaattactgattgaagctttcgggcggatttcagtaattttagtggcggacgggtgagtaacacgtgggtaacctgccctgtaccgggggataacagttggaaacggctgttaataccgcataagcgcacagctccgcatggagcagtgtgaaaaactccggt

SEQ ID NO: 72 - DNA, 225 bp, Unknown
  Ascusbbf_88445, encodes 16S rRNA
agagtttgatcctggctcaggatgaacgctggcggcatgcctaagacatgcaagtcgaacgagacggcccaatgaagtggagtgcttgcacaaagcggacttggatcaccgtctagtggcgcaagggtgagtaacgcgtaggtaatctgccttcgagtctggaataacagttagaaatgattgctaatgccggattatatatagaatgatacgtctatctatatt

SEQ ID NO: 73 - DNA, 225 bp, Unknown
  Ascusbbf_4111, encodes 16S rRNA
agagtttgatcatggctcaggacgaacgctggcggcgtgcttaacacatgcaagtcgaacgatgaagccgcttcggtggtggattagtggcgaacgggtgagtaacacgtgggcaatctgccctgcactctgggacaagccctggaaacggggtctaataccggatatgacacgggatcgcatggtctccgtgtggaaagctccggcggtgcaggatgagcccgc

SEQ ID NO: 74 - DNA, 225 bp, Unknown
  Ascusbbf_1085, encodes 16S rRNA
agagtttgatcctggctcaggatgaacgctggcggcgtgcttaacacatgcaagtcgagcgaagcgcagaaacggatttcttcggattgaaggttctgtgactgagcggcggacgggtgagtaacgcgtggggaacctgccctgtaccgggggataacagacagaaatgtctgctaataccgcataagcgcacgagaaggcatcttcttgtgtgaaaaactccgg

SEQ ID NO: 75 - DNA, 225 bp, Unknown
  Ascusbbf_154, encodes 16S rRNA
agagtttgatcatggctcagattgaacgctggcggcaggcctaatacatgcaagtcgaacggtaacataggaaaagcttgcttttcctgatgacgagtggcggacgggtgagtaaagtttgggaagctacctgatagagggggacaacagttggaaacgactgctaataccgcatacagcctgagggtgaaagcagcaatgcgctatcagatgcgcccaaatggg

SEQ ID NO: 76 - DNA, 225 bp, Unknown
  Ascusbbf_1010, encodes 16S rRNA
agagtttgatcctggctcaggacgaacgctggcggcgtgcttaacacatgcaagtcgaacgagacgatttagaagcttgcttttattgagtcgagtggcaaacgggtgagtaacgcgtagacaacctgccgcaaagatggggacaacagtccgaaaggactgctaataccgaatgttgtatctcctccgcatggaagagatattaaagatggcctctacttgtaa

SEQ ID NO: 77 - DNA, 225 bp, Unknown
  Ascusbbf_5575, encodes 16S rRNA
agagtttgatcctggctcaggacgaacgctggcggcgtgcttaacacatgcaagtcgaacgagaagagatgagaagcttgcttcttatcgattcgagtggcaaacgggtgagtaacgcgtaagcaacctgccctctagatggggacaacagctggaaacggctgctaataccgaatacgttctttctgtcgcatggcagagggaagaaagggaggctcttcggag

SEQ ID NO: 78 - DNA, 225 bp, Unknown
  Ascusbbf_775, encodes 16S rRNA
agagtttgatcctggctcaggatgaacgctagcgacaggcctaacacatgcaagtcgaggggcagcgcgggagaagcttgcttttcctggcggcgaccggcgcacgggtgcgtaacaggtgtgcaatctgtcctataccggggcatagcccagcgaaagttggattaattctccatgtgagcgagtgccgcatgacacacgcttgaaacgtaagggtatagggtg

SEQ ID NO: 79 - DNA, 225 bp, Unknown
  Ascusbbf_19348, encodes 16S rRNA
agagtttgatcctggctcaggatgaacgctggcggcgtgcctaacacatgcaagtcgaacggagtttactcgctgaagcggcttcggccaattcttgagtaaacttagtggcggacgggtgagtaacgcgtgggcaacctgcctcatactgggggatagcagttggaaacgactgataataccgcataagcgcacagtatcgcatgatacagtgtgaaaaactcc

SEQ ID NO: 80 - DNA, 225 bp, Unknown
  Ascusbbf_24302, encodes 16S rRNA
agagtttgatcatggctcaggacgaacgctggcggcgtgcttaacacatgcaagtcgagcgatgaagctccttcgggagcggattagcggcggacgggtgagtaacacgtgggtaacctgcctcatagaggggaatagcctttcgaaaggaagattaataccgcataagattgtagtgccgcatggcatagcaattaaaggagtaatccgctatgagatggaccc

SEQ ID NO: 81 - DNA, 225 bp, Unknown
  Ascusbbf_1, encodes 16S rRNA
agagtttgatcctggctcagattgaacgctggcggcaggcctaatacatgcaagtcgaacggtaacataagaaaagcttgcttttcttgatgacgagtggcggacgggtgagtaacatttgggaaactacctgatagagggggacaacagttggaaacgactgctaataccgcatacagcctaagggtgaaagaagcaattcgctatcagatgtgcccaaacggg

SEQ ID NO: 82 - DNA, 225 bp, Unknown
  Ascusbbf_52548, encodes 16S rRNA
agagtttgatcatggctcaggatgaacgctggcggcgtgcttaacacatgcaagtcgaacgaagcgcattgtttgaattcttcggaaggaagataatgtgactgagtggcggacgggtgagtaacgcgtgggtaacctgccatgtacagggggacaacagttggaaacggctgctaataccgcataagcgcacgagattgcatgatctagtgtgaaaaactccgg

SEQ ID NO: 83 - DNA, 225 bp, Unknown
  Ascusbbf_50658, encodes 16S rRNA
agagtttgatcatggctcaggacgaacgctggcggcgtgcctaacacatgcaagtcgagcggagacatacagcggataggaagttttcggatggaattgaagaagtatgttttagcggcggacgggtgagtaacgcgtgagcaatctgtccttcacagggggataacacagcgaaagttgtactaataccgcataagaccacggtgttgcatgacacaggggtca

SEQ ID NO: 84 - DNA, 225 bp, Unknown
  Ascusbbf_850, encodes 16S rRNA
agagtttgatcctggctcaggataaacgctggcggcgtgcttaacacatgcaagtcgaacgaggaacagaagatgaggtcttcggattaaattgactgttccgagtggcggacgggtgagtaacgcgtggggaacctgccttatactgagggacaacagctggaaacggctgctaatacctcatatgcgcacaggaaggcatcttccggtgtggaaagaaattcg

SEQ ID NO: 85 - DNA, 225 bp, Unknown
  Ascusbbf_25259, encodes 16S rRNA
agagtttgatcctggctcaggatgaacgctagcgacaggcctaacacatgcaagtcgagcggcagcacctcgggtggcgagcggcgcacgggtgagtaacgcgtatgtaacctacccatgagtgggggatagcccagcgaaagctggattaataccgcatgatactgattgaaggcatcggatatcagttaaagatttattgctcatggatggacatgcgtccga

SEQ ID NO: 86 - DNA, 225 bp, Unknown
  Ascusbbf_4, encodes 16S rRNA
agagtttgatcctggctcaggatgaacgctagctacaggcttaacacatgcaagtcgaggggaaacgacatagagtgcttgcactttatgggcgtcgaccggcgaatgggtgagtaacgcgtatccaacctgcccttgaccgagggatagcccagtgaaaactgaattaatacctcatgttctcctcagacggcatcagacgaggagcaaagattaatcggtcaa

SEQ ID NO: 87 - DNA, 225 bp, Unknown
  Ascusbbf_5131, encodes 16S rRNA
agagtttgatcctggctcaggatgaacgctagctacaggcttaacacatgcaagtcgaggggcagcattaagtcagcttgctgatttagatggcgaccggcgcacgggtgagtaacgcgtatccaacctgccccctacccggggatagccttgcgaaagtaagattaatacccggtgcagttatgattccgcatgggaatataacgaaagattcatcggtagggg

SEQ ID NO: 88 - DNA, 225 bp, Unknown
  Ascusbbf_8600, encodes 16S rRNA
agagtttgatcatggctcaggacgaacgctggcggcgtgcctaacacatgcaagtcgaacggagctaaagagcttgctttttagcttagtggcggacgggtgagtaatgcgtgagcaacctgcctgtcagtgggggataacttccggaaacggacgctaataccgcatatagtacataatccgcatggataagtgtatgaaaggagcaatccgctgatagatggg

SEQ ID NO: 89 - DNA, 225 bp, Unknown
  Ascusbbf_1273, encodes 16S rRNA
agagtttgatcatggctcaggatgaacgctggcggcgtgcttaacacatgcaagttgggcggtttctttcgaatgagacttcggtggattttggaagagatagcagcggacgggtgagtaaagcacaaggacgtgccctgaggcgggggacaactacgggaaaccgtagctaataccccgtaagccgagaggtgaaagcagcaatgcgccgaaggagcgacttgt

SEQ ID NO: 90 - DNA, 225 bp, Unknown
  Ascusbbf_39159, encodes 16S rRNA
agagtttgatcatggctcaggacgaacgctggcggcacgcttaacacatgcaagtcgaacggagataatttgagtttacttagattatcttagtggcggacgggtgagtaacacgtgagcaacctacctttgagagagggatagcttctggaaacggatggtaatacctcataacgtagttttaccgcatgataggactaccaaagatttatcactcaaagatgg

SEQ ID NO: 91 - DNA, 225 bp, Unknown
  Ascusbbf_9751, encodes 16S rRNA
agagtttgatcatggctcaggatgaacgctggcggcgtgcctaacacatgcaagtcgaacggggtaaggacaccggatgaagattcgtcagattccaccgtccttacttagtggcggacgggtgagtaacgcgtgggcaacctgccctgtacaggggaatagcagctggaaacggctggtaaaaccgcatatgcgcgcagtaccgcatggtacagcgcggaaaac

SEQ ID NO: 92 - DNA, 225 bp, Unknown
  Ascusbbf_318, encodes 16S rRNA
agagtttgatcatggctcagattgaacgctggcggcaggcttaatacatgcaagtcgaacggtaacagcaggaagcttgcttcctggctgacgagtggcggacgggtgagtaatacctggggagctgcctgaatgagggggacaacacctggaaacgggtgctaataccgcgtaagccctgagggggaaaggctgggcaaccagtcgcattcagatgcgcccagg

SEQ ID NO: 93 - DNA, 225 bp, Unknown
  Ascusbbf_7046, encodes 16S rRNA
agagtttgatcatggctcaggacgaacgctggcggcgtgcttaacacatgcaagtcgagcggtaaggccccttcgggggtacacgagcggcgaacgggtgagtaacacgtgagtaacctgcccctgactctgggataagcctgggaaactgggtctaataccggatatgacctcgtgccgcatggtgtggggtggaaaggtgtttttccggtcagggatgggctc

SEQ ID NO: 94 - DNA, 225 bp, Unknown
  Ascusbbf_25993, encodes 16S rRNA
agagtttgatcatggctcaggatgaacgctggcggcgtgcctaacacatgcaagtcgaacgaagcatatttggcagagattcgtcgaagccggatatgacttagtggcggacgggtgagtaatgtatgagcaacctgcctttcagagggggacaacagttggaaacgactgctaataccgcataatgtatggaggggacatccccatcataccaaaggagcaatc

SEQ ID NO: 95 - DNA, 225 bp, Unknown; identical to SEQ ID NO: 43
  Ascusbbf_7027, encodes 16S rRNA

SEQ ID NO: 96 - DNA, 225 bp, Unknown
  Ascusbbf_1372985, encodes 16S rRNA
agagtttgatcatggctcaggatgaacgctagcggcaggcttaacacatgcaagtcgaggggcatcgcggggtagcaataccctggcggcgaccggcgaaagggtgcgtaacgcgtgagcgacatgcccgtcacagggggacaaccggcggaaacgccgcctaataccccatatgaggccaggccacatggccgggccttgaaagtcaaggcggtgacggattgg

SEQ ID NO: 97 - DNA, 225 bp, Unknown
  Ascusbbf_23253, encodes 16S rRNA
agagtttgatcctggctcaggatgaacgctagcggcaggcttaacacatgcaagtcgaggggcatcgcggtgtagcaatacactggcggcgaccggcgtaagggtgcgtaacgcgtgagcaacatgcccgtcacagggggataatccatggaaacgtggtctaacaccgcatagataaaccggtatggcatcatactgtttagaaattttgattaaggtgacgga

SEQ ID NO: 98 - DNA, 225 bp, Unknown
  Ascusbbf_121971, encodes 16S rRNA
agagtttgatcctggctcaggatgaacgctagcggcaggcttaacacatgcaagtcgaggggcaacgcggtgtagcaatacactggcggcgaccggcggaagggtgcgtaacgcgtgagcaacatgcccgtcacagggggataatccatggaaacgtggtctaacaccgcatagattatagggaggacatcctctttataagaaattcgcaagaaggtgacggat

SEQ ID NO: 99 - DNA, 225 bp, Unknown
  Ascusbbf_5251, encodes 16S rRNA
agagtttgatcatggctcagaacgaacgctggcggcgcgtcttaagcatgcaagtcgagcggtaagattggtgcttgcactaatcctagagcggcggactggtgagtaacgcgtgggtgacgtacctctgtgacggggacagctcctagaaataggagataataccggatacgctgtgtgcagtcagagtgcacacaggaaaggatcttttgattcgcacagaga

SEQ ID NO: 100 - DNA, 225 bp, Unknown
  Ascusbbf_6716, encodes 16S rRNA
agagtttgatcctggctcaggacgaacgctggcggcgtgcttaacacatgcaagtcgaacggatcatctttacttcggttttggtggttagtggcgaacgggtgagtaacacgtgagcaacctgcccttcactgggggataactgtgggaaacttcagctaataccgcatgtacaccttccgtcgcatggtggttggtggaaagttttttcggtgggggatgggc

SEQ ID NO: 101 - DNA, 490 bp, Unknown
  Ascusbbf_100, encodes 16S rRNA
agagtttgatcctggctcaggatgaacgctagctacaggcttaacacatgcaagtcgaggggaaacgatgagagagcttgctctctcaggcgtcgaccggcgcacgggtgagtaacacgtatccaacctgcctttttccagggaataaccttgcgaaagtaagactaatgccctatgtgtcctttgacggcatcagacgaggacgaaagattcatcggaaagggatggggatgcgcctgattaggcagttggcggggcaacggcccaccaaaccgacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttgtacggggataaagtgagtcacgtgtggcttattgcaggtaccgtacgaata

SEQ ID NO: 102 - DNA, 490 bp, Unknown
  Ascusbbf_20584, encodes 16S rRNA
agagtttgatcctggctcaggatgaacgctggcggcgtgcctaatacatgcaagtcgaacgaggtgtagcaatacaccgagtggcgaacgggtgagtaacacgtaggtaacctgcccctaagtctgggatacccaggggaaaccttggctaataccggatagcggcggaggggacatcccttccgcacgaaagtcgcgtttgcgacgctttcggatggacctgcggcacattagctagttggcggggcaacggcccaccaaggcgaggatgtgtagccgacctgagagggtgaacggccacaatggaactgagacacggtccatactcctacgggaggcagcagtagggagttttcggcaatgggcgaaagcctgaccgagcaacgccgcgtgagtgagaaggtcttcggattgtaaagctctgttacgagggacgaacggtggggtcaggaaatgggccccaattgacggtacctcgccagaaagtgac

SEQ ID NO: 103 - DNA, 490 bp, Unknown
  Ascusbbf_4317, encodes 16S rRNA
agagtttgatcctggctcaggatgaacgctagctacaggcttaacacatgcaagtcgaggggcatcatggagattgcttgcaatctttgatggcgaccggcgcacgggtgagtaacgcgtatccaacctgcctgcaagtagggaatagcccggagaaatccggattaatgccctatgtggcccttagatgacatctgaagagggttaaagatttatcgcttgcggatggggatgcgtccgattaggcagacggcggggtaacggcccaccgtgccatcgatcggtaggggttctgagaggaaggtcccccacactggtactgagacacggaccagactcctacgggaggcagcagtgaggaatattggtcaatggtcgtaagactgaaccagccaagtagcgtgcaggatgacggccctacgggttgtaaactgcttttatagggggataatatgcgggacgtgtcctgtattgcaggtaccctatgaat

SEQ ID NO: 104 - DNA, 490 bp, Unknown
  Ascusbbf_6, encodes 16S rRNA
agagtttgatcctggctcaggatgaacgctagctacaggcttaacacatgcaagtcgaggggtaacgacagcgaaagcttgcttttgctgggcgacgaccggcgaatgggtgagtaacgcgtatccaacctgccgcaaagtagggcacagccttgcgaaagtaagattaatgccctatgtgctgtgatgatgacatcagaattgcagtaaaggttcaccgctttgcgatggggatgcgtctgattaggttgttggcggggtaacggcccaccaagcccgcgatcagtaggggttctgagaggaaggtcccccacattggaactgagacacggtccaaactcctacgggaggcagcagtgaggaatattggtcaatgggcgagagcctgaaccagccaagtagcgtgcgggacgaaggccctatgggttgtaaaccgcttttacggggggataaagtgagtgacgtgtcattcattgcaggtaccccgcga

SEQ ID NO: 105 - DNA, 490 bp, Unknown
  Ascusbbf_19022, encodes 16S rRNA
agagtttgatcctggctcaggatgaacgctggcggcgtgcctaatacatgcaagtcgagcgagaaattaagaagaagcgttttcgaacaattcatcttaatggaaagcggcggacgggtgagtaacgcgtaggcaacctgcccttagcagagggatagccattggaaacgatgattaaaacctcataacgctgagataacacatgttatctttgccaaagatttatcggctaaggatgggcctgcgtctgattaactagttggtgaggtaacggctcaccaaggtgacgatcagtagccgacctgagagggtgatcggccacattggaactgagacacggtccaaacttctacggaaggcagcagtaaggaatcttgcacaatgggggaaaccctgatgcagcaacgccgcgtgaacgatgaaggccttcgggttgtaaagttctgatctgagggaagaaaaaaatgacggtacctcaggagaaagcccc

SEQ ID NO: 106 - DNA, 490 bp, Unknown
  Ascusbbf_2624, encodes 16S rRNA
agagtttgatcatggctcaggatgaacgctggcggcgtgcttaacacatgcaagtcgaacgaagcaatttatcacgatcccttcggggtgacgatttattgactgagtggcggacgggtgagtaacgcgtgggtaacctaccttgtacagggggataacagttggaaacgactgctaataccgcataagcgcacagcttcgcatgaagcagtgtgaaaagtttttcggtataagatggacccgcgtctgattagctagttggtgaggtaacggcccaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggct

SEQ ID NO: 107 - DNA, 490 bp, Unknown
  Ascusbbf_3427, encodes 16S rRNA
agagtttgatcatggctcaggatgaacgctagcggcaggcttaacacatgcaagtcgaggggtaacaggggatgtagcaatacatcctgctgacgaccggcgcacgggtgcgtaacgcgtatgcaacctgcccgcaacaggggtataacggagtgaaaattccactaatcccccatattgtcattaggccgcatggctttatgacgaaaggttttttctggttgcggatgggcatgcgtgacattaggtagttggcggggtaacggcccaccaagccgacgatgtctaggggagctgagaggcttatcccccacactggtactgagacacggaccagactcctacgggaggcagcagtgaggaatattggtcaatgggcggaagcctgaaccagccatgccgcgtggaggaagaaggtcctatgggttgtaaactccttttgtaccggagtaataaggtctttgcgaaggccgatgagagtacggtacga

SEQ ID NO: 108 - DNA, 490 bp, Unknown
  Ascusbbf_5005, encodes 16S rRNA
agagtttgatcctggctcaggatgaacgctagctacaggcttaacacatgcaagtcgaggggcagcattgagatagcttgctatttcagatggcgaccggcgcacgggtgagtaacgcgtatccaacctggcccgtagtagggaacagcccggcgaaagtcggattaatgccctatgttctccgacgaagacatctgagttggagcaaagattcatcgctacgggatggggatgcgtctgattaggtagtaggcggggtaacggcccacctagccaacgatcagtaggggttctgagaggaaggtcccccacattggtactgagacacggaccaaactcctacgggaggcagcagtgaggaatattggtcaatgggcgagagcctgaaccagccaagtagcgtgcaggacgactgccctatgggttgtaaactgcttttatgcggggataaagtgaggcatgtatgcctttttgcaggtaccgcatgaat

SEQ ID NO: 109 - DNA, 490 bp, Unknown
  Ascusbbf_69, encodes 16S rRNA
agagtttgatcctggctcaggatgaacgctagctacaggcttaacacatgcaagtcgaggggcagcatgatcgaagcttgctttgattgatggcgaccggcgcacgggtgagtaacgcgtatccaaccttccctatagtagagaatagcccggcgaaagtcggattaatgctctatgttgtatttagaagacatctgaagaataccaaaggtttaccgctataggatggggatgcgtctgattaggtagtaggcggggtaacggcccacctagccgacgatcagtaggggttctgagaggaaggtcccccacattggaactgagacacggtccaaactcctacgggaggcagcagtgaggaatattggtcaatggacggaagtctgaaccagccaagtagcgtgcaggatgacggccctatgggttgtaaactgcttttatatagggataaagtcggggacgtgtccccgtttgtaggtactatatgaat

SEQ ID NO: 110 - DNA, 490 bp, Unknown
  Ascusbbf_8082, encodes 16S rRNA
agagtttgatcctggctcaggacgaacgctggcggcgtgcttaacacatgcaagtcgaacggggaattctgcttcggtggaattcctagtggcgaacgggtgagtaacgcgtaggcaacctgcccttcagacggggacaacatcccgaaaggggtgctaataccggatacgaagctcctgccgcatgacgggagcttgaaaggcgcaaacaagcgccgctgagggatgggcctgcgtccgattagcttgttggtggggtaacggcccaccaaggcgacgatcggtagccggtctgagaggatgaacggccacattgggactgagacacggcccagactcctacgggaggcagcagtggggaatcttccgcaatgggcgaaagcctgacggagcaacgccgcgtgagtgaagaagttcttcggaacgtaaagctctgttgttcacgacgaacggggggaccaggaaatgggtttccagtgacggtagtgaa

SEQ ID NO: 111 - DNA, 490 bp, Unknown
  Ascusbbf_95, encodes 16S rRNA
agagtttgatcctggctcaggatgaacgctagctacaggcttaacacatgcaagtcgaggggcagcgagaaggaagcttgctttctttgtcggcgaccggcgcacgggtgagtaacgcgtatccaaccttccccttagtagggcatagcccggcgaaagtcggattaacaccctatgttatccgaagaggacatctgaattggattaaaggtttaccgctaagggatggggatgcgtctgattaggtagtaggcggggtaacggcccacctagccgacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttatacggggataaagtgagggacgtgtccctttttgtaggtaccgtatgaat

SEQ ID NO: 112 - DNA, 490 bp, Unknown
  Ascusbbf_1136, encodes 16S rRNA
agagtttgatcctggctcaggatgaacgctggcggcgtgcctaacacatgcaagtcgaacggtgtaatgattgaagttttcggacagatttcattacatagtggcggacgggtgagtaacgcgtggagaacctgcactgtactgggggatagcagctggaaacggctggtaataccgcatgagaccacgggagggcatcctcctgaggcaaaagatttatcggtacaggatggatccgcgtttgattagccagttggcggggtaacggcccaccaaagcgacgatcaatagccggcctgagagggcggacggccacattgggactgagacacggcccagactcctacgggaggcagcagtgggggatattgcacaatggacgaaagtctgatgcagcgacgccgcgtgagtgaagaagtatttcggtatgtaaagctctatcagcagggaagaaaggctccggaaggagagatgacggtacctgagtaag

SEQ ID NO: 113 - DNA, 490 bp, Unknown
  Ascusbbf_2770, encodes 16S rRNA
agagtttgatcctggctcaggataaacgccggcggcgtgcctaatacatgcaagtcgaacgaggctcttcggagccgagtggcgtacgggtgagtaacacgttggtaacctgccctccagaccggaataccagagagaaatctctgctaatgccggatgacgtcatatggtcgcaagaccacttgaccaaaggcggcaactgccgcgctgaaggatggacctgcgtcgcattagctagttggcgggataatggcccaccaaggcgaggatgcgtagccgagctgagaggctaaacggccacattgggactgagacacggcccagactcctacgggaggcagcagtagggagtatttggcaatgggggaaaccctgaccgagcaacgccgcgtgtgtgatgaaggccttcgggtcgtaaaacactgtgattctctgggaaactcatggggagtggaaagcctcatgactgaccggactattagaaagcaac

SEQ ID NO: 114 - DNA, 490 bp, Unknown
  Ascusbbf_1629, encodes 16S rRNA
agagtttgatcatggctcaggatgaacgctggcggcgtgcctaatacatgcaagtcgagcgaaccacttcggtggtgagcggcgaacgggtgagtaacacgtaggtgatctgcccatcagacggggacaacgattggaaacgatcgctaataccggataggacgaaagtttaaaggtgctcctggcaccgctgatggatgagcctgcggcgcattagctagttggtagggtaaaggcctaccaaggcgacgatgcgtagccgacctgagagggtgaacggccacactgggactgagacacggcccagactcctacgggaggcagcagtagggaatcttcggcaatgggcgaaagcctgaccgagcaacgccgcgtgaatgatgaaggccttcgggttgtaaaattctgttataagggaagaacgactttagtaggaaatggctaaagtgtgacggtaccttatgagaaagccacggctaactacgtgcca

SEQ ID NO: 115 - DNA, 490 bp, Unknown
  Ascusbbf_1821, encodes 16S rRNA
agagtttgatcctggctcaggatgaacgctagctacaggcttaacacatgcaagtcgaggggcagcacggagactgcttgcagtctctggtggcgaccggcggatgggtgagtaacgcgtatccaacctgcccgtgacccggggacagccttccgaaaggaagattaatacccgatgttccggcgtgcgcgcatgcgctgcgccggcaaagtttttctgcggtgacggatggggatgcgtctgattaggcagcaggcggggtaacggcccacctggccatcgatcagtaggggttctgagaggaaggtcccccacattggaactgagacacggtccaaactcctacgggaggcagcagtgaggaatattggtcaatgggcgcaagcctgaaccagccaagtagcgtgcaggatgacggccctacgggttgtaaactgcttttgcgcgggagcaaagaggggcacgtgtgccccgttgcgcgtaccgcgtg

SEQ ID NO: 116 - DNA, 490 bp, Unknown
  Ascusbbf_56782, encodes 16S rRNA
agagtttgatcatggctcaggatgaacgctagctacaggcttaacacatgcaagtcgaggggcagcatgatcaaagcttgctttgattgatggcgaccggcgcacgggtgagtaacgcgtatccaaccttccctatagtagtggatagcccggcgaaagtcggattaatacactatgttgtatttagaggacatctgaagaataccaaaggcttgccgctataggatggggatgcgtctgattagatagtaggcggggtaacggcccacctagtcgacgatcagtaggggttctgagaggaaggtcccccacattggaactgagacacggtccaaactcctacgggaggcagcagtgaggaatattggtcaatggacgggagtctgaaccagccaagtagcgtgcaggatgacggccctatgggttgtaaactgcttttatcgggggataaagtcacccacgtgtgggtgtttgtaggtacccgatgaat

SEQ ID NO: 117 - DNA, 490 bp, Unknown
  Ascusbbf_92, encodes 16S rRNA
agagtttgatcctggctcaggatgaacgctggcggcgcgcctaacacatgcaagtcgaacggccggacccacctcggtgggcgaggcagtggcgaacggctgagtaacacgtgggcaacctgcccccctccccgggacagcctcgggaaaccgtgggtaataccggatactccgccccctccgcatgggaggggcgggaaagctccggcggggggggatgggcccgcggcctgttagctagttggcggggcaacggcccaccaaggcgactatgggtagctgggttgagagaccgaccagccagattgggactgagacacggcccagactcctacgggaggcagcagtggggaatcttgcgcaatgggcggaagcctgacgcagcgacgccgcgtgcgggaggaaggccctcgggtcgtaaaccgctttcagcagggacgaggccgcaaggtgacggtacctgcagaagaagccccggctaactacgtgc

SEQ ID NO: 118 - DNA, 490 bp, Unknown
  Ascusbbf_118, encodes 16S rRNA
agagtttgatcctggctcaggatgaacgctagctacaggcttaacacatgcaagtcgaggggcagcatgatttgtgcttgcacagattgatggcgaccggcgcacgggtgagtaacgcgtatccaaccttccctatagtagaggatagcccggcgaaagtcggattaatactctatgttattcaatgcggacatctaagttgaatcaaagattaatcgctataggatggggatgcgtctgattaggttgttggcggggtaacggcccaccaagcctacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttatacggggataaagtgagggacgtgtcccttattgtaggtaccgtatgaat

SEQ ID NO: 119 - DNA, 230 bp, Unknown
  Ascusbbf_5429, encodes 16S rRNA
agagtttgatcctggctcagattgaacgctggcggcaggcttaacacatgcaagtcgtacggtaacagagggaagcttgcttctctgctgacgagtggcggacgggtgagtaatgtctgggaagctgcctgcttgagggggatagcggagcgaaagttccgataataccgcgtaagcccgagaggggaaagtgcgggaccgcaaggccgcacgccagcagccgcggtaat

SEQ ID NO: 120 - DNA, 490 bp, Unknown
  Ascusbbf_3, encodes 16S rRNA
agagtttgatcctggctcagattgaacgctggcggcaggcttaacacatgcaagtcgtacggtaacagagggaagcttgcttctctgctgacgagtggcggacgggtgagtaatgtctgggaagctgcctgcttgagggggatagcggagcgaaagttccgataataccgcgtaagcccgagaggggaaagtgcgggaccgcaaggccgcacgcgagcagatgcgcccagatgggattaggcagttggggaggtaacggctcaccaaaccgatgatctctagctggtttgagaggacaatcagccacattggaattgagaaacggaccaaactcctacgggaggcagcagtggggaatattgcacaatgggggaaaccctgatgcagccatgccgcgtgtgtgaagaaggccttcgggttgtaaagcacttttgcattcgaggaagacagcacgtaaataaacgtgttatttgacgttagagtgtgaata

SEQ ID NO: 121 - DNA, 490 bp, Unknown
  Ascusbbf_10576, encodes 16S rRNA
agagtttgatcctggctcaggatgaacgctagctacaggcttaacacatgcaagtcgaggggcagcatgacgatagcttgctattgtcgatggcgaccggcgcacgggtgagtaacgcgtatccaaccttccccatagtagggcatagcccgtagaaatgcggattaataccctatgttttccgaagcagacatctaatttggaacaaaggttcaccgctatgggatggggatgcgtctgattaggttgttggcggggtaacggcccaccaagccatcgatcagtaggggttctgagaggaaggtcccccacattggaactgagacacggtccaaactcctacgggaggcagcagtgaggaatattggtcaatgggcgagagcctgaaccagccaagtagcgtgcaggaagacggccctatgggttgtaaactgcttttatgcggggataaagttggctacgtgtagccatttgcaggtaccgcatgaat

SEQ ID NO: 122 - DNA, 490 bp, Unknown
  Ascusbbf_729, encodes 16S rRNA
agagtttgatcctggctcaggatgaacgctagctacaggcttaacacatgcaagtcgaggggcatcagggtctgtgcttgcacagattgctggcgaccggcgcacgggtgagtaacgcgtatccaaccttccccttagtagaggatagcccggcgaaagtcggattaatactctatgttgttcaatgcggacatctaagttgaaccaaaggtttaccgctaagggatggggatgcgtctgattaggtagtaggcggggtaacggcccacctagccaacgatcagtaggggttctgagaggaaggtcccccacattggaactgagacacggtccaaactcctacgggaggcagcagtgaggaatattggtcaatggacgagagtctgaaccagccaagtagcgtgcaggatgacggccctatgggttgtaaactgcttttatgcggggataaagtgagggacgtgtcccttattgtaggtaccgcatgaat

SEQ ID NO: 123 - DNA, 490 bp, Unknown
  Ascusbbf_201, encodes 16S rRNA
agagtttgatcctggctcaggatgaacgctagctacaggcttaacacatgcaagtcgaggggcagcatatagatagcttgctatttatgatggcgaccggcgcacgggtgagtaacgcgtatccaaccttccctatactagagaatagcccggcgaaagtcggattaatgctctatgttcttctttgatggcatctgacgagaagcaaaggtttaccggtataggatggggatgcgtctgattaggttgttggcggggtaacggcccaccaagcctacgatcagtaggggttctgagaggaaggtcccccacattggtactgagacacggaccaaactcctacgggaggcagcagtgaggaatattggtcaatgggcgagagcctgaaccagccaagtagcgtgcaggatgactgccctatgggttgtaaactgcttttataggggaataaagtgaggtatgcatacctttttgtatgtaccctatgaat

SEQ ID NO: 124 - DNA, 490 bp, Unknown
  Ascusbbf_416, encodes 16S rRNA
agagtttgatcctggctcaggatgaacgctagctacaggcttaacacatgcaagtcgaggggcatcatggagtttgcttgcaaactctgatggcgaccggcgcacgggtgagtaacgcgtatccaaccttccctatagtagaggatagcccggcgaaagtcggattaatactctatgttttccgttgcagacatctaagatggaacaaaggcttgccgctataggatggggatgcgtctgattaggtagtcggcggggtaacggcccaccgagccatcgatcagtaggggttctgagaggaaggtcccccacattggaactgagacacggtccaaactcctacgggaggcagcagtgaggaatattggtcaatgggcgcgagcctgaaccagccaagtagcgtgcaggacgacggccctatgggttgtaaactgcttttatgcggggataaagttcactacgtgtagtgttttgtaggtaccgcatgaat

SEQ ID NO: 125 - DNA, 490 bp, Unknown
  Ascusbbf_15806, encodes 16S rRNA
agagtttgatcctggctcaggatgaacgctagctacaggcttaacacatgcaagtcgaggggcagcatgatcttagcttgctaagattgatggcgaccggcgcacgggtgagtaacgcgtatccaaccttccctatagtagaggatagcccggcgaaagtcggattaatactctatgttttccgttgcagacatctaaaatggaacaaaggtttaccgctataggatggggatgcgtctgattaggttgttggcggggtaacggcccaccaagccttcgatcagtaggggttctgagaggaaggtcccccacattggaactgagacacggtccaaactcctacgggaggcagcagtgaggaatattggtcaatgggcgagagcctgaaccagccaagtagcgtgcaggaagacggccctatgggttgtaaactgcttttatacagggataaagtgtgccacgtgtggcgttttgtaggtactgtatgaat

SEQ ID NO: 126 - DNA, 490 bp, Unknown
  Ascusbbf_6115, encodes 16S rRNA
agagtttgatcctggctcaggatgaacgctggcggcgtgcctaacacatgcaagtcgaacggaaatgttttgatgaagatttcggttggattcatttcattttagtggcggacgggtgagtaacacgtgggtaacctgccctgtaccgggggataacacttagaaataggtgataataccgcataagcgcacactgacgcatgtcagagtgtgaaaaactccggtggtacaggatggacccgcgtctgattagcttgttggcggggtaacggcccaccaaggcgacgatcagtagccggcctgagagggtgaacggccacattgggactgagacacggcccagactcctacgggaggcagcagtgggggatattgcacaatgggggaaaccctgatgcagcgacgccgcgtgagtgatgaagtatttcggtatgtaaagctctatcagcagggaagataatgacggtacctgactaagaagccccggcta

SEQ ID NO: 127 - DNA, 490 bp, Unknown
  Ascusbbf_1325058, encodes 16S rRNA
agagtttgatcctggctcaggacgaacgctggcggcgtgcttaacacatgcaagtcgaacggggcgaagaagagcttgctcttcctagcctagtggcaaacgggtgagtaacgcgtaggcaacctgcccttcggatggggacaacatctcgaaaggaatgctaataccgaatgaagtgcattggccgcatggccgatgcaccaaaggccgggcaaccggtcactgaaggatgggcctgcgtctgattagctagttggtggggtaacggcccaccaaggcgacgatcagtagccggtctgagaggcggaacggccacattgggactgcgacacgaccaaaactcctacgggaggcagcagtggggaatcttccgcaatgggcgaaagcctgacggagcaacgccgcgtgagtgaagaaggttttcggatcgtaaagctctgttgtcagggacgagagacttgatcaggaagtgggtcaaggaggacggtac

SEQ ID NO: 128 - DNA, 490 bp, Unknown
  Ascusbbf_28350, encodes 16S rRNA
agagtttgatcctggctcaggatgaacgctagctacaggcttaacacatgcaagtcgcggggtaacgagaggaaagcttgctttccttgtcgacgaccggcgcacgggtgagtaacgcgtatccaacctgcccattaccacgggatagcccgtcgaaaggcggattaataccgtatgaacttcatggatggcatctgatatgaagtaaaggtttagcggtaatggatggggatgcgtccgattagatagttggtgaggcaacggctcaccaagtcgacgatcggtaggggttctgagaggaaggtcccccacattggaactgagacacggtccaaactcctacgggaggcagcagtgaggaatattggtcaatgggcgagagcctgaaccagccaagtagcgtgcaggacgacggccctatgggttgtaaactgcttttatctggggataaagtgcgggacgcgtcccgctttgcaggtaccagatgaat

SEQ ID NO: 129 - DNA, 490 bp, Unknown
  Ascusbbf_372, encodes 16S rRNA
agagtttgatcctggctcaggatgaacgctagcgacaggcttaacacatgcaagtcgaggggcagcgggcgagtggcaacacttgctgtcggcgaccggcgcactggtgagtaacacgtatgcaacctgcccccttctgggagataacccatagaaatgtggcctaatatcccatagtcggtccagccgcatggccgggccgggaaaggcgagccggaaggggatgggcatgcggcgcattagctagttggcggggcagaggcccaccaaggcgacgatgcgtaggggttctgagaggaaggtcccccacattggtactgagacacggaccaaactcctacgggaggcagcagtgaggaatattggtcaatgggcgggagcctgaaccagccaagtcgcgtgagggaggaaggtcctacggattgtaaacctctttagccggggagcaacgtgcgccacgtgtggcgcagtgagagtacccggagaataa

SEQ ID NO: 130 - DNA, 490 bp, Unknown
  Ascusbbf_667, encodes 16S rRNA
agagtttgatcctggctcaggacgaacgctggcggcatgcctaacacatgcaagtcgaacggagattatttcggtaatcttagtggcgaacgggtgagtaacgcgtaggcaacctgccctttagttggggacaacatcccgaaaggggtgctaataccgaatgtgatcgcttcctcgcatgagagagcgatgaaagatggcctctatttataagctatcgctaaaggatgggcctgcgtctgattagctagttggtggggtaacggcctaccaaggcgatgatcagtagccggtctgagaggatgaacggccacattgggactgagacacggcccagactcctacgggaggcagcagtggggaatcttccgcaatgggcgaaagcctgacggagcaatgccgcgtgagtgatgaaggaattcgttccgtaaagctcttttgtttatgacgaatgtgcagactgtgaataatggtttgtaatgacggtagt

SEQ ID NO: 131 - DNA, 490 bp, Unknown
  Ascusbbf_1207, encodes 16S rRNA
agagtttgatcatggctcaggatgaacgctagcgacaggcctaacacatgcaagtcgaggggcagcgggattgaagcttgctttaattgccggcgaccggcgcacgggtgcgtaacaggtgtgcaatctgtccatagtcggggaatagcccagcgaaagttggattaatgctccatgtgaatcgagaccgcatgatcttgatttgaaacgtaaggactatgggtgagcacgcttctgattagatagttggtgaggtaacggctcaccaagtcgacgatcagtaggggttctgagaggaaggtcccccacattggaactgagacacggtccaaactcctacgggaggcagcagtgaggaatattggtcaatgggcgagagcctgaaccagccaagtcgcgtgaaggatgaaggttctatggattgtaaacttcttttgtccgagggtaaaaaaggctacgtgtagcttcttgcaagtatcggacgaataag

SEQ ID NO: 132 - DNA, 490 bp, Unknown
  Ascusbbf_3875, encodes 16S rRNA
agagtttgatcctggctcaggatgaacgctggcggcgtgcctaatacatgcaagtcgaacggagtgtgccattgatgaagcttcggcggattcgccggtacacttagtggcggacgggtgagtaacgcgtggataacctgcctcacacagggggatagcagctggaaacggctgataataccgcataagcgcacagtgacgcatgtcacagtgtgaaaaactccggtggtgtgagatggatccgcgtctgattagcttgttggcggggtaacggcccaccaaggcgacgatcagtagccggcctgagagggtgaacggccacattgggactgagacacggcccagactcctacgggaggcagcagtagggaatattgcacaatggggggaaccctgatgcagcgacgccgcgtgaaggaagaagtatttcggtatgtaaacttctatcagcagggaagataatgacggtacctgactaagaagccccggc

SEQ ID NO: 133 - DNA, 490 bp, Unknown
  Ascusbbf_72889, encodes 16S rRNA
agagtttgatcatggctcaggatgaacgctggcggcgtgcctaacacatgcaagtcgagcggaccttagaaagtgaacagcttgctgggatctttcgaaaggttagcggcggacgggtgagtaacgcgtgggtaacctgcctcatacagggggatagcagttggaaacgactggtaataccgcataagcgcacagtgccgcatggtacggtgtgaaaaactccggtggtatgagatggacccgcgtccgattagccagttggcggggtaacggcccaccaaagcgacgatcggtagccggcctgagagggcggacggccacattgggactgagacacggcccagactcctacgggaggcagcagtgggggatattgcacaatggaggaaactctgatgcagcgacgccgcgtgggtgaagaagtatttcggtatgtaaagccctatcagcagggacgataatgacggtacctgactaagaagccccggct

SEQ ID NO: 134 - DNA, 490 bp, Unknown
  Ascusbbf_106863, encodes 16S rRNA
agagtttgatcctggctcaggatgaacgctagcgacaggcttaacacatgcaagtcgaggggcagcgcgagggtagcaatacctttggcggcgaccggcgcactggtgagtaacacgtatgcgacctgccccggacagggggataaacccgggaaactgggcctaataccccatacgcctattgatcgcatggtcattaggtgaaagatccgtcggtccgggatgggcatgcggcgcattagctagttggcggggcaacggcccaccaaggcgacgatgcgtaggggttctgagaggaaggtcccccacactggtactgagacacggaccagactcctacgggaggcagcagtgaggaatattggtcaatggacgcgagtctgaaccagccaagtcgcgtgcgggaagaaggccctccgggtcgtaaaccgctttagccggggagtaacgtgggggacgcgtccctcagtgagagtacccggagaataag

SEQ ID NO: 135 - DNA, 490 bp, Unknown
  Ascusbbf_120, encodes 16S rRNA
agagtttgatcctggctcaggatgaacgctagctacaggcttaacacatgcaagtcgaggggcagcatattggtagcttgctactaatgatggcgaccggcgcacgggtgagtaacgcgtatccaaccttccctatactagaggatagcccggcgaaagtcggattaatactctatgttcttcgtagatgacatctgaaatgaagcaaagatttatcggtataggatggggatgcgtctgattaggttgttggcggggtaacggcccaccaagcctgcgatcagtaggggttctgagaggaaggtcccccacattggaactgagacacggtccaaactcctacgggaggcagcagtgaggaatattggtcaatggacgagagtctgaaccagccaagtagcgtgcaggatgacggccctatgggttgtaaactgcttttatatagggataaagtgatctacgtgtagatttttgtaggtactatatgaat

SEQ ID NO: 136 - DNA, 490 bp, Unknown
  Ascusbbf_930, encodes 16S rRNA
agagtttgatcctggctcaggatgaacgctagctacaggcttaacacatgcaagtcgaggggcagcatgatcttagcttgctaagattgatggcgaccggcgcacgggtgagtaacgcgtatccaaccttccctgtactaggggatagcccggcgaaagtcggattaataccctatgttttccgaagcgagcatttaatttggaacaaaggtttaccggtataggatggggatgcgtctgattagatagtaggcggggtaacggcccacctagtcgacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttatatagggataaagtgagggacgtgtcccttattgtaggtactatatgaat

SEQ ID NO: 137 - DNA, 490 bp, Unknown
  Ascusbbf_279562, encodes 16S rRNA
agagtttgatcctggctcaggatgaacgctggcggcgtgcttaacacatgcaagtcgaacggagtacccttgacggagttttcggacaacagataggactacttagtggcggacgggtgagtaacgcgtgaggaacctgccttggagaggggaataacacagagaaatttgtgctaataccgcatgaagcagctggatcgcatgatcctggctgccaaagatttatcgctctgagatggcctcgcgtctgattaggtagttggtggggtaacggcccaccaagccgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttatgagggacgaaggaagtgacggtacctcatgaataagctcc

SEQ ID NO: 138 - DNA, 490 bp, Unknown
  Ascusbbf_1492973, encodes 16S rRNA
agagtttgatcatggctcagaacgaacgctggcggcgcgttttaagcatgcaagtcgagcggcagtagcaatacgagagcggcggacgggtgagtaacacgtgggtaatctgccctccagtcggggatagcctgtggaaacacaggataataccggatgcgatggcgtccacacaagtgggtgtcaggaaaggggccaaggccccgctggaggatgagcccgcgtcccattagcttgatggtggggtacaggcccaccatggcgatgatgggtagccggcctgagagggtgaacggccacattggaactgagacacggtccagactcctacggaaggcagcagctaagaatcttccacaatggacgaaagtctgatggagcgacgccgcgtgggcgatgaaggccgtgaggttgtaaagcccttttcttgagggggaatgatgcaggcagggaatggcctgcggatgacgtgaatcaaggaataagcccc

SEQ ID NO: 139 - DNA, 490 bp, Unknown
  Ascusbbf_1098850, encodes 16S rRNA
agagtttgatcatggctcaggatgaacgctggcggcgtgcttaacacatgcaagtcgaacgattaagccggcttcggccgggcatagagtggcgaacgggtgagtaacacgtgaccaacctgccccgcgcgccgggacagcctcgcgaaagcgggattaataccggatactccgggggcggcgcatgccgcccccgggaaagctccggcggcgcgggatggggtcgcggcccatcaggtagtaggtcgggcagcggccgacctagccgacgacgggtagccgggttgagagaccgaccggccacattgggactgagatacggcccagactcctacgggaggcagcagtggggaatattgcgcaatgggggcaaccctgacgcagcaacgccgcgtgcgggatgaaggccttcgggttgtaaaccgctttcagcagggaagatggtgacagtacctgcacaagaagccccggctaactacgtgccagcagc

SEQ ID NO: 140 - DNA, 490 bp, Unknown
  Ascusbbf_16099, encodes 16S rRNA
agagtttgatcatggctcaggatgaacgctggcggcgtgcctaatacatgcaagtcgaacgagggtgcttgcaccctagtggcgaacgggtgagtaacacgtaggtaacctgcccttaagcttgggatacccagaggaaactttggctaataccggataacaacagaggaggcatctcctttgcttgaaaggccctttcgggtcacttaaggatggacctgcggcgcattagctagttggtgagataacagcccaccaaggcgaggatgcgtagccgaactgagaggttgatcggccacattggaactgagacacggtccaaactcctacgggaggcagcagtaaggagttttcggcaatgggggaaaccctgaccgagcaacgccgcgtgagtgatgacggccctatgggttgtaaagctcttttataagggacgaatggtagtgctaggaaatgagcgctatttgacggtaccttttgaataagccac

SEQ ID NO: 141 - DNA, 490 bp, Unknown
  Ascusbbf_293927, encodes 16S rRNA
agagtttgatcctggctcaggatcaacgctggcggcgtgcctaatgcatgcaagtcgaacggggtcatcttcggatgacttacgtggcggacgggtgaggaacgcgtggccaacctgccctttggtgggggataaccgctggaaacagtgggtaataccgcatgagaccttttgccgagtggggtgaaaggggaaagccgcaaggcgccgaaggagggggctgcgtccgattagctagacggtggggtaacggcctaccgtggcagtgatcggtagctggtttgagaggatgatcagccacacggggactgagacacggccccgactcctacgggaggcagcagcaaggaattttccgcaatgggcgcaagcctgacggagcaacgccgcgtgtgggatgacgcttttcggagtgtaaaccactgttcatggggacgaagcactgacggtacccatggaggaaggcccggctaactacgtgccagcagcc

SEQ ID NO: 142 - DNA, 489 bp, Unknown
  Ascusbbf_77334, encodes 16S rRNA
agagtttgatcctggctcagaacgaacgctggcggcatggattaggcatgcaagtcgaacgaagcagcaatgcttagtggcgcaagggtgaggaacacgtgagtgacctgcccacaagtttggaacagctcctggaaacgggaattaataccggatgtgatcgatgaactgcatggtttattgattaaagcagcaatgcgcttgtggatgggctcgcgtcccattagctagttggtgaggtaacggcccaccaaggccatgatgggtagctggtctgagaggacgaccagccacactggggctgagaactgcccagactcctacgggaggctgcagtcgagaattttgggcaatggacgaaagtctgacccagcaatgccgcgtgcgggatgaaggtcttcggattgtaaaccgctgtttggagggacgaaagatgacggtacttccagagaaagccacggctaactacgtgccagcagccgcggtaat

SEQ ID NO: 143 - DNA, 490 bp, Unknown
  Ascusbbf_52448, encodes 16S rRNA
agagtttgatcatggctcagattgaacgctggcggcaggcttaacacatgcaagtcgaacggtaacgggcgagagcttgctcttgtgccgacgagtggcggacgggtgagtaatgcttgggaatctggcttatggagggggataactactggaaacggtagctaataccgcgtaatgtctgtggactaaagggtgggactttcgggccacctgccataagatgagcccaagtgggattaggtagttggtgaggtaaaggctcaccaagcccgcgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgacgaggaaggcggacttgttaatagcaagtttgattgacgttaatcacagaag

SEQ ID NO: 144 - DNA, 490 bp, Unknown
  Ascusbbf_45796, encodes 16S rRNA
agagtttgatcctggctcaggatgaacgctggcggcgtgcctaacacatgcaagtcgagcgagaatttgtggaagtttcccttcggggaaacggaagcgaaggaaagcggcggacgggtgagtaacgcgtaggtaacctgcccttcacacggggatagccaccggaaacggtgattaatacccgatagtccggaccatcacatggtgatccggggaaagatttatcggtgaaggatggacctgcgtctgattagctagttggtgaggtaatggctcaccaaggcaatgatcagtagccgacctaagagggtgaccggccacactgggactgagacacggcccagactcctacgggaggcagcagtgggggatattgcgcaatgggcgaaagcctgacgcagcaacgccgcgtgaacgaggaagctcttcggagtgtaaagttctgtcctatgggaagaagatgacggtaccataggaggaagccccggct

SEQ ID NO: 145 - DNA, 490 bp, Unknown
  Ascusbbf_5691, encodes 16S rRNA
agagtttgatcatggctcaggatgaacgctagcggcaggcttaacacatgcaagtcgaggggcagcgcggagtagcaatactctggcggcgaccggcggaagggtgcgtaacacgtgagcaacttgcccgtgacagggggataagcgatggaaacgtcgtctaacatcccgtaacacgaggggaggcatctcccttcgttgaaaactccggtggtcacggatgggctcgcgggacattagctagttggcggggcaacggcccaccaaggcgacgatgtctaggggttctgagaggaagatcccccacactggaactgagacacggtccagactcctacgggaggcagcagtgaggaatattggacaatggaggcaactctgatccagccatgccgcgtgaaggacgaaggccctatgggtcgtaaacttcttttgtcagggagcaataagggtcacgcgtggcccgacgagagtacctggcgaataagca

SEQ ID NO: 146 - DNA, 490 bp, Unknown
  Ascusbbf_2033, encodes 16S rRNA
agagtttgatcatggctcagaacgaacgctggcggcgcgtcttaagcatgcaagtcgaacggcaagattggtgcttgcaccgatcctagagtggcggactggtgagtaacacgtgggtgacgtaccctctgaatggggatagccggtagaaataccggataataccgaataaccttgcacctttagagtggtgtaagaaaaggagcttcggcttcgtcggaggaacggcccgcgcactattagctagttggtgaggtaacggcccaccaaggcgacgatagttatccggcctaagagggtgaacggacacattgggactgagatacggcccagactcctacgggaggcagcagctaagaatattccgcaatggaggaaactctgacggagcgacgccgcgtggatgatgaaggccggaaggttgtaaaatccttttgtttgtgaggaataagtcgtataggaaatgatatgatgatgactgtagcaaatg

SEQ ID NO: 147 - DNA, 490 bp, Unknown
  Ascusbbf_64715, encodes 16S rRNA
agagtttgatcatggctcaggatgaacgctggcggcgtgcctaacacatgcaagtcgaacggagcagtcacgctgatgatggagatgcttgcatcaaaagaatcttgtggcagcttagtggcggacgggtgagtaacgtgtggataacctggtccatccagggggacagcagctggaaacggctgataataccgcataagcgcacactatcgcatgatagagtgtgaaaagagatatcgggatggaatggatccgcatctgattagccagttggcggggtagaagcccaccaaagcgacgatcagtagccggcctgagagggcggacggccacattgggactgagacacggcccagactcctacgggaggcagcagtgggggatattgcacaatggggggaaccctgatgcagcgacgccgcgtgggtgaagaagtatttcggtatgtaaagccctatcagcagggaagataatgacggtacctgagtaa

SEQ ID NO: 148 - DNA, 490 bp, Unknown
  Ascusbbf_54541, encodes 16S rRNA
agagtttgatcatggctcagagttaacgctggcatcgtgcataacacatgcaagtcgaacgggacttgatttgtagcttgctatagattaagtttagtggcagacgggtgagtaatgtataagaaacctacctctgagtggggaataacagtccgaaaggattgctaataccccataacataacctagtggcatcacttagttatcaaagatttatcgcttggagatggtcttatattctatcagctagttggcagtgtaacggactaccaaggctacgacggatagccggcctgaaagggcgaccggccacaagggcactgagacacgggccctactcctacgggaggcagcagtggggaattttggacaatgggcgaaagcctgatccagcaacgatgcgtggaggacgaaggttctcggattgtaaactccttttgtgagggaagaaaaaaatgacggtacctcacgaataagccacggctaactac

SEQ ID NO: 149 - DNA, 490 bp, Unknown
  Ascusbbf_4784, encodes 16S rRNA
agagtttgatcatggctcaggatgaacgctggcggcgtgcctaacacatgcaagtcgagcgagaaatcccgaaaagattcttcggaagatttaagggatggatagcggcggacgggtgagtaacgcgtgggcaacctgcccctcactgagggatagccgagggaaacttcgagtaatacctcataacgcataaccgttgcatagcggatatgccaaagatttatcggtgagggatgggcccgcgtctgattagccagttggtgaggtagcggctcaccaaagcgacgatcagtagccggcctgagagggcggacggccacattggaactgagacacggtccagactcctacgggaggcagcagtggggaatattgcacaatgggggaaaccctgatgcagcgacgccgcgtgaaggaagaaggccttcgggtcgtaaacttctgtcctaggggaagaagaactgacggtacccttggaggaagccccggc

SEQ ID NO: 150 - DNA, 490 bp, Unknown
  Ascusbbf_7656, encodes 16S rRNA
agagtttgatcatggctcaggacgaacgctggcggcatgcttaacacatgcaagtcgaacgaacttgattccttcgggatgaaaagttagtggcggacgggtgagtaatgtatgagcaatctgcccttttcatcgggataacatagggaaacttatgctaataccgaatatgaccacggtatcgcatggtactgcggtgaaagctccggcggaaaaggatgagctcatatcctattagttagttggtgagataacagcccaccaagacagcgatgggtagccgagctgagaggctgatcggccacattgggactgaaacacggcccagacttctacggaaggcagcagtggggaatattggtcaatggaggcaactctgaaccagcaatgccgcgtgagtgatgaaaatcttacgattgtaaagctctaaacttagagacgataatgacggtatctaaggataagccccggctaactacgtgccagcagc

SEQ ID NO: 151 - DNA, 490 bp, Unknown
  Ascusbbf_56837, encodes 16S rRNA
agagtttgatcatggctcaggatgaacgctggcggcgtgcctaacacatgcaagtcgaacgaagcacttctcccgtcaaagtagattagcttgctatgaagcggagacatttgaagtgacttagtggcggacgggtgagtaacgcgtgggtaacctgccctgtactgggggacaacagttggaaacggctgctaataccgcataagcgcacagcatcgcatggtgcagtgtgaaaaactccggtggtacaggatggacccgcgtctgattagctagttggtggggtaacggcctaccaaggcgacgatcagtagccggcctgagagggtgaacggccacattgggactgagacacggcccagactcctacgggaggcagcagtggggaatattgcacaatgggggaaaccctgatgcagcgacgccgcgtgagtgatgaagtatttcggtatgtaaagctctatcagcagggaagaaaatgacggtacct

SEQ ID NO: 152 - DNA, 490 bp, Unknown
  Ascusbbf_2728, encodes 16S rRNA
agagtttgatcatggctcagagtgaacgctggcgacgtggctaagacatgcaagtcgagcgagaaggtgccttcgggtgcctgaaagcggcaaacgggtgcgtaacacgtaagtaacctgcccttaagacgggaatagcttgatgaaaattgagataatgcccgatatcaaattcttccgcatggaagaagtttgaaaggtttgtgatgacgcttaaggaggggcttgcggcctatcagcttgttggcggtgtgaaagaccaccaaggctaagacgggtagccggtctgagaggatggacggccacattggaactgagatacggtccaaacacctacgggtggcagcagtttcgaatcattcacaatgggcgaaagcctgatggtgcgacgtcgcgtggaggatgaaggtcttcggattgtaaactcctgtcatcggtgagcaaaaggtcggtgaagaatcgattttgagttaagccgaagaggaagcag

SEQ ID NO: 153 - DNA, 490 bp, Unknown
  Ascusbbf_15146, encodes 16S rRNA
agagtttgatcatggctcaggataaacgctggcggcgcacataagacatgcaagtcgaacggaagtcgttatactgattttgaaatgaacggagaacttgttcaaagggactggatgaagatttataacaatggctttagtggcggactggtgagtaatacgtaagcaacctgcctattagaggggaacaacagttagaaatgactgctaataccgcatatgccataggagccacatggttctagtgggaaaggagcaatccgctaatagatgggcttacggctgattagctagttggtggggtaatggcctaccaaggcgacgatcagtagccggactgagaggttcaacggccacattgggactgagatacggcccagactcctacgggaggcagcagtcgggaattttgcgcaatggaggaaactctgacgcagtgacgccgcgtgcaggaagaaggttttcggattgtaaactgctttagacaggg

SEQ ID NO: 154 - DNA, 486 bp, Unknown
  Ascusbbf_561, encodes 16S rRNA
agagtttgatcctggctcagaacgaacgctggcggcacgcttaacacatgcaagtcgaacggtgcaatggggcttgctctattgcatagtggcggacgggtgagtaacacgtaggaacctgcctggtaatggtggatagcttcgggaaactggaggtaatacagcatgagctcgagagaggaaaggccttagggtcgttaccagaggggcctgcggatgattaggtagttggtggggtaagagcctaccaagccgacgatcaatagctggtctgagaggatgatcagccacactggaactgagatacggtccagactcctacgggaggcagcagtggggaatattggacaatggggggaaccctgatccagcgatgccgcgtgagtgaagaaggccttagggttgtaaagctcttttgacagggacgatgatgacggtacctgtagaataagcaccggctaactctgtgccagcagccgcggtaat

SEQ ID NO: 155 - DNA, 490 bp, Unknown
  Ascusbbf_1071, encodes 16S rRNA
agagtttgatcctggctcaggatgaacgctggcggcgtgcctaatacatgcaagtcgaacgaggtggacggaagcttgcttcctgatacctagtggcgaacgggtgagtaacacgtaggtaacctgcctttaggactgggatacccagacgaaagtttggctaataccggataacaacggggatcgcatgatctccgcttgaaagttgcgtttgcaacacctttagatggacctgcggcacattagctagttggtgagataacagcccaccaaggcaaggatgtgtagccgatctgagaggatgaccggccacaatgggactgagacacggcccatactcctacgggaggcagcagtagggagttttcggcaatgggggaaaccctgaccgagcaacgccgcgtgagtgattaaggtcttcggattgtaaagctctgttacgcaggacgaataactcgagtaggaaatgcctcgagtctgacggtactgc

SEQ ID NO: 156 - DNA, 490 bp, Unknown
  Ascusbbf_6745, encodes 16S rRNA
agagtttgatcctggctcaggatgaacgctagcggcaggcttaacacatgcaagtcgaggggcatcgcgggtagcaatacctggcggcgaccggcggaagggtgcgtaacgcgtgagcgacatgcccgtgacagggggataacagatggaaacgtctcctaataccccatatgatcatatatcgcatggtatgtgattgaaaggtgagaaccggtcacggattggctcgcgtcccatcaggtagacggcggggcagcggcccgccgtgccgacgacgggtaggggctctgagaggagtgacccccacaatggaactgagacacggtccatactcctacgggaggcagcagtgaggaatattggtcaatgggcggaagcctgaaccagccatgccgcgtgcgggaggacggccctatgggttgtaaaccgcttttgagtgagagcaataaggttcacgtgtggaccgatgagagtatcattcgaataagca

SEQ ID NO: 157 - DNA, 490 bp, Unknown
  Ascusbbf_9083, encodes 16S rRNA
agagtttgatcctggctcaggatgaacgctggcggcgtgcataacacattcaagtcgaacggagttgcgatagaaagaggcttcggccaatggaaattgtaacttagtggcggacgggtgagtaacgcgtgagcaacctacctatgcgcgggggacaacagttggaaacgactgctaataccgcataaatcatggtaaaggcatctttagcatggcaaagattaattgcgcatagatgggctcgcgtccgattagatagttggtgaggtaacggcccaccaagtcgacgatcggtagccggactgagaggttgaacggccacattggaactgagagacggtccagactcctacgggaggcagcagtggggaatattgggcaatgggcgaaagcctgacccagcgacgccgcgtgagtgaagaaggtcttcggattgtaaagcttagttattggggaagaagaaagtgacggtacccaaagagaaagccac

SEQ ID NO: 158 - DNA, 490 bp, Unknown
  Ascusbbf_66486, encodes 16S rRNA
agagtttgatcctggctcagaacgaacgctggtggcgtgtcttatacatgcaagtcgagcggggcagcaatgcccagcggcgaacgggtgagtaacgcgtaagcaatctgccccatatcaggaaatacccgtgccaacgcgcggttaatgtccaggagcgtggcttcccgcatggggagttgacaagagatttatcggtatgggatgagcttgcgtccgattagctagttggcggggcaacggcccaccaaggcgacgatcggtagccggcctgagagggtgatcggccacattgggactgagatacggcccagactcctacgggaggcagcagtagggaatattgcacaatgggggaaaccctgatgcagcaacgccacgtgtgggaagaagcatttcggtgtgtaaaccactgtcgtgagggaataaggcgtcttctcggagacgttgaatgtacctcgaaaggaagcaccggcaaacttcgtgccag

SEQ ID NO: 159 - DNA, 490 bp, Unknown
  Ascusbbf_11104, encodes 16S rRNA
agagtttgatcatggctcaggatgaacgctagcggcaggcctaatacatgcaagtcgaacggtaaatgccccttcgggggcatgagagtggcgcacgggtgcgtaacgcgtatgcaacccacccgctgccgggggatagcccggagaaattcggattaataccccatgaggagcgaggaaggcatcttccacgtttcaaaacttcggtggcggcggacgggcatgcgtgccattagatagttggcggggtaacggcccaccaagtcgacgatggctaggggatctgagaggacggtcccccacactggtactgagacacggaccagactcctacgggaggcagcagtaagggatattggtcaatggggggaaccctgaaccagccatgccgcgtgagggaggaaggccctacgggtcgtaaacctcttttgccgggggataaggacgggaacgcgttcccgtttgaaggtacccggagaataagcatcgg

SEQ ID NO: 160 - DNA, 490 bp, Unknown
  Ascusbbf_20364, encodes 16S rRNA
agagtttgatcatggctcaggacgaacgctggcggcgtgcttaacacatgcaagtcgagcggaaaggcccttcggggtactcgagcggcgaacgggtgagtaacacgtgagcaacctgccctaggctttgggataaccctcggaaacgggggctaataccggatattcacttgcggacgcatgtttgtgggtggaaagtttttcggcttgggatgggctcgcggcctatcagcttgttggtggggtgatggcctaccaaggcgacgacgggtagccggcctgagagggcgaccggccacactgggactgagacacggcccagactcctacgggaggcagcagtgggaatattgcacaatgggcggaagcctgatgcagcgacgccgcgtgagggatgacggccttcgggttgtaaacctctttcagcagggacgaagcgtgagtgacggtacctgcagaagaagcgccggccaactacgtgccagcagcc

SEQ ID NO: 161 - DNA, 490 bp, Unknown
  Ascusbbf_47649, encodes 16S rRNA
agagtttgatcctggctcaggatgaacgctagctacaggcctaacacatgcaagtcgcggggcagcatggattctgcttgcagtatccgatggcgaccggcgcacgggtgagtaacgcgtatccaacctgcctccatgcagggcacagcccggcgaaagtcggattaattccctatgccctccctcgcggacatccaatggggaggaaaggcttcggccgcatggagatggggatgcgtaggattagcttgacggcggggtgacggcccaccgtggcaacgatccttaggggttctgagaggaaagtcccccacactggtactgagacacggaccagactcctacgggaggcagcagtgaggaatattggtcaatggtcggaagactgaaccagccaagtagcgtgcaggacgacggccctacgggttgtaaactgcttttatgcggggataaccggcggcactagtgccgccctgcaggtaccgcatga

SEQ ID NO: 162 - DNA, 490 bp, Unknown
  Ascusbbf_60332, encodes 16S rRNA
agagtttgatcatggctcaggacgaacgctggcggcgtgcttaacacatgcaagtcgagcggtaaggctccttcgggagtacacgagcggcgaacgggtgagtaacacgtgagtaacctgccccattcatcggaataaccagtggaaacgctggctaatgccgaatacgaccaccgaaggcatcttctggtggtggaaagctccggcggagtgggatggactcgcggcctatcagcttgttggtgaggtaacggctcaccaaggcgacgacgggtagccggcctgagagggtgaccggccacactgggactgagacacggcccagactcctacgggaggcagcagtggggaatattggacaatgggcgaaagcctgatccagcaacgccgcgtgagggatgacggccttcgggttgtaaacctctttcagcagggacgaagcgaaagtgacggtacctgcagaagaaggaccggccaactacgtgccagc

SEQ ID NO: 163 - DNA, 490 bp, Unknown
  Ascusbbf_17599, encodes 16S rRNA
agagtttgatcatggctcaggatgaacgctggcggcgtgcctaatacatgcaagtcgaacgggcgagatccagcttgctggatttagctagtggcgaacgggtgagtaatacgtaagcaacctgcctgcaaggaccgggataacacctggaaacgggcgctaataccggataggtaacgagggggcatcctcttgttattaaaggttagaaacacaagcagatgggcttacggtgcattagctagttggtgaggtaacggcccaccaaggcgatgatgcatagccggcctgagagggtgaacggccacattgggactgagacacggcccagactcctacgggaggcagcagtagggaattttcggcaatgggcgcaagcctgaccgagcaacgccgcgtgagtgatgaaggttttcggattgtaaagctctgttgtaagggaagaatggtgcggatagaatctgcaaatgacggtaccttaccagaaagc

SEQ ID NO: 164 - DNA, 490 bp, Unknown
  Ascusbbf_19107, encodes 16S rRNA
agagtttgatcatggctcaggacgaacgctggcggcgtgcttaacacatgcaagtcgagcggaaaggcccttcggggtactcgagcggcgaacgggtgagtaacacgtgagcaacctgccctaggctttgggataaccctcggaaacgggggctaataccggataagaccttgccttgcatgaggcttggtggaaagtttttcggcctgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgcaagtgacggtacctgcagaagaagcaccggccaactacgtgccagcagcc

SEQ ID NO: 165 - DNA, 490 bp, Unknown
  Ascusbbf_44971, encodes 16S rRNA
agagtttgatcatggctcaggatgaacgctagcgacaggcctaacacatgcaagtcgaggggtaacagggagcttgctccgctgacgaccggcgcacgggtgagtaacgcgtatgcaaccttcccgcgggatcgggatagccccccgaaagggggattaacaccggatgaggcctaagggcggcatcgcccggaggtcaaatgcgaagcttgcggatgggcatgcgtctgattagcttgttggcggggtaacggcccaccaaggcgacgatcagtaggggttctgagaggaaggtcccccacattggtactgagacacggaccaaactcctacgggaggcagcagtgaggaatattggtcaatgggcgagagcctgaaccagccatgtcgcgtgcaggaatacggccctatgggttttaaactgcttttgccgggggataaagtggcggacgcgtccgctattgcaggtacccggcgaataaggatcggc

SEQ ID NO: 166 - DNA, 490 bp, Unknown
  Ascusbbf_61263, encodes 16S rRNA
agagtttgatcctggctcaggatgaacgctagcggcaggcttaacacatgcaagtcgaggggcatcgtggagtagcaatactctgacggcgaccggcgaaagggtgagtaacgcgtgagcaacatgcccgtgtgagggggatagtcattggaaacgatgcgtaataccccgtaacatcagttaccgcatggtagttgattgaaagattaatcgcacacggattggctcgcgtaccattagctagttggcggggtaacggcccaccaaggcgacgatggttaggggttctgagaggaaggtcccccacattggaactgagacacggtccagactcctacgggaggcagcagtgaggaatattggacaatggccgagaggctgatccagccatgccgcgtgcgggaggacggccctatgggttgtaaaccgcttttgtcagggggcaataaggtctacgtgtagactgatgagagtacctggcgaataagca

SEQ ID NO: 167 - DNA, 490 bp, Unknown
  Ascusbbf_50568, encodes 16S rRNA
agagtttgatcatggctcaggacgaacgctggcggcgtgcctaatacatgcaagtagaacgctgaccactttagcttgctagagtgtgatgagttgcgaacgggtgagtaacgcgtaggtaacctgcctggtagcgggggataactattggaaacgatagctaataccgcataacagttttggtcgcatgaccgaggcttgaaaggaacaattgtttcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaataggtgtgggagtggaaagtccacactatgacggtagct

SEQ ID NO: 168 - DNA, 490 bp, Unknown
  Ascusbbf_19804, encodes 16S rRNA
agagtttgatcatggctcaggatgaacgctagcggcaggcttaacacatgcaagtcgaggggcagcgcgttgtagcaatacgatggcggcgaccggcgcaagggtgcgtaacgcgtgagcaacatgcccgcaacagagggataaccggaggaaactccgactaatacctcataaggatgtagtacggcatcgtgcagcatctaaacttacgagggttgcggattggctcgcgagacattaggtagacggcggggtaacggcccaccgtgccgacgatgtctaggggttctgagaggaaggtcccccacactggaactgagacacggtccagactcctacgggaggcagcagtgaggaatattggacaatggtcggaagactgatccagccatgccgcgtgcaggaagacggtcctatggattgtaaactgcttttgtacgggagcaataagggtgtcgtgacatccgatgagagtaccgtacgaataagc

SEQ ID NO: 169 - DNA, 490 bp, Unknown
  Ascusbbf_106427, encodes 16S rRNA
agagtttgatcatggctcagaacgaacgccggcggcgcgtcttaagcatgcaagtcgggcgggatcagggtgcttgcaccctgtgagagcggcggactggcgaggaacgcgtgggcgacgcaccccctgcaccgggacagccggcagaaatgccgggtgatacgggatgagctcgttttctgtggtggagaacgaggaaagcggctacggccgcggcaggggagcggcccgcgtcccatcagctagtaggcggggcaaaagcccacctaggcaacgacgggtacccggactgagaggtcggacgggcgcattgggactgagatacggcccagactcctacgggaggcagcagctaagaatattccgcaatgggggaaaccctgacggagcgacgccgcgtggacgatggaggccggaaggttgtaaagtcctctggcgcctgaggaagaacccgggcagggaatggcccgggagtgactgtagggcgaga

SEQ ID NO: 170 - DNA, 490 bp, Unknown
  Ascusbbf_1058404, encodes 16S rRNA
agagtttgatcatggctcaggatgaacgctagcggcaggcttaacacatgcaagtcgaggggcagcatgagagcgtagcaatacattcttgatggcgaccggcgcaagggtgcgtaacgcgtgagcaacttgcccgcatcaggggcataatcggtggaaacgccgtctaactccccataacataggaggtggcatcgccttctattgaaatccttggaggatgcggatgggctcgcgtgacattaggcagttggcggggtaacggcccaccaaaccgacgatgtctaggggaactgagaggttaatcccccacactggaactgagacacggcccagactcctacgggaggcagcagtgaggaatattggacaatggagggaactctgatccagccatgccgcgtgcaggataaggtcctatggattgtaaactgctttttgtatgagagcaataaggattacgtgtaatccgatgagagtatcatacgga

SEQ ID NO: 171 - DNA, 490 bp, Unknown
  Ascusbbf_284732, encodes 16S rRNA
agagtttgatcctggctcagaacgaacgctggcggcgcgtcttaagcatgcaagtcgagcggcaagctgccttcgggcagcctagagcggcggactggtgagtaacgcgtggatgacgcaccctcctgatcgggatagcctgtggaaacacagggtaataccgggtaagcccgcccgcgttggaggcgagcggggaaaggggctattgccccgctggaggagcggtccgcgtcccatcagcttgtaggcggtgtaacggaccacctaggccatgacgggtacccggcctgagagggcgatcgggcacattgggactgagatacggcccagactcctacgggaggcagcagctaagaatattccgcaatgggggaaaccctgacggagcgacgccgcgtggacgatgaaggccggaaggttgcagagtcctttggcgcgcgaggaaggagagggggagtggaaagcctcctcggtgactgtagcgcgagaa

SEQ ID NO: 172 - DNA, 490 bp, Unknown
  Ascusbbf_52292, encodes 16S rRNA
agagtttgatcatggctcaggacgaacgctggcggcgtgcctaacacatgcaagtcgaacggagttataaagacggaacccttcggggggacagaaatataacttagtggcggacgggtgagtaacgcgtgagtaacctgcctttgagagggggataacgttctgaaaaggacgctaataccgcataacatattgaagccgcatgactttgatatcaaagattttatcgctcaaagatggactcgcgtccgattagttagttggtggggtaacggcctaccaagacgacgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttgttagggacgaaaaatgacggtacctaacgaataagctccg

SEQ ID NO: 173 - DNA, 490 bp, Unknown
  Ascusbbf_51185, encodes 16S rRNA
agagtttgatcatggctcaggatgaacgctagcggcaggcttaacacatgcaagtcgaggggcagcgggtcgtagcaatacgatgccggcgaccggcgcaagggtgcgtaacgcgtgagcaatctgcccgtatcagggggataagcgatggaaacgtcgtctaataccgcataacaacattggaggcatctccgatgtttgaaagcttcggtggatacggatgagctcgcgagacattagttagttggcggggtaacggcccaccaagaccgcgatgtctaggggaactgagaggttggtcccccacactggaactgagacacggtccagactcctacgggaggcagcagtgaggaatattggacaatggccggaaggctgatccagccatgccgcgtgaaggataaggtcctatggattgtaaacttcttttgagtgggagcaataagggtctcgtgaggcccgatgagagtaccattcgaataagcat

SEQ ID NO: 174 - DNA, 490 bp, Unknown
  Ascusbbf_29488, encodes 16S rRNA
agagtttgatcatggctcaggattaacgctggcggcatgcctaatacatgcaagtcaaacgggaagcttcggcttctagtggcgaacgggtgagtaacacgtaggcaatctgtcctaaagcttgggataacagctggaaacggctgataataccggataacaaattggattgcatgatctaattttgaaagatgcaaatgtatcacttttggaggagcctgcggcgcattagatagttggtgaggtaacggcccaccaagtcgatgatgcgtagctgcgctgagaggcgaaacagccacattgggactgagaacggcccaaactcctacgggaggcagcagtagggaattttcggcaatgggggaaaccctgaccgagcaatgccgcgtgaatgatgacgatcttcggattgtaaagttctgttgtagaggacgaatggtaagtggagtggaacgccatttatttgacggtactttactagaaagccccg

SEQ ID NO: 175 - DNA, 490 bp, Unknown
  Ascusbbf_104542, encodes 16S rRNA
agagtttgatcctggctcaggatgaacgctagctacaggcctaacacatgcaagtcgaggggcatcgcggcgtggagcgatccatgctggcggcgaccggcggatgggtgagtaacgcgtatccaacctgccccatgcccgggcacagcccctggaaacggggagtgactcccggcggcgccgttatgccgcatggcttgacggctaaatttcgaggcatgggatgggggtgcgtccgattaggtagttggcggggcaacggcccaccaagcccacgatcggtaggggttctgagaggaaggtcccccacattgggactgagacacggcccaaactcctacgggaggcagcagtgaggaatattggtcaatgggcggaagcctgaaccagccaagtagcgtggaggatgacggccctacgggttgtaaactcctttagcgcgggaataacagtcgccacgtgtggcgttttgcaggtaccgcgagaataa

SEQ ID NO: 176 - DNA, 490 bp, Unknown
  Ascusbbf_124033, encodes 16S rRNA
agagtttgatcatggctcaggatgaacgctagctacaggcttaacacatgcaagtcgaggggcagcatgtcgtgtgcttgcacacgatgatggcgaccggcgcacgggtgcgtaacgcgtatccaaccttcccgcaagccggggatagcccggcgaaagtcggattaatacccgatgtggtgctttgaggacatctgactggcactaaaggcttgccgcttgcggatggggatgcgtacgattaggtagacggcggggtaacggcccaccgtgccatcgatcgttaggggttctgagaggaaggtcccccacactggtactgagacacggaccagactcctacgggaggcagcagtgaggaatattggtcaatgggcgcgagcctgaaccagccaagtagcgtggaggaagacggccctacgggttgtaaactccttttatgcggggataaagtgccctacgtgtagggttttgcaggtaccgcatgaat

SEQ ID NO: 177 - DNA, 490 bp, Unknown
  Ascusbbf_712468, encodes 16S rRNA
agagtttgatcatggctcagaacgaacgctggtagcgtggattaggcatgcaagtcgaacgggatccggatggtagcaatattgtctggtgagagtggcggattggggaggaacacgtgagcaacctgcccttgagttggggaaaaccgttggaaacgacggctaataccggatgtggcgtcctgtggcatcacgggaacgctaaagggggccgcaaggctctcgctcgaggaggggctcgcgcaccatcagctagttggcggggtaacggcccaccaaggcttacggttagctggtctgagaggatgaccagccccactgggactgagatactgcccagactcctacgggaggctgcagtcgaggatcattcgcaatggacgaaagtctgacgatgcgacgctgcgtggaggatgaaggccttcgggtcgtaaactcctgtcatgagggaaaaggcgagggggcccaatacgctccttagttgatggta

SEQ ID NO: 178 - DNA, 490 bp, Unknown
  Ascusbbf_733362, encodes 16S rRNA
agagtttgatcatggctcaggacgaacgctggcggcgtgcctaatacatgcaagtcgaacgcattttctttcaccgtagcttgctacaccgaaagaaaatgagtggcgaacgggtgagtaacacgtgggtaacctgcccatcagcgggggataacacttggaaacaggtgctaataccgcataattctatttaccgcatggtagatggatgaaaggcgcttttgcgtcactgatggatggacccgcggtgcattagctagttggtggggtaacggcctaccaaggctgcgatgcatagccgacctgagagggtgatcggccacactgggactgagacacggcccagactcctacgggaggcagcagtagggaatcttcggcaatggacgcaagtctgaccgagcaacgccgcgtgagtgaagaaggttttcggatcgtaaaactctgttgttagagaagaacaaggatgagagtggaaagttcatccctt

SEQ ID NO: 179 - DNA, 490 bp, Unknown
  Ascusbbf_95269, encodes 16S rRNA
agagtttgatcctggctcaggatgaacgctggcggcgtgcttaacacatgcaagtcgaacgatgaagctccagcttgctggagtggattagtggcgaacgggtgagtaacacgtgagcaacctgccccggactttgggataacagttggaaacagctgctaataccgaatacgcaccagaacggcatcgttactggtgggaaagatttttcggtccgggaggggctcgcggcctatcagcttgttggtgaggtaacggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagttgggaagaagccttcgggtgacggtaccttcagaaaaagcgccggctaactacgt

SEQ ID NO: 180 - DNA, 490 bp, Unknown
  Ascusbbf_1598189, encodes 16S rRNA
agagtttgatcctggctcaggatgaacgctggcggcgtgcctaacacatgcaagtcgaacggtgatgatttgaaattttcggatggattttcatcatagtggcggacgggtgagtaacgcgtggataacctgcctctttctgggggatagcagctggaaacggctggtaataccgcataagctcctttacctgcatgggtaagggaggaaagatttatcgggaagagatggatccgcgtctgattagccagttggcggggtaacggcccaccaaagcgacgatcagtagccggcctgagagggtgatcggccacattgggactgagacacggcccaaactcctacgggaggcagcagtgggggatattgcacaatgggcgcaagcctgatgcagcgacgccgcgtgagtgaagaagtatttcggtatgtaaagctctatcggcagggaagaaaggcccgcaagggagatgacggtacctgactaagaagc

SEQ ID NO: 181 - DNA, 490 bp, Unknown
  Ascusbbf_261207, encodes 16S rRNA
agagtttgatcctggctcagagttaacgctggcggcgtgcctaacacatgcaagtcgggcggggagtggcagagtaccgcgctcccagcggcagacgggtgagtaacgcgtaggcaacatgcccataagagggagacaaccagccgaaaggttggctaatatcccgtaaaacccgggggaggcatcttttccgggttaaagcagcgatgcgcttatggagtggcctgcggcctatcagctagttggtgaggtaacggcccaccaaggcatagacgggtagccgatctaaaaggatgaccggccacaaggggactgagacacggcccctactcctacgggaggcagcagtggggaattttggacaatgggggaaaccctgatccagcgacgccgcgtgaaggatgaaggttttcggattgtaaacttcttttgcagggggcaaaggccggcaacggcgtgatggtaccctgtgaataagccacggctaact

SEQ ID NO: 182 - DNA, 490 bp, Unknown
  Ascusbbf_173824, encodes 16S rRNA
agagtttgatcatggctcaggacgaacgctggcggcgtgcctaacacatgcaagtcgagcggagaccagggaagagcttgctcggaactggtttcagcggcggacgggtgagtaacgcgtgagcaatctgcctcggacaggggaataacgcatcgaaagatgtgctaataccgcataagaccacgcctgtgcatgcaggagaggtcaaaggagcaatccggtctgagatgagctcgcgtccgattagctggttggtgagataacagcccaccaaggcgacgatcggtagccgacctgagagggtgatcggccacattggaactgagagacggtccagactcctacgggaggcagcagtgggaatattgggcaatgggcgaaagcctgacccagcaacgccgcgtgagggaagaagggtttcggctcgtaaacctctgtcctatgggacgaaggaagtgacggtaccataggaggaagccccggctaacta

SEQ ID NO: 183 - DNA, 490 bp, Unknown
  Ascusbbf_161792, encodes 16S rRNA
agagtttgatcctggctcaggacgaacgctggcggcgtgcttaacacatgcaagtcgaacggaggcttttccttcgggggaagccttagtggcggacgggtgagtaacgcgtgagcaatctgccttgcacagggggataacaactggaaacggttgctaataccgcataacgtaacggggaggcatctttctgttaccaaaggagcaatccggtgcaagatgagctcgcgtccgattagatagttggcggggcaacggcccaccaagtcaacgatcggtagccggactgagaggttgaccggccacattgggactgagacacggcccagactcctacgggaggcagcagtggggaatattgggcaatgggcgaaagcctgacccagcaacgccgcgtgaaggatgaaggttttcggattgtaaacttctttgactgaggacgacaaaaggacggtactcagaaaacaagccacggctaactacgtgccag

SEQ ID NO: 184 - DNA, 490 bp, Unknown
  Ascusbbf_66576, encodes 16S rRNA
agagtttgatcatggctcaggacgaacgctggcggcgtgcttaatacatgcaagtcgaacggagcatttaggtagcttgctatttgaatgcttagtggcggacgggtgagtaacgcgtgaacaatctgccttttgcagggggacaacagttagaaatgactgctaataccgcataagaccacaactcggcatcgagaaggggtaaaaggagcaatccggcaaaagatgagtttgcgtatcattagctagttggtgaggtaacggcccaccaaggcgacgatggttagccgacctgagagggtgatcggccacactggaactgagacacggtccagactcctacgggaggcagcagtaaggaatattgggcaatggaggaaactctgacccagcaacgccgcgtgaaggaagaaggtcttcggattgtaaacttctgttatgagggaagaagatagtgacggtacctcatgagaaagccccggcaaactat

SEQ ID NO: 185 - DNA, 490 bp, Unknown
  Ascusbbf_121661, encodes 16S rRNA
agagtttgatcctggctcaggattaacgctggcaccatgcctaatacatgcatgtcgagcggagtttagagagcttgctttctaaacttagcggcaaatgggtgagtaacacgtaaggaacctgcctaagcgacgaggacaacggttggaaacgactgctaatactggatagtataagaaaccgcatgatttcttatttaaaggtccgtttggaccacgcttagatggccttgcggcgcattagatagttggtgaggtaacggcccaccaagtcaatgatgcgtagctgcactgagaggtgaaacagccacactgggactgagacacggcccagactcctacgggaggcagcagtagggaattttcggcaatgggcgaaagcctgaccgagcaatggtgcgtgaacgatgaaggtccttggatcgtaaagttcttttataagggaagaatacactatgtaggaaatgacatagtgctgacggtacctttt

SEQ ID NO: 186 - DNA, 490 bp, Unknown
  Ascusbbf_544913, encodes 16S rRNA
agagtttgatcatggctcaggatgaacgctagctacaggcttaacacatgcaagtcgaggggcagcattaagttagcttgctaacttagatggcgaccggcgcacgggtgagtaacgcgtatccaaccttccccctgctcagggatagcccgctgaaaggcggattaacacctgatagcttcactagatggcatctgacggtgaataaagataacggcaagggatggggatgcgtctgattagcttgttggcggggtaacggcccaccaaggcgacgatcagtaggggttctgagaggaaggtcccccacatcggtactgagacacggaccaaactcctacgggaggcagcagtgaggaatattggtcaatgggcgagagcctgaaccagccaagtagcgtgcaggacgactgccctatgggttgtaaactgcttttatcagggaataaagtgcggcacgtgtgccgttttgtatgtacctgatgaataa

SEQ ID NO: 187 - DNA, 490 bp, Unknown
  Ascusbbf_169036, encodes 16S rRNA
agagtttgatcatggctcaggatgaacgctggcggcgtgcttaacacatgcaagtcgaacggagctttttaagaacaagacttcggtcaagtgatttctaagcttagtggcggacgggtgagtaacgcgtgagcaacctgcctttcagagggggataacgtttggaaacagacgctaataccgcataacatagttttatcgcatgataggactatcaaaggagcaatccgctgaaagatgggctcgcgtccgattaggtagttggtgaggtaacggcccaccaagccgacgatcggtagccggactgagaggttgaacggccacattgggactgagacacggcccagactcctacgggaggcagcagtggggaatattgcacaatgggcgaaagcctgatgcagcaacgccgcgtgaaggaagacggttttcggattgtaaacttctgttcttggtgaagaaacaaatgacattagccaaggagcaagcc

SEQ ID NO: 188 - DNA, 490 bp, Unknown
  Ascusbbf_333954, encodes 16S rRNA
agagtttgatcctggctcaggacgaacgctggcggcgtgcctaacacatgcaagtcgagcggagccaattgacggatcccttcggggagaagacgaggaagcttagcggcggacgggtgagtaacgcgtgagtaacctgcctgtaagagggggataattcctggaaacggggactaataccgcatattgagcacatatcgcatggtatatgcttgaaagatttatcgcttacagatggactcgcgtctgattagcttgttggcggggtaacggcccaccaaggcgacgatcagtagccgaactgagaggttgatcggccacattgggactgagacacggcccagactcctacgggaggcagcagtgggggatattgcgcaatgggggaaaccctgacgcagcaacgccgcgtgatggaagaaggccttcgggttgtaaacatctgttgcaagggaagaaaaaaatgacggtaccttgtgaggaagccacg

SEQ ID NO: 189 - DNA, 490 bp, Unknown
  Ascusbbf_1848402, encodes 16S rRNA
agagtttgatcatggctcaggacgaacgctggcggcgtgcctaatacatgcaagtcgagcgctggagcgtttccttcgggagacaatccggagcggcggacgggtgagtaacacgtaggcaacctgcccgtaagactgggataactaccggaaacggtagctaataccggataggtggcttcttcgcatggagaagccaagaaacgcggttccgattcgttcggggctgcggcttacggatgggcctgcggcgcattagctagttggcagggtaatggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacggcccggagggtaactactccggga

SEQ ID NO: 190 - DNA, 490 bp, Unknown
  Ascusbbf_738464, encodes 16S rRNA
agagtttgatcatggctcaggacgaacgctggcggcgtgcctaatacatgcaagtcgaacgcaatcttttaacaatgagtgcttgcactcagcgttttaagtgcgagtggcgaacgggtgagtaacacgtgggcaatctgcccaaaagtgggggataacacttggaaacaggtgctaataccgcatcaaccggctgaccgcatggtcggccgggcaaagacggcgtcagctgtcgcttttggatgagcccgcggcgtattaactagttggtaaggtaacggcttaccaaggtgatgatacgtagccgaactgagaggttgatcggccacattgggactgagacacggcccaaactcctacgggaggcagcagtagggaatcttccacaatggacgcaagtctgatggagcaacgccgcgtgtatgaagaaggtcttcggatcgtaaaatactgttgtcagagaagaacacgtgatagagtaactgctatg

SEQ ID NO: 191 - DNA, 490 bp, Unknown
  Ascusbbf_721637, encodes 16S rRNA
agagtttgatcatggctcagattgaacgctggcggcatgctttacacatgcaagtcggacggcagcgcgggcttcggcctggcggcgagtggcggacgggtgagtaagacatcggaacgtgccacggggtgggggacaaccagccgaaaggttggctaataccgcatggcatccacggattaaagcgggggacccttcggggcctcgcgccctgtgagcggccgatggctgattagctagttggtggggtaacggcctaccaaggcgacgatcagtagctggtctgagaggacgaccagccacattgggactgagacacggcccaaactcctacgggaggcagcagtggggaattttggacaatgggggcaaccctgatccagcaatgccgcgtgagtgaagaaggccttcgggttgtaaagctcttttgtcagggaagaaaagggggcggttaagagctgttcctgctgacggtacctgaagaataagc

SEQ ID NO: 192 - DNA, 490 bp, Unknown
  Ascusbbf_225956, encodes 16S rRNA
agagtttgatcctggctcaggatgaacgctagcggcaggcctaacacatgcaagtcgaacgggatccaccagcttgctggtggtgagagtggcgcacgggtgagtaacgcgtatgcaacctacctcttacagtgggatagcccagagaaatttggattaataccgcatagtatgcacttccggcattgggagtacattaaacattcatgggtaagagatgggcatgcgttctattagttagttggagtggtaacggcaccccaagacagcgatagataggggccctgagagggggatcccccacactggtactgagacacggaccagactcctacgggaggcagcagtgaggaatattggacaatgggcgcaagcctgatccagccatgccgcgtgcaggaagacggccctatgggttgtaaactgcttttatacaggaagaaacacccccacgtgtgggggcttgacggtactgtaggaataaggatcg

SEQ ID NO: 193 - DNA, 490 bp, Unknown
  Ascusbbf_407301, encodes 16S rRNA
agagtttgatcctggctcaggattaacgctggcggcgcacataagacatgcaagtcgaacggaagtcgttattaaaaggagtgaagatttatcggaacaatttttggtaacaatggctttagtggcggactggtgagtaacacgtaagtaacctgcctatcagaggggaataacagtgagaaatcattgctaataccgcataagcttacagtattgcatgatacagtaagaaaaggagaaatccgctgatagatggacttgcggccgattagccagttggtggggtaacggcctaccaaagcaacgatcggtagccgagctgagaggctcaacggccacattgggactgagatacggcccagactcctacgggaggcagcagtcgggaatattgcgcaatggaggaaactctgacgcagtgacgccgcgtataggaagaaggttttcggattgtaaactattttagacagggaagaaattgacagtacct

SEQ ID NO: 194 - DNA, 490 bp, Unknown
  Ascusbbf_1051792, encodes 16S rRNA
agagtttgatcatggctcaggatgaacgctggcggcgtgcataacacattcaagtcgaacggtgaagtttcttcggaaacggatcagtggcggacgggtgagtaacgcgtgagcaacctgccgtatagtgggggataacacagggaaacttgtgctaataccgcataacacacggggatcgcatggtacccgtgtcaaagatttattgctgtacgatgggctcgcgtatgattagacagttggcagggtaacggcctaccaaatcaacgatcattagccgaactgagaggttgaacggccacattggaactgagaaacggtccagactcctacgggaggcagcagtggggaatattgggcaatgggcgaaagcctgacccagcgacgccgcgtgagggaagaaggtcttcggattgtaaacctctttcagcagggaagaagtaagtgacggtacctgcagaagaagtcacggctaactacgtgccagcag

SEQ ID NO: 195 - DNA, 490 bp, Unknown
  Ascusbbf_924463, encodes 16S rRNA
agagtttgatcatggctcaggacgaacgctggcggcgtgcttaacacatgcaagtcgaacggggcttatgtagcttgctagataagcctagtggcaaacgggtgagtaacgcgtaggcaacctgcccctgggacggggacaacatcccgaaagggatgctaataccggatgaagcacgaacctcgcatggggtacgtgctaaaggtgggtcaaaccaccgccgagggatgggcctgcgtctgattagccagttggcggggtaacggcccaccaaagcgacgatcagtagccggtctgagaggatgaacggccacattgggactgagacacggcccagactcctacgggaggcagcagtggggaatcttccgcaatgggcgaaagcctgacggagcaacgccgcgtgagtgatgaaggccttcgggtcgtaaagctctgttgccggggacgagagacggagggaggaaatgctctccgcaggacggtacct

SEQ ID NO: 196 - DNA, 490 bp, Unknown
  Ascusbbf_734811, encodes 16S rRNA
agagtttgatcatggctcaggacgaacgctggcggcatgcctaacacatgcaagtcgaacggagcaaagggggcttgccctctttgcttagtggcggacgggcgagtaacgcgtgagcaacctgcccctcagaggggaataacgtccggaaacggacgctaataccgcataacgcagcgggagcgcatgcttctgctgccaaaggagcaatccgctgagggatgggctcgcgtccgattagctggttggcggggtaacggcccaccaaggcgacgatcggtagccgaactgagaggttgatcggccgcattgggactgagacacggcccagactcctacgggaggcagcagtgggggatattgcacaatggaggaaactctgatgcagcaatgccgcgtgagggaagacggtcttcggattgtaaacctaagtagacaggaacgatgatgacggtacctgtaaagtaagctccggctaactacgtgccag

SEQ ID NO: 197 - DNA, 490 bp, Unknown
  Ascusbbf_734493, encodes 16S rRNA
agagtttgatcctggctcaggacgaacgctggcggcgtgcctaacacatgcaagtcgagcggggacatcgggatagcttgctaaactgatgttccagcggcggacgggtgagtaacgcgtgaacaatctgtcccggacagggggataacacttggaaacaggtgctaataccgcataagcccacgttgtcacatgacagagggggaaaaggaggaatccggttcggggtgagttcgcgtccgattagatagttggtgaggtaacggcccaccaagtcaacgatcggtagccgacctgagagggtgatcggccacattggaactgagacacggtccaaactcctacgggaggcagcagtggggaatattgggcaatgggcgaaagcctgacccagcaacgccgcgtgagggaagaaggttttcggattgtaaacctctgtcctcagggacgaaggaagtgacggtacctgaggaggaagccccggctaact

SEQ ID NO: 198 - DNA, 490 bp, Unknown
  Ascusbbf_264703, encodes 16S rRNA
agagtttgatcatggctcaggatgaacgctggcggcgtgcctaatacatgcaagtcgaacgaattttaaggagcttgctccttgaagttagtggcgaacgggtgaataacacgtaggtaacctgccctttagcttgggatacccagaggaaactttggctaataccggataacaacagaagaggcatctcttcagtttgaaaggccctttacggggtcacttaaggatggacctgcggcgcattagttagttggtgagataacagcccaccaagacgaggatgcgtagccgacctgagagggtgatcggccacataggtactgagacacggacctaactcctacgggaggcagcagtaaggagttttcggcaatgggggaaaccctgaccgagcaacgccgcgtgagtgatgacggccctatgggttgtaaagctctgttagataaggacgaatgactagcttaggaaatgaagttagtttgacggtact

SEQ ID NO: 199 - DNA, 490 bp, Unknown
  Ascusbbf_1804044, encodes 16S rRNA
agagtttgatcctggctcaggataaacgctggcggcgtgcctaatacatgcaagtcgaacgatgaagttctcaagcttgcttgagaatagattagtggcgaacgggtgagtaatacataagcaacctacccatgaagactgggataatctctggaaacggggactaataccggataggtaagcggaccgcatgatctgcttattaaaggttaaaaacactgatggatgggcttatggcgcattagctagttggagaggtaacggctcaccaaggcgatgatgcgtagccggcctgagagggtgaacggccacattgggactgagacacggcccagactcctacgggaggcagcagtagggaattttcggcaatgggggaaaccctgaccgagcaacgccgcgtgagtgctaaggccttcgggttgtaaagctctgttgtaagggaagaacggtatgttgagaaaacataagtgacggtaccttacgagga

SEQ ID NO: 200 - DNA, 490 bp, Unknown
  Ascusbbf_394766, encodes 16S rRNA
agagtttgatcctggctcaggatgaacgctggcggcatgcctaagacatgcaagtcgtacgaggcggcccattgattcagattgagatctggagtgcttgcacaaaggaaggatttctgatgacgtggatcctccgcctagtggcaaacgggtgagtaacacgtgggttacctgcctcatagaccgggataccgtttggaaacgaacgttaataccggatgttgtctacggactaaagggagcctttaaagctccgctatgagatgggcctgcggtgcattagatagttggtgaggtaacggcccaccaagtcgacgatgcatagctgaactgagaggttgatcggccacactgggactgatacacggcccagactcctacgggagacagcagttaggaatattcgtcaatgggggaaaccctgaacgagcaatgccgcgtgaatgatgaaggccctatgggttgtaaaattctgttgtttgggaagaac

SEQ ID NO: 201 - DNA, 490 bp, Unknown
  Ascusbbf_61588, encodes 16S rRNA
agagtttgatcatggctcaggatgaacgctagcggcaggcctaacacatgcaagtcgaggggtagagttagcttgctaacttgagaccggcgcacgggtgcgtaacgcgtatgcaatctaccttatactgagggatagcccggagaaatccggattaataccttatagttaataaaaaaggcatcttttatattataaagatttattggtataagatgagcatgcgtcccattagttagttggtgtggtaacggcacaccaagacgatgatgggtaggggtcctgagagggagatcccccacactggtactgagacacggaccagactcctacgggaggcagcagtgaggaatattggtcaatggaggcaactctgaaccagccatgccgcgtgcaggatgacggtcctatggattgtaaactgcttttgtacaggaagaaaaagagttacgtgtagcttattgacggtactgtaagaataaggatcggc

SEQ ID NO: 202 - DNA, 490 bp, Unknown
  Ascusbbf_101282, encodes 16S rRNA
agagtttgatcctggctcaggacgaacgctggcggcgtgcttaacacatgcaagtcgaacggaagtatatattaagcttgctttttgtatactttagtggcggacgggtgagtaacgcgtgaggacttgtccactccagggggacaacagttggaaacagctgctaataccccataagcctaagggttaaaggagcaatccgggagaggagagactcgcgtcctatcagctagtaggtgagataatggctcacctaggctaagacgggtaaccggactgagaggtcgaacggtcacactggaactgagacacggtccagactcctacgggaggcagcagtggggaatcttgggcaatgggggcaaccctgacccagcgacgccgcgtgggtgaagaaattcttcggaatgtaaagccctgttgtatgggaagataatgacggtaccataccagaaagccccggcaaactacgtgccagcagccgcggtaa

SEQ ID NO: 203 - DNA, 490 bp, Unknown
  Ascusbbf_360670, encodes 16S rRNA
agagtttgatcctggctcaggatgaacgctagcggcaggcctaacacatgcaagtcgaggggtaagaggcattagcttcctagaccggcgtacgggtgcgtaacgcgtatacaatctaccttttacttagggatagcccggagaaatttggattaatacctaatagtactatataacggcatcgttatatagttaaagcgttagtggtaagagatgagtatgcgtcctattagctagttggtaaggtaacggcttaccaaggctacgataggtaggggtcctgagagggagatcccccacactggtactgagacacggaccagactcctacgggaggcagcagtgaggaatattggtcaatgggcggaagcctgaaccagccatgccgcgtgcaggaagacggccttatgggttgtaaactgcttttgtaagggaagaataatctttacgtgtagagagatgacggtaccttatgaataagcatcggcta

SEQ ID NO: 204 - DNA, 490 bp, Unknown
  Ascusbbf_431634, encodes 16S rRNA
agagtttgatcatggctcaggatgaacgctggcggcgtgcctaacacatgcaagtcgaacgaagctgcgaggaaggagacttcggtcaacggaattgtagacttagtggcggacgggtgagtaacgcgtgagcaacctgcctcagagtgggggacaacagctggaaacggctgctaataccgcatgacatttaaggaaggcatcttctttaaatcaaagcttaatgtgctctgagatgggctcgcgtctgattagctagatggtgaggtaatggctcaccatggcgacgatcagtagccggactgagaggttgaacggccacattgggactgagatacggcccagactcctacgggaggcagcagtggggaatattggtcaatgggggaaaccctgaaccagcaacgccgcgtgaaggaagaaggctttcgggttgtaaacttcttttatctgagacgatagtgacggtatcagatgaataagctacggc

SEQ ID NO: 205 - DNA, 490 bp, Unknown
  Ascusbbf_36008, encodes 16S rRNA
agagtttgatcatggctcaggatgaacgctggcggcgtgcataacacattcaagtcgaacggtgaagtcccttcggggacggatcagtggcggacgggtgagtaacgcgtgagcaacctgccatacagtgggggataacacagggaaacttgtgctaataccgcatgacacatcgggatcgcatgtttctgatgtcaaagagcaattgctgtatgatgggctcgcgtatgattagacagttggcagggtaacggcctaccaaatccacgatcattagccgaactgagaggttgaacggccacattggaactgagaaacggtccagactcctacgggaggcagcagtggggaatattgggcaatgggcgaaagcctgacccagcgacgccgcgtgagggaagaaggtcttcggattgtaaacctctttcagcagggaagaaggaagtgacggtacctgcagaagaagtcacggctaactacgtgccagcag

SEQ ID NO: 206 - DNA, 490 bp, Unknown
  Ascusbbf_20210, encodes 16S rRNA
agagtttgatcctggctcaggatgaacgctggcggcgtgcctaacacatgcaagtcgaacgaagcgtcccgcccgaagagaaggagtgcttgcacaaatttaattcaattggggcgacttagtggcggacgggtgagtaacgcgtgggtaacctgccttatacagggggataacagttagaaatgactgctaataccgcataagcgcacagaatcgcatgatacagtgtgaaaagccgagacggtataagatggacccgcgtctgattagccagttggcagggtaacggcctaccaaagcgacgatcagtagccggcctgagagggtgaacggccacattgggactgagacacggcccaaactcctacgggaggcagcagtgggggatattgcacaatgggggaaaccctgatgcagcgacgccgcgtgagcgaagaagtatttcggtatgtaaagctctatcagcagggaagaaaatgacggtacctga

SEQ ID NO: 207 - DNA, 490 bp, Unknown
  Ascusbbf_1901558, encodes 16S rRNA
agagtttgatcatggctcaggacgaacgctggcggcgtgcttaacacatgcaagtcgaacggggcgattgaaagcttgcttttatgagcctagtggcaaacgggtgagtaacgcgtgggcaacctaccggaaagatggggacaacatcccgaaaggggtgctaataccgaatgttgtacaggggacgcatgttccttgtattaaaggattttatccgctttccgatgggcccgcgtccgattagctagttgggggggtagcggcccaccaaggcgacgatcggtagccggcctgagagggtggacggccacattgggactgagacacggcccagactcctacgggaggcagcagtggggaatcttccgcaatgggcgcaagcctgacggagcaacgccgcgtgagtgaagaaggccttcgggccgtaaagctctgttgccggggaagagtggcaggaggggactcctgcagggacggtacccggcgagga

SEQ ID NO: 208 - DNA, 490 bp, Unknown
  Ascusbbf_6729, encodes 16S rRNA
agagtttgatcctggctcagattgaacgctggcggcatgccttacacatgcaagtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtgaggtaaaggctcaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaat

SEQ ID NO: 209 - DNA, 490 bp, Unknown
  Ascusbbf_2122, encodes 16S rRNA
agagtttgatcatggctcagaacgaacgctggcggcatggattaggcatgcaagtcgaacggtgcagcaatgcatagtggcgcaagggtgaggaacgcgtgagtaatctgccctcaagttgggaacagcttctggaaacggaaattaataccgaatgtgatctcagggaggcatctttctgggattaaaggccgcaaggtcgcttgaggaggggctcgcgtcccattatgctagttggtgaggtaacggcccaccaaggcgaagatgggtagctggtctgagaggacgatcagccacactgggactgagaactgcccagactcctacgggaggctgcagtcgagaattttgggcaatggacgaaagtctgacccagcaatgccgcgtgcgggatgaaggtcttcggattgtaaaccgctgtcaagtgggacgaaacaaatgacggtaccgctgaaggaagtcacggctaactacgtgccagcagccgcgg

SEQ ID NO: 210 - DNA, 490 bp, Unknown
  Ascusbbf_56285, encodes 16S rRNA
agagtttgatcctggctcaggacgaacgctggcggcgcgcctaacacatgcaagtcgaacgggactagtgaccggagtgcagagaggatctgtgttgcgatcactagttcagtggcggacgggtgagtaaagcatgagcaacctggctactagagggggatagcttttggaaacagaagataataccgcatacatcaaagatttcgcatgagatttttggaaaaggagcaatccgctaatagatgggctcatgtccgattagctagttggtagggtaaaggcctaccaaggcgacgatcggtagccgtactgagaggttcaacggccacattgggactgagacacggcccagactcctacgggaggcagcagtgaggaatattgcgcaatggagggaactctgacgcagcgacgccgcgtgagggaagaaggttttcgaattgtaaacctctgtcctcagggaagaaaagaatgacggtacctggggagg

SEQ ID NO: 211 - DNA, 490 bp, Unknown
  Ascusbbf_70836, encodes 16S rRNA
agagtttgatcctggctcaggatgaacgctagcggcaggcttaacacatgcaagtcgaggggcagcgagatgtagcaatacattgtcggcgaccggcgcacgggtgcgtaacgcgtatgcaacctaccatatacaggaggataaccattcgaaagaatgactaatactccatagtattattttgaggcatcttagaataattaaagaatttcggtatatgctgggcatgcgtgacattagctagttggagaggtaacggctcaccaaggctacgatgtctaggggttttgagaggaagatcccccacactggtactgagacacggaccagactcctacgggaggcagcagtgaggaatattggtcaatggacggaagtctgaaccagccatgccgcgtgaaggaagactgccctatgggttgtaaacttcttttatacggggataaacctatctttgcgaagatagctgaaggtaccgtatgaataagca

SEQ ID NO: 212 - DNA, 490 bp, Unknown
  Ascusbbf_31846, encodes 16S rRNA
agagtttgatcctggctcaggatgaacgctggcggcgtgcctaacacatgcaagtcgagcgagaagctcatgatcgaaacttcggttgattgattgagtggaaagcggcggacgggtgagtaacgcgtaggcaacctgccccttgcagagggatagcctcgggaaaccgggattaaaacctcataatgcagaagagagacatctttcctctgccaaagatttatcggcaagggatgggcctgcgtctgattagttagttggtggggtaacggcctaccaaggcagcgatcagtagccgacctgagagggtgatcggccacattggaactgagacacggtccaaactcctacgggaggcagcagtggggaatattgcacaatgggcgaaagcctgatgcagcaacgccgcgtgaaggatgaaggcccttgggtcgtaaacttctgttctaagggaagataatgacggtaccttaggagcaagtcccggcta

SEQ ID NO: 213 - DNA, 490 bp, Unknown
  Ascusbbf_160461, encodes 16S rRNA
agagtttgatcatggctcaggatgaacgctagcggcaggcctaacacatgcaagtcgaggggtagaacacttcggtgtttgagaccggcgcacgggtgcgtaacgcgtatgcaatctaccttgtacagagggatagcccagagaaatttggattaatacctcatagtataatttaatggcatcatttgattattaaagttccaacggtacaagatgagcatgcgtcccattagttagttggtgtggtaacggcacaccaagacgatgatgggtaggggtcctgagagggagatcccccacactggtactgagacacggaccagactcctacgggaggcagcagtgaggaatattggtcaatggaggcaactctgaaccagccatgccgcgtgcaggaagacggttctatggattgtaaactgcttttgtacaggaagaaattatccctcgtgagggagcttgacagtactgtaagaataaggatcggcta

SEQ ID NO: 214 - DNA, 490 bp, Unknown
  Ascusbbf_57053, encodes 16S rRNA
agagtttgatcctggctcaggatgaacgctagcgggaggcctaacacatgcaagccgagcggtagaagtccttcgggactttgagagcggcgtacgggtgcgtaacacgtgtgcaacctgcctttatctgggggatagcctttcgaaaggaagattaataccccataatatagtgactggcatcagttactattgaaaactccggtggatagagatgggcacgcgcaagattagatagttggtgaggtaacggctcaccaagtctgtgatctttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtacagggataaacccagatacgtgtatctggctgaaggtactgtacgaataagcaccggct

SEQ ID NO: 215 - DNA, 490 bp, Unknown
  Ascusbbf_7025, encodes 16S rRNA
agagtttgatcctggctcaggatgaacgctggcggcgtgcttaacacatgcaagtcgaacggagagatattacagaagttttcggatggaagtgatagatcttagtggcggacgggtgagtaacgcgtaaacaatctgccttagagagggggacaacagatagaaatatctgctaataccgcataagaccacaggtaggcatctactaggggtaaaaggagaaatccactttaagatgagtttgcgtactattagctagttggtgaggtaacggcccaccaaggcgacgatggttagccggcctgagagggtgaacggccacattggaactgagatacggtccagactcctacgggaggcagcagtgaggaatattgggcaatgggcgaaagcctgacccagcaacgccgcgtgaaggaagaaggttttaggattgtaaacttctgttgtaagggaaaaagaaagtgatggtaccttacgaggaagctac

SEQ ID NO: 216 - DNA, 490 bp, Unknown
  Ascusbbf_27749, encodes 16S rRNA
agagtttgatcatggctcagattgaacgctggcggcacgcctaacacatgcaagtcgagcggtaacagtagtagtagcaatactattagctgacgagcggcggacgggtgaggaacacgtaggaacctaccctcaagcgggggatacccaagggaaactttggttaataccgcatagattcgagagaggaaagttgccgagaggtgacacttgaggaagggcctgcgtccgattagctagttggtggggtaagagcttaccaaggcgatgatcggtaactggtctgagaggacgaccagtcacactgggactgagacacggcccagactcctacgggaggcagcagtggggaatattggacaatgggggcaaccctgatccagcgatgccgcgtgagtgaagaaggccctcgggtcgtaaagctctttaggtcaggaagaaggttattggaggataatgctgataacttgacggtactgacagaataagc

SEQ ID NO: 217 - DNA, 490 bp, Unknown
  Ascusbbf_13225, encodes 16S rRNA
agagtttgatcatggctcagaacgaacgctggcggcgcgtcttaagcatgcaagtcgagcggtaaggaggtagcttgctacttccctagagcggcggactggtgagtaacgcgtgggtgacgtaccctttggttggggatagccggtagaaataccgggtaataccgaataagacctctgatagaaagatcagagaggaaagcggctccggccgcgccgaaggaacggcccgcgtactattagctggttggtgaggtaacggcccaccaaggcgacgatagttatccggcctaagagggtgaacggacacattgggactgagatacggcccagactcctacgggaggcagcagctaagaatattccgcaatggggggaaccctgacggagcgacgccgcgtggatgatgaaggccggaaggttgtaaagtccttttgagtgtgatgaataaagcctgcagggaatggcaggaagatgaccgtagcacttg

SEQ ID NO: 218 - DNA, 470 bp, Unknown
  Ascusbbf_952514, encodes 16S rRNA
agagtttgatcctggctcagaacgaacgctggcggcaggcctaacacatgcaagtcgagcgctctcttcggagagagcggcagacgggtgagtaacgcgtgggaacgtgcccgaaggtacggaacaaccgctggaaacggcgactgataccgtatgtcccctgagggggaaagatttatcgccttcggatcggcccgcgtcggattagctagttggcggggtaacggcccaccaaggcgacgatccgtagctggtttgagaggatgatcagccacactgggactgagacacggcccagactcctacgggaggcagcagtggggaatcttggacaatgggggcaaccctgatccagccatgccgcgtgagcgatgaaggccttagggttgtaaagctctttcacccgtgaagataatgacggtagcgggagaagaagccccggctaactccatgccagcagccgcggtaat

SEQ ID NO: 219 - DNA, 490 bp, Unknown
  Ascusbbf_1372257, encodes 16S rRNA
agagtttgatcctggctcaggacgaacgctggcggcgtgcttaacacatgcaagtcgaacggtaaggccctttcgggggtacacgagtggcgaacgggtgagtaacacgtgggtaatctgccctgcacttcggtataagcctgggaaactgggtctaataccggatatgagctctcaccgcatggtgggggttggaaagtttttcggtgcaggatgagcccgcggcctatcagcttgttggtggggtaatggcctaccaaggcgacgacgggtagccggcctgagagggtgatcggccacagtgggaaggggacacggcacagactcgtacgggaggcagcagaggggaatattgcacaatgggcggaagccggatgcagcgaggccgcgtgggggatgacggtcttcggattgtaaacccctttcagtagggacgaagcgcaagtgacggtacctgcagaagaagcaccggccaactacgtgccagcag

SEQ ID NO: 220 - DNA, 490 bp, Unknown
  Ascusbbf_778268, encodes 16S rRNA
agagtttgatcctggctcagattgaacgctggcggcaggcttaacacatgcaagtcgagcggtaacaggtccagcttgctggatgctgacgagcggcggacgggtgagtaatgcataggaatctgcccggtagtgggggataacctggggaaacccaggctaataccgcatacgtcctacgggagaaagcaggggaccttcgggctttgcgctatcggatgagcctatgccggattagctagttggtgaggtaatggctcaccaaggcagcgatccgtagctggtctgagaggatgatcagccacactgggactgagacacggcccagactcctacgggaggcagcagtggggaatattggacaatgggggcaaccctgatccagccatgccgcgtgtgtgaagaaggctttcgggttgtaaagcactttcagcggggaagaaggccttcgggataataccccggaggaaggacatcacccgcagaagaa

SEQ ID NO: 221 - DNA, 490 bp, Unknown
  Ascusbbf_813581, encodes 16S rRNA
agagtttgatcatggctcaggatgaacgctagcggcaggcctaacacatgcaagtcgaggggcagcgatctgtgcttgcacagagtcggcgaccggcgcacgggtgcgcaacgcgtatggaacctgcccgttacgggggaatagcccggggaaacccggattaatgccccatgttgaccttgcgcggcatcgcgctaggtccaaaggcttcggccggtaacggatggccatgcgtaccattagcaagttggcggggtaacggcccaccaatgctacgatggttaggggccctgagaggggggccccccacactggtactgagacacggaccagactcctacgggaggcagcagtgaggaatattggacaatgggcgggagcctgatccagccatgccgcgtgcgggaagaaggccctacgggtcgtaaaccgcttttgtacgggaagaacgaggggcacgcgtgcccccttgacggtaccgtaagaataa

SEQ ID NO: 222 - DNA, 490 bp, Unknown
  Ascusbbf_21628, encodes 16S rRNA
agagtttgatcctggctcaggacgaacgctggcggcgtgcttcatacatgcaagtcgaacgagaagcagtcttcggactgtggaaagtggcggacgggtgagtaatatgtagagaatctgccctagagcgggggacaacagttggaaacgactgctaataccccatatgcgcgtacttgagatagtattcgtgaaaactccggtgctctaggatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatgggggaaaccctgacgcagcaacgccgcgtgattgaataagcccttcggggtgtaaagatctgtcagtggggacgaaacttgacggtacccacagaggaagcatcggctaactccgtgccagcagccgcg

SEQ ID NO: 223 - DNA, 490 bp, Unknown
  Ascusbbf_7920, encodes 16S rRNA
agagtttgatcatggctcaggacgaacgctggcggcgtgcttaacacatgcaagtcgaacggagttagacgctggattgatgccagcttgctggtggatttccttgtctaacttagtggcggacgggtgagtaacgcgtgagtaacctgccctcgagtggggaataacgttctgaaaagatcgctaataccgcataacacatactggtcgcatggtcggtatgtcaaagatttatcgctcgaggatggactcgcgtccgattagcttgttggcggggtaacggcccaccaaggcgacgatcggtagccggactgagaggttgaacggccacattgggactgagacacggcccagactcctacgggaggcagcagtgggggatattgcgcaatgggggaaaccctgacgcagcaacgccgcgtggaggatgacggttttcggattgtaaactccttttatgggggacgaactaagacggtaccccatgaat

SEQ ID NO: 224 - DNA, 490 bp, Unknown
  Ascusbbf_27321, encodes 16S rRNA
agagtttgatcatggctcaggatgaacgctagctacaggcttaacacatgcaagtcgaggggcagcacgggagttgcttgcaacttctggtggcgaccggcgaatgggtgagtaacgcgtatccaacctgccctgtgcccgggaatagcccttggaaacgaggattaacgcccgatggcgtgcattgaccgcatgggaaatgcactaaatgcgaaggcacgggatggggatgcgttccattaggttgttggcggggtaacggcccaccaagccttcgatggataggggttctgagaggaaggtcccccacattggaactgagacacggtccaaactcctacgggaggcagcagtgaggaatattggtcaatgggcggaagcctgaaccagccaagtagcgtgagggatgacggccctacgggttgtaaacctcttttatgcggggataaagtgctccacgcgtggagttttgcaggtaccgcatgaataa

SEQ ID NO: 225 - DNA, 490 bp, Unknown
  Ascusbbf_44947, encodes 16S rRNA
agagtttgatcctggctcagattgaacgctggcggcaggcttaacacatgcaagtcgaacgatgatgtctagcttgctagacggattagtggcgaacgggtgagtaatgcttaggaatctgcctggtagtgggggacaacattccgaaaggaatgctaataccgcatacgacctacgggtgaaagggggcgcaagctctcgctatcagatgagcctaagtcggattagctagttggtggggtaaaggcctaccaaggcgacgatctgtagctggtcttagaggatgatcagccacactgggactgagacacggcccagactcctacgggaggcagcagtggggaatattggacaatgggcgaaagcctgatccagccatgccgcgtgtgtgaagaaggccttttggttgtaaagcactttaagtggggaggaaaagcttgtggttaatacccacaagccctgacgttacccacagaataagcaccggcta

SEQ ID NO: 226 - DNA, 490 bp, Unknown
  Ascusbbf_65370, encodes 16S rRNA
agagtttgatcctggctcaggacgaacgctggcggcgtgcctaacacatgcaagtcgagcggaggtagacaaggagtaatctgagtttaccttagcggcggacgggtgagtaacgcgtgagcaacctgcctttcacagggggataaggcggcgaaagccgctctaataccgcatgagaccacggtgatgatattacaggggtcaaaggagcaatccggtgaaagatgggctcgcgtccgattaggtagttggtggggtagaggctcaccaagccaatgatcggtagccggcctgagagggtgaacggccacattggaactgagagacggtccaaactcctacgggaggcagcagtggggaatattgggcaatgggcgaaagcctgacccagcaacgccgcgtgaaggaagaaggttttcggattgtaaacttctgttcttggggaagagaagaagacggtacccaaggaggaagccccggctaactacgt

SEQ ID NO: 227 - DNA, 490 bp, Unknown
  Ascusbbf_105858, encodes 16S rRNA
agagtttgatcctggctcagattgaacgctggcggcatgctttacacatgcaagtcgaacggcagcgggggtttaagcttgcttaaacctgccggcgagtggcgaacgggtgagtacaacatcggaacgtgtccgtttgtgggggacaactgctcgaaagggtagctaataccgcataagacctgagggtgaaagtgggggatcgcaagacctcacgcgaacggagcggccgatgactgattaggtagttggtgaggtaaaggcccaccaagccgacgatcagtagctggtctgagaggacgaccagccacactggaactgagacacggtccagactcctacgggaggcagcagtggggaattttggacaatgggggaaaccctgatccagccatgccgcgtgcgggaagaaggccttcgggttgtaaaccgcttttgtcagggacgaaaagtcgtatttaaataaagtacgatgctgacggtacctgaa

SEQ ID NO: 228 - DNA, 490 bp, Unknown
  Ascusbbf_122105, encodes 16S rRNA
agagtttgatcatggctcaggacgaacgctggcggcgtgcctaacacatgcaagtcgaacggggtccaagagagcttgctctcggaagacctagtggcgaacgggtgagtaacacgtgagaaacctgcctcggagtggggaataactcggggaaactcgagctaataccgcataccttcagacggtcgcatggctgactgaagaaagaatttcgctctgagagggtctcgcggcctatcagcttgttggtggggtaatggcctaccaaggcaacgacgggtagctggattgagagatcgatcagccacactggaactgagacacggtccagactcctacgggaggcagcagtggggaatcttgcgcaatgggcgaaagcctgacgcagcaacgccgcgtgcgggatgacggccttcgtggttgtaaaccgctttcagcagggacgaaaatgacggtacctgcagaagaagccccggctaactacgtgcca

SEQ ID NO: 229 - DNA, 487 bp, Unknown
  Ascusbbf_234273, encodes 16S rRNA
agagtttgatcctggctcaggatgaacgctggcggcgtgcctaacacatgcaagtcgagcgaggacttcggtcctagcggcggacgggtgagtaacgcgtgggtaatctgcctcatacacacggataacataccgaaaggtatgctaatacgagataatattaagaaatggcatcatttcttaatcaaagaatttcggtatgagatgagcccgcgtcccattagctagttggtaaggtaaaagcttaccaaggcgacgatgggtagccgacctgagagggtgatcggccacactggaactgagacacggtccagactcctacgggaggcagcagtggggaatattgcacaatgggcgaaagcctgatgcagcaacgccgcgtgagcgatgaaggtcttcggatcgtaaagctctgtcctcaaggaagaattttgacggtacttgaggaggaagccccggctaactacgtgccagcagccgcggtaat

SEQ ID NO: 230 - DNA, 490 bp, Unknown
  Ascusbbf_150424, encodes 16S rRNA
agagtttgatcatggctcaggacgaacgctggcggcgtggattaggcatgcaagtcgagcgatatccaaccttcgggttggtgaaagcggcgaacgggtgagtaacacgtgaacaacctgccctcacattccggataatagaccgaaaggtcttgtaatacgggcgaggattctcctttggcatcttaggagaagggaaggcgcaagccgtgcgaggaggggttcgcggattatcaggtagatggtggggtaacggcctaccatgccgacgacgattagctggtctgagaggatggtcagccacactgggactgagacactgcccagactcctacgggaggctgcagtcgagaatcttgcacaatgtacgaaagtatgatgcagcgacgccgcgtgaaggatgaaggcccttgggtcgtaaacttcttttatcggggaagaataaatgacggtacccgatgaataagccacggctaactacgtgccagca

SEQ ID NO: 231 - DNA, 490 bp, Unknown
  Ascusbbf_1571154, encodes 16S rRNA
agagtttgatcctggctcagaacgaacgctggcggcgcgtcttaagcatgcaagtcgaacgagaatctttagcttgctaaagaggaaagtggcggacgggtgagtaaaatgtagagaatctgccctagagagtgggacaacagagggaaacttctgctaataccgcatatgcgcgtatctgaaatggtattcgtgaaaactccggtgctctgggatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatgggggaaaccctgacgcagcaacgccgcgtgattgaaaaagcccttcggggtgtaaagatctgtcagtggggacgaaacttgacggtacccacagaggaagcatcggctaactccgtgccagcagccg

SEQ ID NO: 232 - DNA, 490 bp, Unknown
  Ascusbbf_12241, encodes 16S rRNA
agagtttgatcatggctcaggatgaacgctagctacaggcttaacacatgcaagtcgaggggtaacaggagggaagcttgctttcctcgctgacgaccggcgaatgggtgagtaacgcgtatccaacctgccgcacgcccgggaacagcccttggaaacgaggattaaatcccgataccttgcccttccgcatgaaggggcaagaaaacaggcatgcgatggggatgcgtctgattagcttgttggcggggtaacggcccaccaaggcgacgatcagtaggggttctgagaggaaggtcccccacattggaactgagacacggtccaaactcctacgggaggcagcagtgaggaatattggtcaatgggcgagagcctgaaccagccaagtagcgtgagggatgactgccctacgggttgtaaacctcttttgtccaggaataaaaaaggcctcgtgaggcctcttgcaggtactggttgaataaggacc

SEQ ID NO: 233 - DNA, 490 bp, Unknown
  Ascusbbf_2630, encodes 16S rRNA
agagtttgatcatggctcagaatgaacgttggcggcatggattaggcatgcaagtcgtacggtgaaggggagcttgctcctccgatcagtggcgaaagggatagtaacgcgtagacacctaccttctggacggggatagctgcgggaaactgcaggtaatacccgataatgacgagagtccaaaggtgtaattccttcagaagacggatctgcgtcctaccagatagttggcggggtaacggcccaccaagtctaagacgggtagcgggtgtgagagcatgacccgcatcactgggactgagacactgcccagacacctacgggtggctgcagtcgagaatcttcgtcaatgggcgaaagcctgaacgagcgatgccgcgtgcgggatggaggccttcgggttgtaaaccgctgtcgaattggaggaaatgcatagtgtagaattatgcttgactgatagtagaaggaaggacgggctaagttcgtgcca

SEQ ID NO: 234 - DNA, 490 bp, Unknown
  Ascusbbf_8430, encodes 16S rRNA
agagtttgatcatggctcaggacgaacgctggcggcgtgcctaatacatgcaagtcgagcgaatctgatgggagcttgctccctgatgattagcggcggacgggtgagtaacacgtgggtaacctgcctgtaagactgggataactccgggaaaccggggctaataccggataacttttttcttcgcatgagggagaattgaaagatggcctcggctatcacttacagatggacccgcggcgcattagctagttggtgaggtaacggctcaccaaggcgacgatgcgtagccgacttgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatcgttcgaatagggcggtaccttgacggtac

SEQ ID NO: 235 - DNA, 490 bp, Unknown
  Ascusbbf_5064, encodes 16S rRNA
agagtttgatcctggctcaggataaacgctggcggcgcacataagacatgcaagtcgaacgaacttaattcattcttttagattgaaagcggttagtggcggactggtgagtacaacataagcaacctgcctgtaagaggggaacaacagttagaaatgactgctaataccgcatatgccatagtaaccacatggttacagtgggaaaggagcaatccgcttatagatgggcttatgcctgattagctagttggtggggtaacggcctaccaaggcgacgatcagtagccgaactgagaggttaaacggccacattgggactgagatacggcccagactcctacgggaggcagcagtcgggaatattgcgcaatggaggaaactctgacgcagtgacgccgcgtgcaggaagaaggttttcggattgtaaactgctttagacagggaagaaaaaagacagtacctgtagaataagctccggctaactacg

SEQ ID NO: 236 - DNA, 490 bp, Unknown
  Ascusbbf_11976, encodes 16S rRNA
agagtttgatcatggctcagaacgaacgctggcggcgcgtcttaagcatgcaagtcggacggcaagatgagagcttgctctcatcctagagtggcggactggtgagtaacacgtgggtgacgtacccccgggacggggatagctcctagaaataggagataataccggatacgaccgcagacgtagaggtctgcgaggaaaggagctctggctccgcccggggaacggcctgcggcccattagctagttggtgtggtaacggcataccaaggcgatgatgggtatccggcctgagagggtgaacggacacattgggactgagatacggcccagactcctacgggaggcagcagctaagaatattccgcaatggacgaaagtctgacggagcgacgccgcgtggatgaagaaggccggaaggttgtaaaatccttttaaacgggaagaataagccttgcagggaatggcagggtggtgacggtaccgtttg

SEQ ID NO: 237 - DNA, 490 bp, Unknown
  Ascusbbf_32755, encodes 16S rRNA
agagtttgatcctggctcaggatgaacgctggcggcgtgcctaatacatgcaagtcgagcggtaaggctttcactctgtattcaaagctttgaatatagtgtgaaagtacacgagcggcggacgggtgagtaacacgtgggaatctaccccaaactgagggataagcatcggaaacggtgtctaataccgcatatggtcttcggattaaagcttcggcggtttgggaagagcccgcgcaagattagctagttggtaaggtaatggcttaccaaggcgacgatctttagctggtttgagaggatgatcagccacactggaactgagacacggtccagactcctacgggaggcagcagtaaggaattttccacaatgggggcaaccctgatggagcaacgccgcgtgcaggatgaatgccttcgggttgtaaactgcttttataagtgaagaatatgacggtaacttatgaataaggatcggctaactccgt

SEQ ID NO: 238 - DNA, 490 bp, Unknown
  Ascusbbf_462272, encodes 16S rRNA
agagtttgatcctggctcaggacgaacgctggcggtatgcttaacacatgcaagtcgaacgagacaagatggaagtgcttgcacggaaatcttagaaagtggcgaacgggtgagtaacgcgtgggtaacctgccctatggaaaggaatagcctcgggaaactgggagtaatgccttataatatagtgaagtcgcatggctttgctattaaacgctccggtgccataggatggacccgcgtcccattagctagttggtgagataacagcccaccaaggcgacgatgggtaaccggtctgagagggcgaacggtcacactggaactgagacacggtccagactcctacgggaggcagcagtggggaatattgcgcaatgggggaaaccctgacgcagcaataccgcgtgagtgaagaaggttttcggatcgtaaagctctgttattggggaagaaaaaaagacggtacccaagaagaaagtcccggctaact

SEQ ID NO: 239 - DNA, 490 bp, Unknown
  Ascusbbf_1595610, encodes 16S rRNA
agagtttgatcatggctcaggacgaacgctggcggtatgcttaacacatgcaagtcgaacgagacgagatggaatgatccttcgggagaatgaaatcttagaaagtggcgaacgggtgagtaacgcgtgggtaacctgccctatggaaaggaatagcctcgggaaactgggagtaatgccttataagatacgtttgtcgcatggcagatgtattaaacgctccggtgccataggatggacccgcgtcccattagctagttggtgagataacagcccaccaaggcgacgatgggtagccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaagctctgttattggggaagaaaaaagacggtacccaaggagaaagtcccggc

SEQ ID NO: 240 - DNA, 490 bp, Unknown
  Ascusbbf_171733, encodes 16S rRNA
agagtttgatcctggctcaggacgaacgctggcggcgcgcctaacacatgcaagtcgaacggaacccttactgagaaattttcggatggatcgggaaggcgtttagtggcggacgggtgagtaacacgtgagcaacctgcctttcagagggggataacagttggaaacgactgctaataccgcataatataccgagacggcatcgtcatggtatcaaaggagcaatccgctgaaagatgggctcgcggccgattagctagttggtgaggtaaaggcccaccaaggcgacgatcggtagccggactgagaggttgaacggccacattgggactgagacacggcccagactcctacgggaggcagcagtgggggatattgcacaatgggcgaaagcctgatgcagcgacgccgcgtgagggaagacggttttcggattgtaaacctctgtcttaagggaagaaaatgacggtaccttaagaggaagctccgg

SEQ ID NO: 241 - DNA, 490 bp, Unknown
  Ascusbbf_335222, encodes 16S rRNA
agagtttgatcctggctcaggatgaacgctgacagaatgcttaacacatgcaagtcgatggggaagcggtgcttgcaccgtggtaaccatggcggacgggtgagtaacgcgtaaagaacttaccttttggactgggataacagagggaaacttctgctaaaactggatggagttaatatgtagcattatgtattaatgaaaaggaatgccaagagagagctttgcgtcctattagctagttggtggggtaaaggcttaccaaggcgatgataggtagccggcctgagagggtgaacggccacaaggggactgagatacggcccttactcctacgggaggcagcagtggggaatattggacaatggagggaactctgatccagcaattctgtgtgcacgaagacggttttcggattgtaaagtgcttttattagggaagaagaaagtgacggtacctaaggaataagcgacggctaaatacgtgccagcag

SEQ ID NO: 242 - DNA, 490 bp, Unknown
  Ascusbbf_57546, encodes 16S rRNA
agagtttgatcctggctcagattgaacgctagcgggatgctttacacatgcaagtcgaacggcagcgcgagaaaagcttgcttttcttggcggcgagtggcgaacgggtgagtaatatatcggaacgtgcccagtagcgggggataactacgcgaaagcgtggctaataccgcatacgccctacgggggaaagggggggatcgcaagacctctcactattggagcggccgatatcagattagctagttggtggggtaaaggcctaccaaggccacgatctgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcagggaagaaacggcgctgaataatacttggcgcaactgacggtacctgcaga

SEQ ID NO: 243 - DNA, 490 bp, Unknown
  Ascusbbf_25556, encodes 16S rRNA
agagtttgatcatggctcaggatgaacgctggcggcgtgcttaacacatgcaagtcgagcgagaagctcataagtgattcttcggatgaacgagtgagtggaaagcggcggacgggtgagtaacgcgtaggcaacctgccccgtacaaagggatagctactggaaacggtaattaatacctcataacgcagaggcatcgcatggtgcttttgccaaagatttatcggtatgggatgggcctgcgtctgattagcttgttggtgaggtaacggctcaccaaggcgacgatcagtagccgacctgagagggtaaacggccacattggaactgagacacggtccaaactcctacgggaggcagcagtggggaatattgcacaatgggggaaaccctgatgcagcaacgccgcgtgagcgaagaaggcctttgggtcgtaaagctctgtcctgaaggaagaaggaagtgacggtacttcaggaggaagccccgg

SEQ ID NO: 244 - DNA, 490 bp, Unknown
  Ascusbbf_23638, encodes 16S rRNA
agagtttgatcctggctcaggatgaacgctggcggcgtgcctaacacatgcaagtcgagcggagatacatgtctaggagatttcggtcgaattaattgtatcttagcggcggatgggtgaggaacgcgtggagaacctgcccttcacagggggataacagctggaaacggctgttaataccgcatatgctcacaggatcgcatgatccagggaggaaagccgagacggtgaaggatggctccgcgtcggattagccagttggcggggtaacggcccaccaaagcgatgatccgtagccggcctgagagggcgaccggccacattgggactgagacacggcccaaactcctacgggaggcagcagtgggggatattgcacaatgggggaaaccctgatgcagcgacgccgcgtgaaggaggaagtgcttcggcatgtaaacttctatcagcagggaagaagatgacggtacctgactaagaagccccggct

SEQ ID NO: 245 - DNA, 490 bp, Unknown
  Ascusbbf_12234, encodes 16S rRNA
agagtttgatcatggctcaggatgaacgctggcggcgtgcctaacacatgcaagtcgaacgggactgtttagtgatgatttcggtctgaactttacagtttagtggcggacgggtgagtaacgcgtggataacctgcctttcacagggggatagcagctggaaacggctggtaataccgcatacgctctttacaccgcatggtgcagagaggaaagatttatcggtgaaagatggatccgcgtctgattagccagttggcggggtaacggcccaccaaagcgacgatcagtagccggcctgagagggcggacggccacattgggactgagacacggcccagactcctacgggaggcagcagtgggggatattgcacaatgggcgcaagcctgatgcagcgacgccgcgtgagtgaagaagtatttcggtatgtaaagctctatcagcagggaagaaaggcccttttagggagatgacggtacctgactaa

SEQ ID NO: 246 - DNA, 490 bp, Unknown
  Ascusbbf_530002, encodes 16S rRNA
agagtttgatcctggctcaggacgaacgctggcggcatgcttcatacatgcaagtcgaacgtgaagccgacttcggttggtggaacgtggcggacgggtgagtaatatgtaggaaatctgcccttgagagggggacaacagagggaaacttctgctaataccccatatgagcgtacctgaaatggtatttttgaaaactccggtgctcaaggatgagcctgcatctgattagctagttggcggtgtaatggaccaccaaggcgacgatcagtagctggtttgagaggatgatcagccacaatgggactgagacacggcccatactcctacgggaggcaggagtagggaattttgcgcaatgggcgaaagcctgacgcagcaatgccgcgtgaacgtagaagcccttcggggtgtaaagttctgtcagtggggacgaattttgacggtacccacagaggaagcaccggctagctccgtgccagcagccgcg

SEQ ID NO: 247 - DNA, 490 bp, Unknown
  Ascusbbf_26285, encodes 16S rRNA
agagtttgatcctggctcaggataaacgctggcggcgcacataagacatgcaagtcgaacggacttaatcttaatatttatattgagaagcggttagtggcggactggtgagtaacgcgtaagcaatctacctattagaggggaataacagtgagaaatcattgctaataccgcatatgccataagaaccacatggttctagtgggaaaggagcaatccgctaatagatgagcttgcgtctgattagctagttggtggggtaatggcctaccaaggcaacgatcagtagccgaactgagaggttgaacggccacattgggactgagatacggcccagactcctacgggaggcagcagtcgggaatattgcgcaatggaggaaactctgacgcagtgacgccgcgtataggaagaaggttttcggattgtaaactattgtcgttggggaagataaaagacagtacccaaggaggaagctccggctaactac

SEQ ID NO: 248 - DNA, 490 bp, Unknown
  Ascusbbf_46791, encodes 16S rRNA
agagtttgatcatggctcaggacgaacgctggcggcgtgcctaacacatgcaagtcgagcggagacattaaggagcttgctccgagatgttttagcggcggacgggtgagtaacgcgtgagcaatctgtcccgtacagggggataacacttggaaacaggtgctaataccgcatgagaccacaacgtcacatggcgaaggggtcaaaggagcaatccggtatggggtgagctcgcgtccgattagctagttggtgaggtaacggcccaccaaggcgacgatcggtagccgacctgagagggtgatcggccacattggaactgagagacggtccaaactcctacgggaggcagcagtggggaatattgggcaatgggcgaaagcctgacccagcaacgccgcgtgagggaagaaggttttcggattgtaaacctctgtccttggggacgaaggaagtgacggtacccaaggaggaagccccggctaactac

SEQ ID NO: 249 - DNA, 490 bp, Unknown
  Ascusbbf_742985, encodes 16S rRNA
agatttgatcctggctcaggacgaacgctggcggcgtgcctaacacatgcaagtcgaacggactgattcccttcggggatgaaagttagtggcggacgggtgagtaacgcgtgagtaacctgcctttcagagggggataacgtttggaaacgaacgctaataccgcataacatatatttgtcgcatggcagatatatcaaaggagcaatccgctgaaagatggactcgcgtctgattagatagttggcggggcaacggcccaccaagtcgacgatcagtagccggactgagaggttgaacggccacattgggactgagacacggcccagactcctacgggaggcagcagtgagggatattgcacaatgggcgcaagcctgatgcagcaacgccgcgtgaaggatgacggttttcggattgtaaacttctgttcttagtgatgataatgacattagctaaggagaaagccacggctaactacgtgccagca

SEQ ID NO: 250 - DNA, 490 bp, Unknown
  Ascusbbf_6748, encodes 16S rRNA
agagtttgatcctggctcagagttaacgctggcatcgtgcataacacatgcaagtcgaacgggactttgcgctgtagcaatacagtgtaaagtttagtggcagacgggtgagtaatgtatgggaaatctaccttcgagtggggaataacggcccgaaagggttgctaataccccataacatttctaggtggcatcaccaagaaatcaaagatttatcgcttgaagacgatcccatattccatcagcttgttggcagtgtaacggactaccaaggcgacgacggatagccggcctgaaagggcgaccggccacaagggcactgagacacgggccctactcctacgggaggcagcagtggggaattttggacaatgggcgaaagcctgatccagcaacgatgcgtggaggatgaaggttctcggattgtaaactccttttgtgagggacgaaaaaaatgacggtacctcacgaataagccacggctaactac

SEQ ID NO: 251 - DNA, 490 bp, Unknown
  Ascusbbf_2171, encodes 16S rRNA
agagtttgatcatggctcagaacgaacgctggcggcgcgttttaagcatgcaagtcgagcgggaacaggtagcaatacctgtgagagcggcggacgggtgagtaacacgtggataatctaccctacagttggggatagcttggtgaaagccaagataataccgaatacgatgtacacgacagaagtggagtacaggaaaggggctacggccccgctgaaggatgagtctgcgtcccattagctagatggcagggtaaaggcctaccatggcgatgatgggtagccggcctaagagggtgaacggccacattgggactgagatacggcccagactcctacgggaggcagcagctaagaatcttccacaatggacggaagtctgatggagcgacgccgcgtgaatgatgaaggccgtgaggttgtaaagttcttttctggagggagaataaggcatgtagggaatgacatgccgatgacgtgaatccaggaa

SEQ ID NO: 252 - DNA, 471 bp, Unknown
  Ascusbbf_134236, encodes 16S rRNA
agagtttgatcatggctcagagcgaacgctggcggcatgcttaacacatgcaagtcgcacgaacctttcggggttagtggcggacgggtgagtaacgcgtaggaatctgtccacgggtgggggataactctgggaaactggagctaataccgcatgatacctgagggtcaaaggcgcaagtcgcctgtggaggagcctgcgttcgattagctagttggtggggtaaaggcctaccaaggcgatgatcgatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcgtaat

SEQ ID NO: 253 - DNA, 490 bp, Unknown
  Ascusbbf_5020, encodes 16S rRNA
agagtttgatcctggctcagagtgaacgctggcggtaggcctaacacatgcaagtcgaacggcagcgggtagggagcttgctccctatgccggcgagtggcggacgggtgaggaatacatcggaatctactctgtcgtgggggataacgtagggaaacttacgctaataccgcatacgacctacgggtgaaagtgggggaccgcaaggcctcacgcgatagaatgagccgatgtccgattagctagttggcggggtaaaggcccaccaaggcgacgatcggtagctggtctgagaggatgatcagccacactgggactgagacacggcccagactcctacgggaggcagcagtggggaatattggacaatgggcgcaagcctgatccagccataccgcgtgagtgaagaaggccctcgggttgtaaagctcttttgttgggaaagaaatcctgttggctaatacccggcagggatgacggtacccaaaga

SEQ ID NO: 254 - DNA, 490 bp, Unknown
  Ascusbbf_7489, encodes 16S rRNA
agagtttgatcatggctcaggatgaacgctggcggcaggcttaatacatgcaagtcgaacggtaaggccgagtgcagcaatgcatgaggtacacgagtggcgcacgggtgcgtaacgcgtatgcaacctgcccccaaccgggacaaaacagctggaaacggctgctaatatcccatggtcacttaaaacggcatcgttatgagtgtaaagatttattggttggggatgggcatgcgtattattaggtagttggcggggtaacggcccaccaagccgacgatgattaggggttctgagaggaaagacccccacactggaactgagacacggtccagactcctacgggaggcagcagtagggaatattgggcaatggaggcaactctgacccagccatgccgcgtgaaggaataaggccctatgggtcgtaaacttcttttaccgcagagtaaacccggggacgcgtccccggttgagagtatgcggggaat

SEQ ID NO: 255 - DNA, 490 bp, Unknown
  Ascusbbf_33814, encodes 16S rRNA
agagtttgatcatggctcaggatgaacgctagctacaggcctaacacatgcaagtcgaggggcagcatgggagaagcttgcttttcccgatggcgaccggcgaatgggtgagtcacgcgtgtccaacctgccttcagcccggggatagcccttggaaatgaggattaagacccgatatatgcgcattccgcatggcgtgcgcatgaaactggactgaagatggggacgcgtcggattagcttgacggcggggcgacggcccaccgtggcgacgatccgcaggggttctgagaggaaggtcccccacactggcactgagacacgggccagactcctacgggaggcagcagtgaggaatattggtcaatgggcgagagcctgaaccagccaagtagcgtgcaggatgacggccctacgggttgtaaactgcttttgcgggaggataaaggacactacgtgtagtgttttgcaggtatcccgtgaataaggac

SEQ ID NO: 256 - DNA, 490 bp, Unknown
  Ascusbbf_30594, encodes 16S rRNA
agagtttgatcatggctcagaacgaacgctggcggcgcgtcttaagcatgcaagtcgaacggcaaggcgggtgcttgcacctgccctagagtggcggactggtgagtaacacgtggatgacataccctccggacggggatagccggtagaaataccgggtaataccggatacggtcgtgcgggttagagccgcacgaggaaaggagctacggctccgccggaggaatggtccgcggcctattagttagttggtggggtaaaggcctaccaaggcgatgacgggtatccggcctgagagggtgaacggacacattgggactgagatacggcccagactcctacgggaggcagcagctaagaatattccgcaatggacgaaagtctgacggagcgacgccgcgtgaatgaagaaggccggaaggttgtaaagttcttttggacgtgaggaataagtgcctcagggaatgggggcgcggtgactgtagcgtct

SEQ ID NO: 257 - DNA, 490 bp, Unknown
  Ascusbbf_361780, encodes 16S rRNA
agagtttgatcatggctcaggatgaacgctggcggcgtgcctaatacatgcaagtcggacggcagcagcaatgctgtagtggcgaacgggtgagtaacacgttggtgacctgccccaaagatgggaatatcacctggaaacgggtggcaaaaccgaataagctcggcttagttagagaaggtcgagtaaaagagtgatctactttgggaggggcctgcggcccatcagttagttggtgagggtaatggcccaccaagacgaagacgggtaggggacctgagagggtggtcccccacaatggaactgaaacacggtccatacacctgcgggtggcagcagtagggaatattgctaaatgggcgaaagcctgaagcagcaacgccgcgtggacgaaggaggccttcgggtcgtaaagtcctttttataggggaaaaggaaggatggtaccctatgaataaatctcggctaactacgtgccagcagccgcggt

SEQ ID NO: 258 - DNA, 490 bp, Unknown
  Ascusbbf_7465, encodes 16S rRNA
agagtttgatcatggctcaggatgaacgctagcggcaggcttaacacatgcaagtcgaggggcagcgcgttgtagcaatacaatggcggcgaccggcgcaagggtgcgtaacgcgtgagcaatctgcccgtatcagggggataagcgatggaaacgtcgtctaataccgcataacacattgaacggcatcgtttgatgttgaaagcttcggtggatacggatgagctcgcgagacattagttagttggcggggtaacggcccaccaagaccgcgatgtctaggggaactgagaggttggtcccccacactggaactgagacacggtccagactcctacgggaggcagcagtgaggaatattggacaatggccggaaggctgatccagccatgccgcgtgaaggataaggtcctatggattgtaaacttcttttgagagggagcaataaggatgtcgtgacatccgatgagagtacctttcgaataagcat

SEQ ID NO: 259 - DNA, 490 bp, Unknown
  Ascusbbf_16448, encodes 16S rRNA
agagtttgatcatggctcagaacgaacgctggtggcgtgtcttatacatgcaagtcgagcgaggcagcaatgccgagcggcgaacgggtgagtaacgcgtaagcaatctgccccgtatcaggaaatacccgtgccaacgcgcggttaatgtccaggagagtgggagcctgcatgggctcttgactagagatttatcggtacgggatgagcttgcgtccgattagctagttggcggggcaacggcccaccaaggcgacgatcggtagccggcctgagagggtgatcggccacattgggactgagatacggcccagactcctacgggaggcagcagtagggaatattgcacaatgggggaaaccctgatgcagcaacgccacgtgtgggaagaagcatttcggtgtgtaaaccactgtcatgagggaataaggcctattttcggataggattgaatgtaccttgagaggaagcaccggcaaacttcgtgcca

SEQ ID NO: 260 - DNA, 490 bp, Unknown
  Ascusbbf_24078, encodes 16S rRNA
agagtttgatcatggctcaggatgaacgctggcggcgtgcctaacacatgcaagtcgaacggagtatatgcgctgatgatcgaagtgcttgcatagagagaatcttgcatatacttagtggcggacgggtgagtaacgtgtggataacctggtccatccagggggatagcagctggaaacggctggtaataccgcataagcgcacagcagggcatcctgcggtgtgaaaagatttatcgggatggaatggatccgcatctgattagccagtcggcggggtaacggcccaccgaagcgacgatcagtagccggcctgagagggcggacggccacattgggactgagacacggcccagactcctacgggaggcagcagtgggggatattgcacaatggggggaaccctgatgcagcgacgccgcgtgggtgaagaagtatttcggtatgtaaagccctatcagcagggaagataatgacggtacctgagtaa

SEQ ID NO: 261 - DNA, 489 bp, Unknown
  Ascusbbf_29541, encodes 16S rRNA
agagtttgatcatggctcagaacgaacgctggcggcatggattaggcatgcaagtcgaacgaagcagcaatgcttagtggcgaaagggtgaggaacgcgtgagtaatctgcccccaagttgggaataacagctggaaacggctgctaataccgaatgtggctgattgaccgcatggttgattggctaaagatttatcgcttggggatgagctcgcgtcccattagttagttggtgaggtaacggcccaccaagacgatgatgggtagctggtctgagaggatggtcagccacactgggactgagacactgcccagactcctacgggaggctgcagtcgagaatcttgggcaatgcgcgaaagcgtgacccagcaatgccgcgtgtatgatgaaggtcttcggatcgtaaaatactgtctcccgtgacgaagtaatgacggtagcggggaaggaagccacggctaactacgtgccagcagccgcggtaat

SEQ ID NO: 262 - DNA, 490 bp, Unknown
  Ascusbbf_98493, encodes 16S rRNA
agagtttgatcatggctcaggatgaacgctggcggcgtgcctaacacatgcaagtcgagcggagtcatatgttgattcttcggatgatttatatgacttagcggcggatgggtgagtaacacgtgggtaatctgccctgcactgggggataacagttggaaacgactgttaataccgcatatgcacacggggccgcatggccctgggtggaaagattcatcggtgcaggatgagcccgcgtcggattaactagttggcagggtaacggcctaccaaggtgatgatccgtagccggcctgagagggcgaccggccacattgggactgagacacggcccaaactcctacgggaggcagcagtggggaatattgcacaatgggcgcaagcctgatgcagcgacgccgcgtgaaggaagaagtatttcggtatgtaaacttctatcagcggggaagaagatgacggtacccgactaagaagccccggctaacta

SEQ ID NO: 263 - DNA, 490 bp, Unknown
  Ascusbbf_46946, encodes 16S rRNA
agagtttgatcctggctcaggacgaacgctggcggcgtgcctaacacatgcaagtcgaacgaagcttgagaacagaattcttcggaaggacgtttgatatgactgagtggcggacgggtgagtaacgcgtgagcaacctgcccttcggagggggatagtgtctggaaacggacagtaataccgcataatgttggatgatggcatcttcattcaaccaaagatttatcgccgaaggatgggctcgcgtctgattagatagttggtggggtaacggcctaccaagtcgacgatcagtagccggactgagaggttgaacggccacattgggactgagacacggcccagactcctacgggaggcagcagtggggaatattgcacaatgggcgcaagcctgatgcagcaacgccgcgtggaggaagacggttttcggattgtaaactcctgttcttagggaagaagacagtgacggtacctaaggagcaagccac

SEQ ID NO: 264 - DNA, 468 bp, Unknown
  Ascusbbf_424219, encodes 16S rRNA
agagtttgatcctggctcagaacgaacgctggcggcaggcttaacacatgcaagtcgagcgccccgcaaggggagcggcagacgggtgagtaacgcgtgggaatctacccatctctacggaacaactctgggaaactggagctaataccgtatacgtccgagaggagaaagatttatcggggatggatgagcccgcgttggattagctagttggtggggtaatggcctaccgaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaat

SEQ ID NO: 265 - DNA, 490 bp, Unknown
  Ascusbbf_122193, encodes 16S rRNA
agagtttgatcatggctcaggatgaacgctggcggcgtgcttaacacatgcaagtcgaacggagatacgtaaaagaagttttcggatggaatttacatatcttagtggcggacgggtgagtaacacgtaaacaatctgcctttgagagcgggacaacagatagaaatatctgctaataccgcataagaccacaggttcgcatgaactaggggtaaaaggggagcaatctcgctcaaagatgagtttgcggactattagctagttggtgaggtaacggcccaccaaggcaaagatggttagccgacctgagagggtgatcggccacactggaactgagaaacggtccagactcctacgggaggcagcagtgaggaatattgggcaatggaggaaactctgacccagcaacgccgcgtgaaggaagaaggttttcggattgtaaacttctgttatgggggaaaaaggaagtgatggtaccccatgagcaagc

SEQ ID NO: 266 - DNA, 490 bp, Unknown
  Ascusbbf_1488889, encodes 16S rRNA
agagtttgatcatggctcaggatgaacgctggcggcgtgcttaacacatgcaagtcgaacggagttaacgcgctgaggagagcttgctcaaatcatgcgttaacttagtggcggacgggtgagtaacgcgtggataacctgccttataccgggggataacacttagaaataggtgctaataccgcataagcgcacgctttcgcatgaaagagtgtgaaaaactccggtggtataagatggatccgcgtctgattagatagttggtgaggtaacggcccaccaagtcaacgatcagtagccggcctgagagggtgaacggccacattgggactgagacacggcccaaactcctacgggaggcagcagtggggaatattgcacaatggaggaaaccctgatgcagcgacgccgcgtgagtgaagaaatatttcggtatgtaaagctctatcagcaaggaagaaacaaatgacggtacttgactaagaagccc

SEQ ID NO: 267 - DNA, 490 bp, Unknown
  Ascusbbf_284679, encodes 16S rRNA
agagtttgatcctggctcaggatgaacgctagctacaggcctaacacatgcaagtcgaggggcagcatgaagaaagcttgctttctttgatggcgaccggcgaatgggtgagtcacgcgtgtccaacctgcccctgtcccggggatagcccttggaaatgaggattaagacccgatatgtgcctttgccgcatggcgttggcatgaaaccaggacagggatggggacgcgtcggattagctagacggcggggcaacggcccaccgtggcgacgatccgcaggggttctgagaggaaggtcccccacactggcactgagacacgggccagactcctacgggaggcagcagtgaggaatattggtcaatgggcgagagcctgaaccagccaagtagcgtgcaggatgacggccctacgggttgtaaactgcttttgcgggaggataaccggcactacgtgtagtgccctgcaggtatcccgtgaataaggac

SEQ ID NO: 268 - DNA, 490 bp, Unknown
  Ascusbbf_195842, encodes 16S rRNA
agagtttgatcctggctcaggacgaacgctggcggcgtgcctaacacatgcaagtcgaacggaaatatatgacggaagttttcggatggaagatatatattttagtggcggacgggtgagtaacgcgtgagtaacctgcctttatgagggggataacgttctgaaaaggacgctaataccgcataaagtatatttgccgcatggtagatataccaaaggagcaatccgcatagagatggactcgcgtccgattagccggttggcggggtaacggcccaccaaagcaacgatcggtagccggactgagaggttgaacggccacattgggactgagacacggcccagactcctacgggaggcagcagtgggggatattgcgcaatgggggaaaccctgacgcagcaacgccgcgtgaaggaagacggttttcggattgtaaacttcttttattaaggacgaagaatgacggtacttaatgaataagctccgg

SEQ ID NO: 269 - DNA, 490 bp, Unknown
  Ascusbbf_98713, encodes 16S rRNA
agagtttgatcctggctcaggacgaacgctggcggcgtgcttaacacatgcaagtcgaacgaagttccgttgaatgagatttcggtcaaaggagacggacacttagtggcggacgggtgagtaacgcgtgagtaacctgcctttcagaggggaataacatttggaaacgaatggtaataccgcataacatcaaggagccgcatggcactttgatcaaaggagcaatccgctgagagatggactcgcgtccgattagctagttggcgggatagaggcccaccaaggcgacgatcggtagccggactgagaggttgaacggccacattgggactgagacacggcccagactcctacgggaggcagcagtggggaatattgcacaatgggggaaaccctgatgcagcaacgccgcgtgaaggaagacggtcttcggattgtaaacttttgttcttagcgaagaaagaaatgacggtagctaaggagaaagcca

SEQ ID NO: 270 - DNA, 490 bp, Unknown
  Ascusbbf_143680, encodes 16S rRNA
agagtttgatcatggctcaggatgaacgctagctacaggcttaacacatgcaagtcgaggggcagcaggtatctagcttgctaggtacgctggcgaccggcgcacgggtgcgtaacgcgtatccaatctacccgtcacccggggatagcctttcgaaagaaagattaacacccgatggtttccctgggccgcatggtccggggagtaaaggttcaccggtggcggatggggatgcgtccgattagctggttggcggggcaacggcccaccaaggcgacgatcggtaggggttctgagaggaaggtcccccacactggaactgagacacggtccagactcctacgggaggcagcagtgaggaatattggtcaatggtcggaagactgaaccagccaagtagcgtgagggacggcggccctacgggttgtaaacctcttttgttcgggaataacaggcgccacgcgtggcgccctgcatgtaccgttcgaag

SEQ ID NO: 271 - DNA, 490 bp, Unknown
  Ascusbbf_211323, encodes 16S rRNA
agagtttgatcctggctcaggatgaacgctggcggcgtgcttaacacatgcaagtcgaacggaacttttacggaaggagacttcggtcaacggaaatttaagtttagtggcggacgggtgagtaacgcgtgagtaacctgcctttcagagggggataacgtttggaaacgaacgctaataccgcataaaacagcagtatcgcatggtacaactgtcaaagattttatcgctgaaagatggactcgcgtccgattaggcagttggcggggtaacggcccaccaaaccgacgatcggtagccggactgagaggttgaacggccacattgggactgagacacggcccagactcctacgggaggcagcagtggggaatattgcacaatgggcgcaagcctgatgcagcaacgccgcgtgagggaagacggttttcggattgtaaacctctgttcttagtgacgaagaagtgacggtagctaaggagcaagccac

SEQ ID NO: 272 - DNA, 490 bp, Unknown
  Ascusbbf_112792, encodes 16S rRNA
agagtttgatcatggctcaggattaacgctggcggcatgcctaatacatgcaagtcgaacgagcagcaatgctagtggcgaacgggtgagtaacacgtagggaacctgccctttagacgaggataactactggaaacggtagctaaaactggatagtatacattaaggcatcttgatgtatttaaaggtcctgcaagggaacactaaaggatggtcctgcggaacattagctagttggtgaggtaacggcccaccaaggcgacgatgtttagctgtactgagaggtaaaacagccacactgggactgagacacggcccagactcctacgggaggcagcagtagggaattttcggcaatgggggaaaccctgaccgagcaatgccgcgtgaatgatgaaattcttcggaatgtaaagttctgttgttagggacgaaaggtatacgtaggaaatggcgtataattgacggtacctaactagaaagccccggc

SEQ ID NO: 273 - DNA, 490 bp, Unknown
  Ascusbbf_120210, encodes 16S rRNA
agagtttgatcctggctcaggacgaacgctggcggcgtgcctaacacatgcaagtcgaacgggattccatcgaatgaggcttcggcggattttggtggacatctagtggcggacgggtgagtaacgcgtgagcaacctgcctttaagagggggataacataccgaaaggtatgctaataccgcataagatattagtaccgcatgatacagatatcaaagatttcatcgcttaaagatgggctcgcgtccgattagatagttggcggggtaacggcccaccaagtcgacgatcggtagccggactgagaggttgaacggccacattgggactgagacacggcccagactcctacgggaggcagcagtgggggatattgcgcaatggggggaaccctgacgcagcaacgccgcgtgaaggaagaaggtcttcggattgtaaacttctgtcttatgggacgaagaagtgacggtaccataggaggaagccacg

SEQ ID NO: 274 - DNA, 490 bp, Unknown
  Ascusbbf_195188, encodes 16S rRNA
agagtttgatcatggctcaggacgaacgctggcggcgtgcctaacacatgcaagtcgaacgggatcctcatgaaggagttttcggacaacggaatggggcatctagtggcggacgggtgagtaacgcgtgagcaacctgcccttcggagggggacaacagttggaaacgactgctaataccgcatgacatatacggatggcatcatctgtatatcaaagatttatcgccgagggatgggctcgcgtctgattagctagttggtgaggtaacggctcaccaaggctgcgatcagtagccggactgagaggttgaacggccacattgggactgagatacggcccagactcctacgggaggcagcagtggggaatattgggcaatgggggcaaccctgacccagcaacgccgcgtgaaggaagaaggctttcgggttgtaaacttctttgacgagggacgaagaaagtgacggtacctcgaaaacaagccacg

SEQ ID NO: 275 - DNA, 490 bp, Unknown
  Ascusbbf_290604, encodes 16S rRNA
agagtttgatcctggctcaggacgaacgctggcggcgtgcttaacacatgcaagtcgaacggacgatcacccttcggggtgtgagttagtggcggacgggtgagtaacgcgtgagtaatctgccttggagtggggaataacacagggaaacttgtgctaataccgcataacgtcatcgggtggcatcatctggtgaccaaagatttattgctccaagatgagctcgcgtccgattagatagttggcggggtaatggcccaccaagtcgacgatcggtagccggactgagaggttggccggccacattgggactgagacacggcccagactcctacgggaggcagcagtgggaatattaggcaatgggggaaaccctgacctagcgacgccgcgtgaaggatgaaggttttcggattgtaaacttctttggcaggggacgataatgacggtaccctgagaacaagccacggctaactacgtgccagcagcc

SEQ ID NO: 276 - DNA, 490 bp, Unknown
  Ascusbbf_807408, encodes 16S rRNA
agagtttgatcatggctcaggatgaacgctagctacaggcttaacacatgcaagtcgtggggcagcgctgggaatgcttgcattccctggcggcgaccggcggatgggtgagtaacgcgtatccagcctgccccgcgcccggggacagcccttagaaatgaggattaacccccgataggtgtccctgccgcatggccgggccacgaaacagacgcgggatggggatgcgttccattaggcagcaggcggggtaacggcccacctggcccgcgatggataggggttctgagaggaaggtcccccacactggaactgagacacggtccagactcctacgggaggcagcagtgaggaatattggtcaatgggcggaagcctgaaccagccaagtagcgtgcgggatgaaggccctacgggttgtaaaccgcttttgcgcggggataaagagggggacttgtcccccgttgcaggtaccgcgcgaataaggacc

SEQ ID NO: 277 - DNA, 490 bp, Unknown
  Ascusbbf_105531, encodes 16S rRNA
agagtttgatcatggctcaggatgaacgctggcggcgtgcttaacacatgcaagtcgaacggaggtatttcgctgacgaggcttcggccaaatcttgagataccttagtggcggacgggtgagtaacgcgtgggaaacctgccctatgcagggggataacagttagaaatgactgctaataccgcataagcccacggcatcgcatgatgctgcgggaaaagatttatcggcataggatggtcccgcgtcagattagccagttggcggggtaacggcccaccaaagcgacgatctgtagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaagatgacagtacctgagtaagaagccccgg

SEQ ID NO: 278 - DNA, 490 bp, Unknown
  Ascusbbf_737528, encodes 16S rRNA
agagtttgatcatggctcagaacgaacgctggcggcgtgccttatacatgcaagtcgagcgagggcgcagcaatgcgaaccgagcggcgaacgggtgagtaacgcgtgaacaacctgccccaaagtccgggatagcccttccaacggaggattaataccggatggcgagggttcccgcatgggagcctatccaaagtcttggcgctatgggaggggttcgcgtccgattagctagttggcggggcaacggcccaccaaggcgacgatcggtagccggcctgagagggcgaacggccacaatgggactgagatacggcccatactcctacgggaggcagcagtagggaatattgcgcaatggacggaagtctgacgcagcaacgccacgtgtgggacgaagcctttcggggtgtaaaccactgtcagcggggactagtaagcggggcaacccgtcgcgaatgtacccgcagaggaagcaccggcaaacttc

SEQ ID NO: 279 - DNA, 490 bp, Unknown
  Ascusbbf_1801815, encodes 16S rRNA
agagtttgatcctggctcagaacgaacgctggtagcgtggattaggcatgcaagtcgaacgggatcagccggttagcaataattggctgtgagagtggcggattggggaggaacacgtgagcaacctgtccttgggttggggaaaaccgcgggaaactgcggctaataccggatgcggcgcctggagacatctccggagcgctaaagggggccgcaaggctctcgcccatcgaggggctcgcgcaccatcagcttgttggcggggtaacggcccaccaaggcttacggttagctggtctgagaggatggccagccccactgggactgagatactgcccagactcctacgggaggctgcagtcgaggatcatttgcaatgggcgaaagcctgacaatgcgacgctgcgtggaggatgaaggccttcgggttgtaaactcctgtcatgggggaacaggcgaggggagctaatacctcccttagttgagtgta

SEQ ID NO: 280 - DNA, 490 bp, Unknown
  Ascusbbf_407371, encodes 16S rRNA
agagtttgatcatggctcaggatgaacgctagcggcaggcttaacacatgcaagtcgaggggcagcgcgtggtagcaataccatggcggcgaccggcgcacgggtgcgtaacgcgtatgcaacctgcctgtaacagggggataacccggagaaatttggactaataccccatattgccgcgtggcagcattgttgtgcggcgaaaggagcgatccggttacagatgggcatgcgtgacattaggtagttggcggggcaacggcccaccaagccgacgatgtctaggggaactgagaggttagtcccccacactggtactgagacacggaccagactcctacgggaggcagcagtgaggaatattggtcaatggtcggaagactgaaccagccatgccgcgtgagggaggaaggccctagttggttgtaaacctcttttacgggggagcaataaggcggacgcgtccgtcgatgagagtaccccgggaata

SEQ ID NO: 281 - DNA, 490 bp, Unknown
  Ascusbbf_736020, encodes 16S rRNA
agagtttgatcatggctcaggacgaacgctggcggcgtgcctaacacatgcaagtcgagcggggacataaggaactgcggctacggccaaagggagatatgttcgagcggcggacgggtgagtaacgcgtgaacgatctgtcttccacagggggataacacgtggaaacatgtgctaataccgcataagaccacagcgctgcatggcgcaggggtcaaaggagcgatccggtgggaggtgagttcgcgtctgattagatagttggtgaggtaacggcccaccaagtcaacgatcagtagccgacctgagagggtgatcggccacattggaactgagacacggtccaaactcctacgggaggcagcagtgggaatattgggcaatgggcgaaagcctgacccagcaacgccgcgtgagggaagaaggttttcggattgtaaacctctgtccttggtgacgaaggaagtgacggtagccaaggaggaagccc

SEQ ID NO: 282 - DNA, 490 bp, Unknown
  Ascusbbf_724736, encodes 16S rRNA
agagtttgatcatggctcaggatgaacgctggcggcgtgcctaacacatgcaagtcgaacgaagcatagagattagatttcttcggattgaagatttttatgacttagtggcgaacgggtgagtaacgcgtgggtaacctgcctcatgcagggggataacaattagaaatgattgctaataccgcataagaccgcagaaccgcatggttgagcggccaaagatttatcggcatgagatggacccgcgtctgattagttagttggtggggtaacggcctaccaagacgatgatcagtagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctttaagcagggaagatgatgacggtacctgcagaataagcaccgg

SEQ ID NO: 283 - DNA, 490 bp, Unknown
  Ascusbbf_1875300, encodes 16S rRNA
agagtttgatcctggctcaggatgaacgctggcggcatgcctaagacatgcaagtcgtacgaggtgaccttttgaagcagagtgcttgcacaaagtagataaagattttcacctagtggcgcaagggtgagtaacacgtgggttatctgccttgaagactggaataacaattggaaacgattgctaatgccggatgatatgtaagaggatacgtcttcttatagtaaaaggagcctttaaagcttcacttcaagatgagcctgcggcgcattagctagttggtggggtaatggcctaccaaggcaacgatgcgtagccgaactgagaggttgatcggccacattgggactgagacacggcccaaactcctacgggagacagcagttaggaatattcgtcaatgggggaaaccctgaacgagcaatgccgcgtgaatgatgacggtcctctggattgtaaaattctgttgttgaggaagaacgtctagtgt

SEQ ID NO: 284 - DNA, 490 bp, Unknown
  Ascusbbf_1217559, encodes 16S rRNA
agagtttgatcctggctcaggatgaacgctggcggcgtgcctaatacatgcaagtcgaacgaggttggtagcaatatcaaccgagtggcgaacgggtgagtaacacgtagggaacctgccctttagtttgggatacccagaggaaactttggctaataccggataactaatctggaggcatctccggattctaaaaggggcctttaaagcctcgcttaaggatggacctgcggcgcattagctagttggtgagataacagcccaccaaggcgaggatgcgtagccgacctgagagggtgaacggccacactggaactgagacacggtccagactcctacgggaggcagcagtagggagttttcggcaatgggggaaaccctgaccgagcaacgccgcgtgagtgatgaaggtcttcggattgtaaagctctgttataggggaagaatgatagattgaggaaatgctatctatttgacggtaccttatgag

SEQ ID NO: 285 - DNA, 490 bp, Unknown
  Ascusbbf_1810698, encodes 16S rRNA
agagtttgatcctggctcaggatgaacgctggcggcgtgcttaacacatgcaagtcgaacggagtatatcaatcgaaaccttcgggtttcacctgttatacttagtggcggacgggtgagtaacgcgtgagcaaccaaccttgtgcagagggataacaattagaaatgattgctaatacctcataagaccacagcatcgcatggtgcagtgggaaaacttccgggggcacaagacgggctcgcgttcgattagctggatgatgaggtaacggcccaccatggcgacgatcgatagccggactgagaggtcgaccggccacattgggactgagacacggcccagactcctacgggaggcagcagtggggaatattgcacaatgggggaaaccctgatgcagcgacgccgcgtgagtgatgaagtatttcggtatgtaaagctcttttagcagggaagaagatgacggtacctgcagaaacagccccggcta

SEQ ID NO: 286 - DNA, 490 bp, Unknown
  Ascusbbf_238248, encodes 16S rRNA
agagtttgatcatggctcaggacgaacgctggcggcatgcctaacacatgcaagtcgaacgagggtagcaatactcgagtggcgaacgggtgagtaacgcgtgaggaatctgccttacacaacgggatacctactggaaacagtagttaatacggtataagaccacagtaccgcatggtacagtggtaaaagatttatcggtgtaagatgacctcgcgtcgcattagctagttggtggggtaacggctcaccaaggcgacgatgcgtagccgacctgagagggtgatcggccacattgggactgagatacggcccagactcctacgggaggcagcagtggggaatattgggcaatggaggaaactcttacccagcaatgccgcgtgaatgaagaaggtcgtaagattgtaaagttctttagtcagggattaataaatgaaagatctgaagaataagctccggctaactacgtgccagcagccgcggtaat

SEQ ID NO: 287 - DNA, 472 bp, Unknown
  Ascusbbf_1584800, encodes 16S rRNA
agagtttgatcatggctcagagcgaacgctggcggcaggcttaacacatgcaagtcgaacgctcgtagcaatacgagagtggcagacgggtgagtaacacgtgggaacgtacctttcggttcggaataacccggggaaactcgggctaataccggatacgtccgcaaggagaaagatttatcgccgaaagatcggcccgcgtcggattagctagttggtgaggtaatggctcaccaaggcaatgatccgtagctggtctgagaggacgatcagccacactgggactgagacacggcccagactcctacgggaggcagcagtggggaatattggacaatgggcgcaagcctgatccagccatgccgcgtgagtgatgaaggccttagggttgtaaagctcttttaccagggaagataatgacggtacctggagaataagccccggctaacttcgtgccagcagccgcggtaat

SEQ ID NO: 288 - DNA, 490 bp, Unknown
  Ascusbbf_4532, encodes 16S rRNA
agagtttgatcctggctcaggatgaacgctagcgataggcctaacacatgcaagtcgaggggcagcacatgacgtagcaatacagatggtggcgaccggcgcacgggtgagtaacacgtatgcaacctaccttcaacaggagaataacccgtcgaaagacggactaatactccataacacagggatcccacatgggaatatttgttaaagatttatcggttgaagatgggcatgcgctccattagctagttggtgaggtaacggctcaccaaggcaacgatggataggggaactgagaggtttatcccccacactggtactgagacacggaccagactcctacgggaggcagcagtgaggaatattggtcaatggaggcaactctgaaccagccacgtcgcgtgaaggatgacggccctacgggttgtaaacttcttttgtaagggaataaagttagttacgtgtaactatttgcatgtaccttacgaat

SEQ ID NO: 289 - DNA, 490 bp, Unknown
  Ascusbbf_4162, encodes 16S rRNA
agagtttgatcctggctcaggataaacgctggcggcgcacataagacatgcaagtcgaacgaacttaattcatttgtttacagatggaagcggttagtggcggactggtgagtaacatgtaagcaatctacctgtcagaggggaataacaatgagaaatcattgctaataccgcatacattatgaatatcgcatgataagcataagaaaggagcaatccgctgacagatgagcttgcacctgattagttagttggtggggtaacggcctaccaagacgacgatcagtagccgagctgagaggctctacggccacattgggactgagatacggcccagactcctacgggaggcagcagtcgggaattttgcgcaatggaggaaactctgacgcagtgacgccgcgtataggaagaaggttttcggattgtaaactattttagacagggaagaagaaagtgacagtacctgtagaataagctccggctaact

SEQ ID NO: 290 - DNA, 490 bp, Unknown
  Ascusbbf_9929, encodes 16S rRNA
agagtttgatcatggctcaggacgaacgctggcggcgtgcctaacacatgcaagtcgaacggagtttgaggaatgaaggtttcgattggattttcttaaacttagtggcggacgggtgagtaacgcgtgagtaacctgcccataagagggggataacgttttgaaaagaacgctaataccgcataacatatcgaagccgcatggcattgatatcaaaggagcaatccgcttatggatggactcgcgtccgattagcttgttggcggggtaacagcccaccaaggcaacgatcggtagccggactgagaggttgaacggccacattgggactgagacacggcccagactcctacgggaggcagcagtgggggatattgcgcaatgggggaaaccctgacgcagcaacgccgcgtggaggatcgaaggtcttcggattgtaaactccttttgttaaggacgaaaagaatgacggtacttaacgaataagctc

SEQ ID NO: 291 - DNA, 484 bp, Unknown
  Ascusbbf_9977, encodes 16S rRNA
agagtttgatcatggctcagaacgaacgctggcggcacgcttaacacatgcaagtcgaacggaattatggggcttgctccataatttagtggcgcacgggtgagtaacacgtgggtacctgcctattgatggtggacaactccgggaaactggggctaatacagcataagctcgaaagaggaaagaatttattcgtcgatagaggggcctgcgtctgattaggtagttggtggggtaatagcttaccaagccgatgatcagtagctggtctgagaggatgatcagccacactggaactgagacacggtccagactcctacgggaggcagcagtggggaatattggacaatgggggaaaccctgatccagcgatgccgcgtgagtgatgaaggccctagggttgtaaagctcttttgacagggacgatgatgacggtacctgtagaataagcaccggctaactctgtgccagcagccgcggtaat

SEQ ID NO: 292 - DNA, 470 bp, Unknown
  Ascusbbf_298715, encodes 16S rRNA
agagtttgatcatggctcagaacgaacgctggcggcaggcctaacacatgcaagtcgaacgccctagcagtagggagtggcagacgggtgagtaacgcgtgggaaccttccctatagtacggaatataccagggaaacttggagcaataccgtatacgcccgaaaggggaaagatttatcgctataggatgggcccgcgtaggattagctagttggtgaggtaatggctcaccaaggcgacgatccttagctggtctgagaggatgatcagccacactgggactgagacacggcccagactcctacgggaggcagcagtggggaatattgggcaatgggcgaaagcctgacccagccatgccgcgtgagtgacgaaggccttagggttgtaaagctcttttggcggggacgataatgacggtacccgcagaataagccccggctaacttcgtgccagcagccgcggtaat

SEQ ID NO: 293 - DNA, 490 bp, Unknown
  Ascusbbf_229858, encodes 16S rRNA
agagtttgatcatggctcaggatgaacgctggcggcgtgcctaacacatgcaagtcgagcggagtaagacaccggatgaagattcgtctgaatccaccgtcttacttagcggcggatgggtgagtaacgcgtggacaacctgcccttcactgggggataacaaccggaaacgggtgctaataccgcatgggcgcgaacgaccgcatgatcgatcgcgtaaagatttatcggtgaaggatgggtccgcgtcggattaactagttggcggggtaacggcccaccaaggtgatgatccgtagccggcctgagagggcgaccggccacattgggactgagacacggcccaaactcctacgggaggcagcagtgggggatattgcacaatgggcggaagcctgatgcagcgacgccgcgtgagcgaagaagtgcctcggcatgtaaagctctatcggtggggaagaagatgacggtacccacagaagaagccccg

SEQ ID NO: 294 - DNA, 490 bp, Unknown
  Ascusbbf_69030, encodes 16S rRNA
agagtttgatcatggctcaggacgaacgctggcggcatgcctaacacatgcaagtcgaacgaggatagcaatatccgagtggcgaacgggtgagtaacacgtgagtaacctgcctcatacaacgggatacctacaggaaactgtagttaatacggtataagaccacagaaacacatgtttcagtggtaaaagattttatcggtatgagatggactcgcggcgcattagctagttggtgaggtaacggctctaccaaggcgacgatgcgtagccgacctgagagggtgatcggccacattgggactgagatacggcccagactcctacgggaggcagcagtggggaatattgggcaatggaggaaactcttacccagcaatgccgcgtgaatgaagaaggtcgtaagattgtaaagttctttagtcagggacgaaaaaaatgacggtacctgaagaataagctccggctaactacgtgccagcagccgcgg

SEQ ID NO: 295 - DNA, 490 bp, Unknown
  Ascusbbf_1867224, encodes 16S rRNA
agagtttgatcatggctcaggatgaacgctggcggcatgcctaagacatgcaagtcgaacgaagtgaccttttgaaacgaagtgcttgcacggagcggataaagattttcacttagtggcgcaagggtgagtaacacgtgggttatctgccttttagactgggataacaattagaaatgattgctaataccggatgataaatagaaagatacgtttttctattttaaaagatccccttaaaggatcactaaaagatgagcctgcggcgcattagctagatggtggggtaaaggcctaccatggcgacgatgcgtagccggactgagaggtcgatcggccacattgggactgagacacggcccaaactcctacgggagacagcagttaggaatattcgtcaatggaggaaactctgaacgagcaatgccgcgtgaatgatgacagtctttggattgtaaagttctgttgttggggaagaatgtgttatata

SEQ ID NO: 296 - DNA, 490 bp, Unknown
  Ascusbbf_1856867, encodes 16S rRNA
agagtttgatcctggctcagaacgaacgctggcagcgtggattaggcatgcaagtcgaacgggatcggggaggcagcaatgtcgccccgtgagagtggcggaagggcgaggaacacgtgggcaacctgtctttgaggtggggaaaaccgttggaaacgacggctaataccgaatgtagcgcccgctcgcatgagcggagcgccaaagggggcgaaagctccccctcttcgaggggcccgcgcaccatcagctagtcggcggggtaacggcccaccgaggcttacggttagctggtctgagaggatggccagccgcactgggactgagatactgcccagactcctacgggaggctgcagtcgaggatcatttgcaatgggcgaaagcctgacaatgcgacgctgcgtggaggatgaaggccctcgggttgtaaactcctgtcatgggggaaaaggaaaagggacccaacacgtccccgatttgatggtacc

SEQ ID NO: 297 - DNA, 490 bp, Unknown
  Ascusbbf_146606, encodes 16S rRNA
agagtttgatcctggctcaggatgaacgctggcggcgtgcttaacacatgcaagtcgaacgattaaaccggcttcggccggacatagagtggcgaacgggtgagtaacacgtgaccaacctgccccgcgcaccgggacagcctcgcgaaagcgggattaataccggatactccgcgggccccgcatggggcccgcgggaaagctccggcggcgcgggatggggtcgcggcccatcaggtagtaggtcgggtaagggccgacctagccgacgacgggtagccgggttgagagaccgaccggccacattgggactgagatacggcccagactcctacgggaggcagcagtggggaatattgcgcaatgggggcaaccctgacgcagcaacgccgcgtgcgggatgaaggccttcgggttgtaaaccgctttcagcagggaggatagtgacagtacctgcacaagaagccccggctaactacgtgccagcagc

SEQ ID NO: 298 - DNA, 490 bp, Unknown
  Ascusbbf_67981, encodes 16S rRNA
agagtttgatcatggctcaggacgaacgctggcggcgtgcttaacacatgcaagtcgaacggagaaccccggatgaaattttcggatggattctgggaattctcagtggcggacgggtgagtaacgcgtgagcaatctgcctcagagagggggacaacagctggaaacggctgctaataccgcataagaccacactacagcattgtagaggggtaaaaggagtgatccgctttgagatgagctcgcgtcccattagttagttggcggggtaacggcccaccaagacgacgatgggtagccgacctgagagggtgatcggccacactggaactgagacacggtccagactcctacgggaggcagcagtggggaatattgggcaatgggcgaaagcctgacccagcaacgccgcgtgaaggaagaaggtcttcggattgtaaacatctgtcctatgggacgaaggaagtgacggtaccataggaggaagccc

SEQ ID NO: 299 - DNA, 490 bp, Unknown
  Ascusbbf_31629, encodes 16S rRNA
agagtttgatcctggctcaggacgaacgctggcggtatgcttaacacatgcaagtcgaacgagaaggttttgaatgatccttcgggtgaaattagaactggaaagtggcgaacgggtgagtaacgcgtgggtaacctgccctatggaaaggaatagcctcgggaaactgggagtaaagccttatattatggttttgtcgcatggcaagatcatgaaaactccggtgccataggatggacccgcgtcccattagctagttggtgagataacagcccaccaaggcgacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaagctctgttattggggaagaaaacatgacggtacccaatgaggaagtcccggc

SEQ ID NO: 300 - DNA, 490 bp, Unknown
  Ascusbbf_77882, encodes 16S rRNA
agagtttgatcctggctcaggacgaacgctggcggcgtgcctaacacatgcaagtcgaacggagctttgcgttgaaattgagagcagcttgctgcaggatatttcttgtaaagcttagtggcggacgggtgagtaacgcgtgaggaacctgccttacagagggggacaacagttggaaacgactgctaataccgcataacatagcgaaaggacatccttttgttatcaaaggagtaatccgctgtaagatggcctcgcgtccgattagatagttggcggggtaacggcccaccaagtcgacgatcggtagccggactgagaggttgaacggccacattgggactgagacacggcccagactcctacgggaggcagcagtgggggatattgcacaatggaggaaactctgatgcagcaacgccgcgtgagggaagaaggttttcggattgtaaacctctgttttcggtgacgaaacaaatgacggtagccg

SEQ ID NO: 301 - DNA, 490 bp, Unknown
  Ascusbbf_8164, encodes 16S rRNA
agagtttgatcatggctcaggatgaacgctggcggcgtgcctaacacatgcaagtcgaacggggttactggcagcggagatttcggtcaaagcagcctttaacctagtggcggacgggtgagtaacgcgtggggaacctgccctgtactgggggataacagtgagaaatcactgctaataccgcataagcgcacagcatcgcatgatgcagtgtgaaaaactgaggtggtacaggatggctccgcgttggattagccagttggcggggtaacggcccaccaaagcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatgatgacggtacctgactaagaagccccggc

SEQ ID NO: 302 - DNA, 490 bp, Unknown
  Ascusbbf_180746, encodes 16S rRNA
agagtttgatcctggctcaggatgaacgctagcgataggcttaacacatgcaagtcgaggggcagcataaaggcagcaatgtcttaggtggcgaccggcgcacgggtgagtaacacgtatgcaacctgcccacaactgcgggataacccgtcgaaagacggactaataccgcatggtatggattgatcgcctgattgattcatcaaagaatttcggttgtggatgggcatgcgttccattaggcagttggtgaggtaacggctcaccaaacctacgatggataggggttctgagaggaaggtcccccacactggtactgagacacggaccagactcctacgggaggcagcagtgaggaatattggtcaatgggcgagagcctgaaccagccaaatcgcgtgaaggatgaaggtattatgtattgtaaacttcttttataggggaataaagtgcaccacgtgtggtgttttgtatgtaccctaggaataag

SEQ ID NO: 303 - DNA, 470 bp, Unknown
  Ascusbbf_1594, encodes 16S rRNA
agagtttgatcatggctcagagcgaacgctggcggcaggcctaacacatgcaagtcgaacggttccttcggggacagtggcagacgggtgagtaacgcgtgggaacgtgcccttcggttcggaataactcagggaaacttgagctaataccggatacgtccgagaggagaaagatttatcgccgaaggatcggcccgcgtctgattagctagttggtggggtaatggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctcttttgtccgggacgataatgacggtaccggaagaataagccccggctaacttcgtgccagcagccgcggtaat

SEQ ID NO: 304 - DNA, 490 bp, Unknown
  Ascusbbf_50788, encodes 16S rRNA
agagtttgatcctggctcagaacgaacgctggcggcgcgtcttaagcatgcaagtcgagcggcaagataccttcgggtatcctagagcggcggactggtgagtaacacgtagatgacgcaccctcgtgacggggatagcctgtggaaacacagggtaataccggataagcccgggagtactggaagctttcggggaaaggggctattgccccgcgggaggagcggtctgcggcccatcagctagttggcggggtaaaggcccaccaaggcgatgacgggtatccggcctgagagggtgatcgggcacattgggactgagatacggcccagactcctacgggaggcagcagctaagaatattccgcaatgcgcgaaagcgtgacggagcgacgccgcgtggacgatgaaggccggaaggttgcagagtcctttggcgcctgaggaaagggcaggggaatggaaagcccctgaattgactgtagggcgagaa

SEQ ID NO: 305 - DNA, 490 bp, Unknown
  Ascusbbf_7913, encodes 16S rRNA
agagtttgatcctggctcagaacgaacgctggcggcaggcttaacacatgcaagttggacgggaatcgattgatagcttgctattgattgaggagagtagcgcacgggtgagtaacacgtgggaacataccttatagtgggggataacaattggaaacgattgataataccgcataagtcctaagggagaaaggagtaattcgctataagattggcccgcggaagattaggcagttggtggggtaaaggcctaccaaacctacgatctatagctggtctgagaggacgatcagccacattgggactgagacacggcccaaactcctacgggaggcagcagtgaggaatattgggcaatgggggcaaccctgacccagccatgccgcgtgagtgaagaaggttttcgaattgtaaagctctttcggatgtgaagatgatgacggtagcatctaaagaagccccggcaaacttcgtgccagcagccgcggta

SEQ ID NO: 306 - DNA, 490 bp, Unknown
  Ascusbbf_37080, encodes 16S rRNA
agagtttgatcctggctcaggatgaacgctagctacaggcttaacacatgcaagtcgaggggcagcataagagaagcttgcttttcttgatggcgaccggcgcacgggtgagtaacgcgtatccaacctacccataagtagtgcatagcccggcgaaagtcggattaattcactatatgtttaattttggcatctttattaaacgaaagatttattgcttatggatggggatgcgtatgattagttagttggtgaggtaatggctcaccaaggctacgatcattaggggttctgagaggaaggtcccccacactggtactgagacacggaccagactcctacgggaggcagcagtgaggaatattggtcaatggacggaagtctgaaccagccaagtagcgtgtaggaagactgccctatgggttgtaaactacttttgttcgggagtaaagttagttacgtgtgactatttgcaagtaccgatcgaata

SEQ ID NO: 307 - DNA, 488 bp, Unknown
  Ascusbbf_378166, encodes 16S rRNA
agagtttgatcctggctcaggatgaacgctggcggcaggcttaacacatgcaagttgagcgggaatgattgatagcttgctattagtcatgagagcagcgcactggtgagtaacacgtgggaacatacctattggtgggggacaacagagggaaacttctgctaataccgcataagccctaagggggaaagatttattgccgatagattggcccgcggaagattaggtagtaggtggggtaacggcctacctagccgacgatctatagctggtctgagaggacgatcagccacattggaactgagacacggtccagactcctacgggaggcagcagtgaggaatattgggcaatggaggcaactctgacccagccatgccgcgtgagtgaagaaggttttcggattgtaaagctctttcagataagaagatgatgacggtattatcagaagaagcaccggctaacttcgtgccagcagccgcggtaat

SEQ ID NO: 308 - DNA, 490 bp, Unknown
  Ascusbbf_60233, encodes 16S rRNA
agagtttgatcatggctcagaacgaacgctggcggcgcgtcttaagcatgcaagtcgagcggcaagatatctccggatatcctagagcggcggactggtgagtaacgcgtggatgacgcacccttgtgacggggatagcctgtggaaacacagggtaataccggataagctcagtatcgttggagggtactgaggaaaggaactattgttccgcacgaggagcggtccgcgtcccatcagctagttggcggggtaaaggcccaccaaggcaatgacgggtacccggcctgagagggcgatcgggcacattgggactgagatacggcccagactcctacgggaggcagcagctaagaatattccgcaatgcgcgaaagcgtgacggagcgacgccgcgtggacgatgaaggccggaaggttgcagagtcctttggcgcccgaggaaagagcgggggaatggaaagcccctgaattgactgtagggcgagaa

SEQ ID NO: 309 - DNA, 490 bp, Unknown
  Ascusbbf_23519, encodes 16S rRNA
agagtttgatcatggctcagaacgaacgctggcggcgcgtcttaagcatgcaagtcgagcggtaagatatagcttgctatatcctagagcggcggactggtgagtaacacgtgggtgacatacccctcagaccgggatagctcctagaaataggagataataccagatacgacctatgttgtcagaggacatagaggaaagatgctacggcatcgctgaaggagtggcccgcggcccattagctagttggtagggtaacggcttaccaaggcgacgatgggtatccggcctaagagggtggacggacacattgggactgagatacggcccagactcctacgggaggcagcagctaagaatattccgcaatggacgaaagtctgacggagcgacgccgcgtggacgatgaaggccgaaaggttgtaaagtccttttgaatctgacgaataagcagtgcagggaatggcattgtggtgacggtaggatttga

SEQ ID NO: 310 - DNA, 490 bp, Unknown
  Ascusbbf_1070, encodes 16S rRNA
agagtttgatcatggctcagaacgaacgctggtggcgtgtcttatacatgcaagtcgagcggtccagcaatggatagcggcgaacgggtgagtaacgcgtaagcaatctgccccctgctcgggaatagccgtgccaacgcgcggataataccggatatcgtggggtcctgcatagggccttgacaaaagatttatcggcaggggatgagcttgcgtccgattagctagttggcggggcaacggcccaccaaggcgacgatcggtagccggcctgagagggtgatcggccacattgggactgagatacggcccagactcctacgggaggcagcagtagggaatattgcacaatgggggaaaccctgatgcagcaacgccacgtgtgggaagaagcatttcggtgtgtaaaccactgtcgtgagggaataaggctatttttcggagtagttgaatgtacctcgagaggaagcaccggcaaacttcgtgccag

SEQ ID NO: 311 - DNA, 490 bp, Unknown
  Ascusbbf_101875, encodes 16S rRNA
agagtttgatcatggctcaggatgaacgctggcggcgtgcctaacacatgcaagtcgagcgagaaacctgcgagttgatacttcggttgaaacatgcaggcggaaagcggcggacgggtgagtaacgcgtaggcaacctgccccatgcagagggatagcctcgggaaaccgggattaaaacctcataatgcgcagacgagacatctcgactgcgccaaagatttatcggcaagggatgggcctgcgtctgattagttagttggtgaggtaacggctcaccaaggcgacgatcagtagccgacctgagagggtgatcggccacattggaactgagacacggtccaaactcctacgggaggcagcagtggggaatattgcacaatgggggaaaccctgatgcagcaacgccgcgtgaaggatgaaggcccttgggtcgtaaacttctgttctaagggaagataatgacggtaccttaggagcaagtcccggc

SEQ ID NO: 312 - DNA, 490 bp, Unknown
  Ascusbbf_34081, encodes 16S rRNA
agagtttgatcatggctcaggatgaacgctagcggcaggcctaacacatgcaagtcgaggggcagcggggtagcaataccgccggcgaccggcgcacgggtgagtaacgcgtatgtaacctagttcacaaagagggatagccttccgaaagggagattaataccacatatgatgatagcttcgcatggagtagtcatgaaaaatttattgatgtgaaatggacatgcgtctgattagatagtaggcggggtaacggcccacctagtcgacgatcagtaggggttctgagagggagatcccccacattggtactgagacagggaccaaactcctacgggaggcagcagtgaggaatattggtcaatggacggaagtctgaaccagccaagtcgcgtgcaggaagacggccctatgggttgtaaactgcttttgtacgagggtaaaaggcgctatgtatagtgttttgaaagtaccgtacgaataaggatcg

SEQ ID NO: 313 - DNA, 490 bp, Unknown
  Ascusbbf_1849914, encodes 16S rRNA
agagtttgatcctggctcaggatgaacgctggcggcgtgcctaacacatgcaagtcgagcgagaaacctctttgaagatacttcggttgattctgtgaggcggaaagcggcggacgggtgagtaacgcgtaggcaacctgcccttagcagagggatagcctcgggaaaccgggattaaaacctcataatacgccatcaagacatcttggaggcgtcaaagatttatcggctaaggatgggcctgcgtctgattagttagttggtggggtaacggcctaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaaggatgaaggcccttgggtcgtaaacttccgttctaagggaagatagtgacggtaccttaggagcaagtcccggc

SEQ ID NO: 314 - DNA, 490 bp, Unknown
  Ascusbbf_67638, encodes 16S rRNA
agagtttgatcctggctcaggatgaacgctagcggcaggcttaacacatgcaagtcgaggggcagcgcggtgtagcaatacattggcggcgaccggcgaaagggtgagtaacgcgtgagcaacatgcccgttgcagggggatagtcattggaaacgatgcgtaataccccgtaatatcatggatcgcatggtttatgattgaaagatttatcggcgacggattggctcgcgtaccattagctagatggcggggtaacggcccaccatggctacgatggttaggggttctgagaggaaggtcccccacattggaactgagacacggtccagactcctacgggaggcagcagtgaggaatattggtcaatggccgagaggctgaaccagccatgccgcgtgcgggaagacggccctatgggttgtaaaccgcttttttgtgggagcaataagttgcacgtgtgcaatgatgagagtaccatgagaataagca

SEQ ID NO: 315 - DNA, 490 bp, Unknown
  Ascusbbf_4908, encodes 16S rRNA
agagtttgatcctggctcaggacgaacgctggcggcgtgcctaacacatgcaagtcgaacgaagttattacgctgaaatgatattagcttgctaaaggaatttcttgtaatgcttagtggcggacgggtgagtaacgcgtgagcaacctgcctttcagagggggacaacagttggaaacgactgctaataccgcataacattgtttaaagacatctttagataatcaaaggagcaatccgctgaaagatgggctcgcgtccgattagatagttggcggggtaacggcccaccaagtcgacgatcggtagccggactgagaggttgatcggccacattgggactgagacacggcccagactcctacgggaggcagcagtgggggatattgcacaatgggcgaaagcctgatgcagcaacgccgcgtgagggaagaaggtcttcggattgtaaacctttgtcctaagtgaagaaacaaatgacggtaactta

SEQ ID NO: 316 - DNA, 490 bp, Unknown
  Ascusbbf_1591684, encodes 16S rRNA
agagtatgatcctggctcaggacgaacgctggcggcatgcctaacacatgcaagtcgaacggaataggtttagctgtagcgatacttttgaacctatttagtggcgaacgggtgagtaacacgtgagcaacctgccttttacacagggataacagttggaaacgactgctaataccggataagaccacaccgaggcatctcggaggggtcaaagcgttttagcggtaaaagatgggctcgcgtcccattagctagttggtgagataacagcccaccaaggcgacgatgggtagccgacttgagagagtgatcggccacattggaactgagacacggtccagactccttcgggaggcagcagtggggaatattgggcaatggaggaaactcttacccagcaatgccgcgtgaatgaagaaggccttcgggttgtaaagttcttttgttgatgataaagaaagtgatattagtcaatgaataagccccggct

SEQ ID NO: 317 - DNA, 490 bp, Unknown
  Ascusbbf_41469, encodes 16S rRNA
agagtttgatcatggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtaccta

SEQ ID NO: 318 - DNA, 490 bp, Unknown
  Ascusbbf_48476, encodes 16S rRNA
agagtttgatcatggctcaggatgaacgctggcggcgtgcctaacacatgcaagtcgagcgagaagctttccagaagatacttcggttgattcagggaagtggaaagcggcggacgggtgagtaacgcgtaggcaacctgccccttgcagagggatagcctcgggaaaccgggattaaaacctcataatgcggtgagaagacatcttcatatcgccaaagatttatcggcaagggatgggcctgcgtctgattagttagttggtggggtaacggcctaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaaggatgaaggcccttgggtcgtaaacttctgttctaagggaagatagtgacggtaccttaggagcaagtcccggc

SEQ ID NO: 319 - DNA, 490 bp, Unknown
  Ascusbbf_90324, encodes 16S rRNA
agagtttgatcctggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaag

SEQ ID NO: 320 - DNA, 490 bp, Unknown
  Ascusbbf_67509, encodes 16S rRNA
agagtttgatcctggctcaggacgaacgctggcggcgcgcctaacacatgcaagtcgaacgaggttggacttcggtttaaccgagtggcggacgggtgagtaacacgtgagcaatctgcctctgagagtggaataccagccggaaacagctgttaataccgcatgatgtattgggagggcatccttctgataccaaagatttatcgctcagagatgagctcgcgtccgattagatagttggcggggtaacggcccaccaagtcgacgatcggtagccggactgagaggttgaacggccacattgggactgagacacggcccagactcctacgggaggcagcagtgggggatattgcacaatgggggaaaccctgatgcagcgacgccgcgtgcaggaagacggtcctctggattgtaaactgctgtgttcagggacgataatgacggtacctgaatagaaagctccggctaactacgtgccagcagccgc

SEQ ID NO: 321 - DNA, 490 bp, Unknown
  Ascusbbf_227627, encodes 16S rRNA
agagtttgatcctggctcaggatgaacgctagcgacaggcttaacacatgcaagtcgaggggcagcatgggagcggcaacgctcccgatggcgaccggcgcactggtgagtaacacgtatgcaacctgccccgccgcggggaatagtccggggaaacccggcgtaatgccccatgtgccgcgacgccgcatggcgtttcggtgaaagctccggcgcgacgggatgggcatgcggcgcattagctggttggcggggcaacggcccaccaaggctacgatgcgtaggggttctgagaggaaggtcccccacactggtactgagacacggaccagactcctacgggaggcagcagtgaggaatattggtcaatggccggaaggctgaaccagccaagtcgcgtgcgggaagtaggccctacgggtcgtgaaccgctttagccggggagcaacgggccggacgcgtccggccgtgagagtacccggagaataag

SEQ ID NO: 322 - DNA, 490 bp, Unknown
  Ascusbbf_5141, encodes 16S rRNA
agagtttgatcatggctcaggatgaacgctggcggcgtgcctaacacatgcaagtcgaacgaagcactcttgtagatccttcgggtgaaactttagtgactgagtggcggacgggtgagtaacgcgtgggtaacctgccctgtacagggggataacagtcagaaatgactgctaataccgcataagcgcacgagaggacatcctcatgtgtgaaaaactccggtggtacaggatgggcccgcgtctgattagctggttggcggggtaaaggcccaccaaggcgacgatcagtagccggtctgagaggatgaacggccacattggaactgagacacggtccaaactcctacgggaggcagcagtggggaatattgcacaatggggggaaccctgatgcagcaacgccgcgtgagtgaagaagtatttcggtatgtaaagctctatcagcagggaagataatgacggtacctgactaagaagctccggctaa

SEQ ID NO: 323 - DNA, 490 bp, Unknown
  Ascusbbf_15135, encodes 16S rRNA
agagtttgatcatggctcagaacgaacgctggcggcgcgtcttaagcatgcaagtcggacggcagggtgccttcgggcatccgagagtggcgaacgggtgagtaacacgtaagtgatctgccctccagttggggatagcctgtggaaacacagggtaataccggatgagatgacaatgattgaactatgtcatgaaagtggctacggccacgctgggggatgagcttgcggctcattagctagttgggggtgtaacggaccaccaaggcgacgatgagtagccggcctgagagggtgaacggccacattgggactgagacacggcccagactcctacgggaggcagcagctaagaatattccgcaatggggggaaccctgacggagcgacgccgcgtgaacgatgaaggcagagatgttgtaaagttcttttatcactgaagaataaccggaccagggaatgggtgcgggatgacgttaggtgatgaata

SEQ ID NO: 324 - DNA, 468 bp, Unknown
  Ascusbbf_11247, encodes 16S rRNA
agagtttgatcatggctcagagcgaacgctggcggcaggcctaacacatgcaagtcgagcgcccagcaatgggagcggcagacgggagagtaacacgtgggaacgtacccttcagtacggaacaaccaagggaaactttggctaataccgtatacgtccgtaaggagaaagatttatcgctgaaggatcggcccgcgtctgattagcttgttggtgaggtaatggctcaccaaggcgacgatcagtagctggtctgagaggatgatcagcctcactgggactgagacacggcccagactcctacgggaggcagcagtggggaatattggacaatgggcgaaagcctgatccagccatgccgcgtggatgatgaaggccttagggttgtaaagtcctttcgacggggaagataatgacggtacccgtagaagaagccccggctaacttcgtgccagcagccgcggtaat

SEQ ID NO: 325 - DNA, 490 bp, Unknown
  Ascusbbf_26898, encodes 16S rRNA
agagtttgatcctggctcaggatgaacgctggcggcaggcttaatacatgcaagtcgaacggtaaggtctgaagtagcaatactaaagatacacgagtggcgcacgggtgcgtaacgcgtatgtaatctacccttaaccggaacaaaacagttggaaacgactgctaatattccatagtcattagttaaggcatcttaaagaatgtaaagatttattggttaaggatgagcatgcgtattattaggtagttggtagggtaacggcctaccaagccgacgatgattaggggtcctgagagggttaacccccacactggaactgagacacggtccagactcctacgggaggcagcagtagggaatattgggcaatggaggaaactctgacccagccatgccgcgtgaaggaagacggtcctatggattgtaaacttcttttattgcagagtaaaattagatacgtgtatttaattgagagtatgcgatgaat

SEQ ID NO: 326 - DNA, 485 bp, Unknown
  Ascusbbf_5842, encodes 16S rRNA
agagtttgatcatggctcagaacgaacgctggcggcaggcttaacacatgcaagtcgaacggaacatagagtgcttgcactttatgtcagtggcgcacgggtgagtaacgcgtaggtatctgtctgttggacggggatagcctctggaaacggagggtaaaacccggtaaggcctgagggcgagacgagaaatcggccgacagaggagcctgcgttagattaggcagttggtggggtaacggcctaccaaaccgacgatctatagctggtctgagaggatgatcagccacattgggactgagacacggcccaaactcctacgggaggcagcagtggggaatattggacaatgggggagaccctgatccagccatgccgcgtgagtgaagaaggccttcgggttgtaaagctcttttacacgggaagatgatgacggtaccgtgagaataagcaccggctaacttcgtgccagcagccgcggtaat

SEQ ID NO: 327 - DNA, 490 bp, Unknown
  Ascusbbf_3110, encodes 16S rRNA
agagtttgatcctggctcaggacgaacgctggcggtatgcttaacacatgcaagtcgaacgagaagctgtctaatgaaccttcgggtgatttagagagtggatagtggcgaacgggtgagtaacgcgtgggcaacctgcctttcggagcggaatagcctcgggaaaccgggagtaaagccgcataacattattttttcgcatgaagagataatcaaaactccggtgccgaaagatgggcccgcgtcctattagctagttggtgaggcaacggctcaccaaggcgacgataggtagccggtctgagagggcgaacggccacactggaactgagacacggtccagactcctacgggaggcagcagtggggaatattgcgcaatgggggcaaccctgacgcagcaataccgcgtgagtgaagaaggttttcggatcgtaaagctctgttattggggaagaagaagtgacggtacccaatgaggaagtcccggc

SEQ ID NO: 328 - DNA, 490 bp, Unknown
  Ascusbbf_1507577, encodes 16S rRNA
agagtttgatcctggctcaggatgaacgctagctacaggcttaacacatgcaagtcgaacgagaagctgacttcggtcagtggaaagtggcggacgggtgagtaatgtgtagagaatctgccctagagagagggacaacagttggaaacgactgctaatacctcatatgcgcgtagctgagatgctattcgtgaaaactccggtgctctgggatgagtctgcatctgattagctagttggcggtgtaatggaccaccaaggcgacgatcagtagctggtttgagaggatgatcagccacaatgggactgagacacggcccatactcctacgggaggcagcagtagggaattttgcgcaatgggggaaaccctgacgcagcaacgccgcgtgattgaataagcccttcggggtgtaaagatctgtcagtagggacgaaacttgacggtacctacagaggaagcatcggctaactccgtgccagcagccgcg

SEQ ID NO: 329 - DNA, 490 bp, Unknown
  Ascusbbf_17170, encodes 16S rRNA
agagtttgatcatggctcaggacgaacgctggcggcgtgcctaacacatgcaagtcgaacgaagctccggatcggattcttcggatgaagagaaggaagacttagtggcggacgggtgagtaacgcgtgagcaacctgcctttcagagggggataacagttggaaacgactgctaataccgcataacataagatcatcgcatggtggttttatcaaagctgaggcgctgaaagatgggctcgcgtccgattagatagttggtggggtaacggcctaccaagtcgacgatcggtagccggactgagaggttgaacggccacattgggactgagacacggcccagactcctacgggaggcagcagtgggggatattgcacaatgggcgaaagcctgatgcagcaacgccgcgtgagggaagacggttttcggattgtaaacctctgtctttggtgaagaagaaagtgacggtagccaaggaggaagccacgg

SEQ ID NO: 330 - DNA, 490 bp, Unknown
  Ascusbbf_15733, encodes 16S rRNA
agagtttgatcatggctcagattgaacgctggcggcaggcttaacacatgcaagtcgaacggtagcaggaagaaagcttgctttctttgctgacgagtggcggacgggtgagtaatgcttgggaatctggcttatggagggggataactgtgggaaactgcagctaataccgcgtattctctgaggaggaaagggtgggaccttagggccacctgccataagatgagcccaagtgggattaggtagttggtggggtaaaggcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtaatgaggaagggatgttattaaatagatagcatcattgacgttaattacaga

SEQ ID NO: 331 - DNA, 488 bp, Unknown
  Ascusbbf_1445914, encodes 16S rRNA
agagtttgatcctggctcagaacgaacgctggcggcaggcttaacacatgcaagttgagcgggattgattagtagcttgcttttgatcatgcgagcagcgcactggtgagtaacacgtgggaacataccttttggtgggggacaacagttggaaacgactgctaataccgcataagccctgagggggaaagattaattgccgagagattggcccgcggaagattaggtagtaggtggcgtaacggcctacctagccgacgatctatacctggtctgagaggacgatcagccacattggaacggagacacggtccagactcctacgggagacagcagagaggaatattgggcaagggagggaactctgacccagccaggccgcgtgagggaagaaggttttcggattgtaaagcactttcagacgggaagatgatgacggtaccgtcggaagaagcaccggctaactccgtgccagcagccgcggtaat

SEQ ID NO: 332 - DNA, 490 bp, Unknown
  Ascusbbf_25683, encodes 16S rRNA
agagtttgatcatggctcaggatgaacgctggcggcgtgcttaacacatgcaagtcgaacgagaacgtttccttcggggaactagtaaagtggcgaacgggtgagtaacacgtgggcaacctgccccttacattgggataacgcagagaaatttgcgctaataccggatacttcgttttgagggcatcctctttacgagaaagcttttgcggtaagggatgggcccgcggtccattagcttgttggtggggtaacggcctaccaaggcgacgatggatagccggcttgagagagtgatcggccacattgggactgagacacggcccagactcctacgggaggcagcagtggggaattttgcgcaatgggggcaaccctgacgcagcaacgccgcgtgcgggatgacggccttcgggttgtaaaccgctttcagaagggaagaatttagacggtaccttcagaagaagctccggctaactacgtgccagca

SEQ ID NO: 333 - DNA, 490 bp, Unknown
  Ascusbbf_44146, encodes 16S rRNA
agagtttgatcatggctcaggatgaacgctggcggcgtgcctaacacatgcaagtcgaacggatttcctaatgacagaggcttcggccgacgaagtttggaagttagtggcggacgggtgagtaacgcgtggagaacctgccctgtactgggggataacatcaggaaactggtgctaaaaccgcataagcgcacaggaccgcatggtctggtgtgaaaaactccggtggtacaggatggctccgcgttggattagccagttggcggggtaacggcccaccaaagcgacgatccatagccggcctgagagggtgaacggccacattgggactgagacacggcccagactcctacgggaggcagcagtggggaatattgcacaatggggggaaccctgatgcagcgacgccgcgtgaaggaagaagtatctcggtatgtaaacttctatcagcagggaagaaaatgacggtacctgactaagaagccccggc

SEQ ID NO: 334 - DNA, 490 bp, Unknown
  Ascusbbf_90222, encodes 16S rRNA
agagtttgatcatggctcagaatgaacgctggcggcatggattaggcatgcaagtcggacggggtgcagaaatgcacccagtggcgaaagggtgcgcaacgcgtggggaacctgcccccggatccgggacaagcgctggaaacggcgtctgatacgggatgaggacggccgccgcatgggggccgctccaaagattcatcgtccggggagggccccgcgtcccattagctggttggcggggtatcggcccaccaaggctacgacgggtaggtggtctgagaggatggtcacccacactgggactgagacactgcccagactcctacgggaggctgcagtcgagaatcttccgcaatgggcgcaagcctgacggagcgatgccgcgtgggggacggaggccttcgggtcgtgaacccctgtcacccgggacgaagaaagcgacggtaccgggagaggaagccacggctaactacgtgccagcagccgcggt

SEQ ID NO: 335 - DNA, 490 bp, Unknown
  Ascusbbf_397404, encodes 16S rRNA
agagtttgatcatggctcaggacgaacgctggcggcgtgcttaacacatgcaagtcgaacgaagcggcagtgaaggaggcttcggccaatggatctgtcgacttagtggcggacgggtgagtaacgcgtgagcaacctgcctttcagagggggataacgtttggaaacgaacgctaataccgcataaagtattttcgctgcatgacggagataccaaaggagcaatccgctgaaagatgggctcgcgtccgattagatagttggtggggtaacggcctaccaagtcgacgatcggtagccggactgagaggttgaacggccacattgggactgagacacggcccagactcctacgggaggcagcagtggggaatattgcacaatgggcgcaagcctgatgcagcaacgccgcgtgagggaagacggttttcggattgtaaacctttgtccttggtgaagatcatgacggtagccgaggaggaagccacgg

SEQ ID NO: 336 - DNA, 490 bp, Unknown
  Ascusbbf_388454, encodes 16S rRNA
agagtttgatcctggctcaggatgaacgctggcggcgtgcttaacacatgcaagtcgaacgaagcacttgaccttcgggtcttgtgactgagtggcggacgggtgagtaacgcgtgggtaacctgccctgtacagggggataacagttagaaatgactgctaataccgcataagcatacggagaggcatctctctgtgtgaaaaactccggtggtacaggatgggcccgcgtctaattagctggttggcagggtaacggcctaccaaggcgacgatcagtagccggtctgagaggatgaacggccacattggaactgagacacggtccaaactcctacgggagacagcagtggggaatattgcacaatgggggaaaccctgatgcagcaacgccgcgtgagtgatgaagtatttcggtatgtaaagctctatcagcagggaagatgatgacggtacctgactaagaagctccggctaaatacgtgccagc

SEQ ID NO: 337 - DNA, 490 bp, Unknown
  Ascusbbf_299823, encodes 16S rRNA
agagtttgatcatggctcagaacgaacgctggcggcgtgcttaacacatgcaagtcgaacgcgaaagcggcttcggtcgcaagtagagtggcgcacgggtgagtaacgcgtagataacctgccttcatgtccgggataacacgccgaaaggggtactaataccggatacccttgcatttcacaagtaaggcaaggaaaggtggcctctgattcaagctactgcatgaagaggggtctgcgtaccattagctagtaggtggggtaatggcctacctaggcaacgatggttagcgggtctgagaggatgatccgccacactggcactggaatacgggccagactcctacgggaggcagcagtgaggaatattgcgcaatgggggcaaccctgacgcagcgacgccgcgtgagtgaagaaggtcttcggatcgtaaagctctgtcaagagggaagaagtgcgaggcggctaatatctgtctcgtttgacggta

SEQ ID NO: 338 - DNA, 490 bp, Unknown
  Ascusbbf_706339, encodes 16S rRNA
agagtttgatcctggctcaggatgaacgctagcgacaggcttaacacatgcaagtcgaggggcatcgcgggggtggcaacactcctggcggcgaccggcgcactggtgagtaacacgtatgcaacctgcccccggcagagggataaacccgggaaactgggcctaatacctcatgcgccgcgagcccgcatgggtttgcggtgaaaggattccggccggggatgggcatgcggcgcattagctggttggcggggcaacggcccaccaaggcgacgatgcgtaggggttctgagaggaaggtcccccacactggtactgagacacggaccagactcctacgggaggcagcagtgaggaatattggtcaatgggcgggagcctgaaccagccaagtcacgtgggggatgacggtcctacggattgtaaacccctttagccggggagcaacgggcgccacgcgtggcgcattgagcgtacccggagaataagc

SEQ ID NO: 339 - DNA, 490 bp, Unknown
  Ascusbbf_138539, encodes 16S rRNA
agagtttgatcatggctcaggacgaacgctggcggcgtgcctaacacatgcaagtcgaacggagtttatttttcggagtccctcgggacaaagagctataaacttagtggcggacgggtgagtaacgcgtgagtaacctgccttacagagggggacaacagttggaaacgactgctaataccgcataaagtacaaagaaggcatcttcattgtaccaaaggagcaatccgctgtaagatggactcgcgtccgattagatagttggtgaggtaacggctcaccaagtcgacgatcggtagccggactgagaggttgaacggccacattgggactgagacacggcccagactcctacgggaggcagcagtgggggatattgcacaatggaggaaactctgatgcagcaacgccgcgtgagggaagaaggttttcggattgtaaacctctgttttcagtgaagaaacaaatgacggtagctgaagaggaagcc

SEQ ID NO: 340 - DNA, 490 bp, Unknown
  Ascusbbf_335247, encodes 16S rRNA
agagtttgatcatggctcaggacgaacgctggcggcgtgcctaacacatgcaagtcgaacgaagctcccggatatgagattcgtcaaattgaagggatgacttagtggcggacgggtgagtaatgcgtgagcaacctgcccttcggagggggacaacagctggaaacggctgctaataccgcataatgtatcgtgaaggcatcttcgtgataccaaagatttatcgccgagggatgggctcacgtctgattagcttgttggtggggcaacggcccaccaaggctgcgatcagtagccggactgagaggttgaacggccacattgggactgagatacggcccagactcctacgggaggcagcagtggggaatattgggcaatgggggaaaccctgacccagcaacgccgcgtgaaggaagaaggctttcgggttgtaaacttcttttaacagggaagataatgacggtacctgttgaataagccacggcta

SEQ ID NO: 341 - DNA, 490 bp, Unknown
  Ascusbbf_297163, encodes 16S rRNA
agagtttgatcatggctcaggataaacgctggcggcgcacataagacatgcaagtcgaacggacgagattagattctttacgattctaatcaagttagtggcggactggtgagtaacgcgtgagcaacctacctattagaggggaacaacagagagaaatttctgctaataccgcataagctgatagaatcgcatgatttagtcagaaaaggagcaatccgctaatagatgggctcgcgtccgattagctagttggtaaggtaacggcttaccaaggcgacgatcggtagccggactgagaggttgaacggccacattgggactgagatacggcccagactcctacgggaggcagcagtcgggaatattgcgcaatggaggaaactctgacgcagtgacgccgcgtataggaagaaggttttcggattgtaaactattgtcgttagggaagagaaaggacggtacctaaggaggaagccccggctaacta

SEQ ID NO: 342 - DNA, 490 bp, Unknown
  Ascusbbf_387558, encodes 16S rRNA
agagtttgatcctggctcaggatgaacgctggcggcgtgcttaacacatgcaagttgaacgaaggtactggaggaggcttcggcggaatccggtatacttagtagcggacgggtgagtaacgcgtgggcaacctgccctgtacagggggacaacagctggaaacggctgctaataccgcataagcgcacagcaccgcatggtgccgtgtgaaaagcgcaacggtacaggatgggcccgcgtctgattaggcagttggcggggtaacggcccaccaaaccgacgatcagtagccgacctgagagggtgaccggccacattgggactgagacacggcccaaactcctgcgggaggcagcagtggggaatattgcacaatggaggaaactctgatgcagcgacgccgcgtgagtgaagaagtatttcggtatgtaaagctctatcagcagggaagaaaatgacggtacctgcacaagaagccccggctaacta

SEQ ID NO: 343 - DNA, 490 bp, Unknown
  Ascusbbf_1873556, encodes 16S rRNA
agagtttgatcctggctcaggacgaacgctggcggcacgcttaacacatgcaagtcgaacgagcgaaaagtgcttgcacttctagctagtggcggacgggtgagtaacacgtgagcaatctgcctttcggtgggggataccaattggaaacgattgttaataccccataacatagtggtaccgcatgatactgctatcaaagatttattgccgaaagatgagctcgcgtctgattaggtagttggtgaggtaacggcccaccaagccgacgatcagtagccggactgagaggttgaacggccacattgggactgagacacggcccagactcctacgggaggcagcagtggggaatattgcacaatgggcgaaagcctgatgcagcgatgccgcgtgagggaagaaggttttaggattgtaaacctctgtctttggggacgataatgacggtacccaaggaggaagctccggctaactacgtgccagcagc

SEQ ID NO: 344 - DNA, 490 bp, Unknown
  Ascusbbf_138829, encodes 16S rRNA
agagtttgatcatggctcaggatgaacgctagcggcaggcttaacacatgcaagtcgaggggcagcgcggggtagcaatactctggcggcgaccggcgaaagggtgagtaacgcgtgagcaacatgcccttgggtgggggatagtcattggaaacgatgcgtaataccccgtacgacgagagaccgcatgatttttcgttaatagatttattgcccaaggattggctcgcgtgccattagctagttggcggggtaacggcccaccaaggcgacgatggctaggggttctgagaggaaggtcccccacattggaactgagacacggtccagactcctacgggaggcagcagtgaggaatattggtcaatggccgagaggctgaaccagccatgccgcgtgcgggaggacggccctatgggttgtaaaccgcttttgttggggagcaataaggagcacgtgtgctttgatgagagtacccagcgaataagca

SEQ ID NO: 345 - DNA, 490 bp, Unknown
  Ascusbbf_285223, encodes 16S rRNA
agagtttgatcatggctcaggacgaacgctggcggcgtgcttaacacatgcaagtcgaacgaggcaagttccttcggggacttaccgagtggcggacgggtgagtaacgcgtgagcaatctgtcccggacagggggataacaactggaaacagttgctaataccgcataagaccacggagtcgcatggcactgaggtaaaaggatttatccggttcggggtgagttcgcgtctgattagatagttggcgaggtaacggctcaccaagtcgacgatcagtagccgacctgagagggtgaccggccacattgggactgagacacggcccagactcctacgggaggcagcagtggggaatattgggcaatgggggaaaccctgacccagcaacgccgcgtgagggaagaaggttttcggattgtaaacctctgtccttggggacgaagtaagtgacggtacccgaggaggaagccccggctaactacgtgcca

SEQ ID NO: 346 - DNA, 490 bp, Unknown
  Ascusbbf_237948, encodes 16S rRNA
agagtttgatcatggctcaggatgaacgctggcggcgtgcctaacacatgcaagtcgaacgaagcgcccggaacagaggattcgtccgaagggaagggatgactgagtggcggacgggtgagtaacgcgtggaaaacctgccccatgcagggggacaacagggagaaatccctgctaataccgcataagcgcacggcacggcatcgtgcagtgtgaaaagatttatcggcatgggatggttccgcgtccgattagccagctggcggggtaacggcccaccagggcagcgatcggtagccggcctgagagggcggacggccacattgggactgagacacggcccagactcctacgggaggcagcagtgggggatattgcacaatggggggaaccctgatgcagcgacgccgcgtgggtgaagaagtatttcggtatgtaaagccctatcggcagggaagatgatgacggtacctgactaagaagccccggc

SEQ ID NO: 347 - DNA, 490 bp, Unknown
  Ascusbbf_1608739, encodes 16S rRNA
agagtttgatcatggctcaggatgaacgctagctacaggcttaacacatgcaagtcgaggggcagcgctggggttgcttgcaacccctggcggcgaccggcggatgggtgagtaacgcgtatccaacctgccccgtgcccggggacagcccttagaaatgaggattaacccccgatggcgtgctcgcgccgcatggcgcttgcactaaaccggcacgggatggggatgcgttccattaggtcgcaggcggggtaacggcccacctggccgacgatggataggggttctgagaggaaggtcccccacactggtactgagacacggaccagactcctacgggaggcagcagtgaggaatattggtcaatgggcggaagcctgaaccagccaagtagcgtgcgggatgaaggccctacgggttgtaaaccgcttttgcgcggggataaaacgcgggacttgtcccgccttgcaggtaccgcgcgaataaggac

SEQ ID NO: 348 - DNA, 490 bp, Unknown
  Ascusbbf_186025, encodes 16S rRNA
agagtttgatcatggctcaggataaacgctggcggcgtgcataacacattcaagtcgaacgaagctccggaacttgcttgcaagggaaggaagacttagtggcggacgggtgagtaacgcgtgagcaacctgcctgcaggtgcgggataacgtttggaaacgaacgctaataccgcatgacgcatggagatcgcatggtcatcatgccaaagatatattgcctgcagatgggctcgcgtccgattagacagttggcggggtaacggcccaccaaatcagcgatcggtagccggactgagaggttgaacggccacattggaactgagatacggtccagactcctacgggaggcagcagtggggaatattgggcaatgggcgaaagcctgacccagcgacgccgcgtgagggaagaaggtcttcggattgtaaacctctttcagcagggaagaaggaagtgacggtacctgcagaagaagccacggctaact

SEQ ID NO: 349 - DNA, 490 bp, Unknown
  Ascusbbf_425511, encodes 16S rRNA
agagtttgatcctggctcaggatgaacgctagcggcaggcttaacacatgcaagtcgaggggcagcgaggatagcaatatctgtcggcgaccggcggaagggtgagtaacgcgtgagcaacattcccgcatcagggggatagtcactggaaacggtgcgtaataccccgtaagatgttgagaggcatctcttggcattgaaagatttatcggatgcggattggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgatggagtgaggccctatgggtcgtaaacatcttttctcggggggcaataagggccacgagctggtccgatgagagtacccggggaataagcat

SEQ ID NO: 350 - DNA, 490 bp, Unknown
  Ascusbbf_399590, encodes 16S rRNA
agagtttgatcatggctcaggataaacgctggcggcgtgcctaatacatgcaagttgaacggagagcttcggctcttagtagcgaacgggtgagtaacacgtaggcaacctgccctgttgactgggataacaagacgaaagacttgctaataccggatgataacgtatatcgcatgatatatggatgaaagttgggacacaacacaacaggatgggcctgcggcgcattagctagatggtgagatagcagcccaccatggtaatgatgcgtagccgatctgagaggatgtacggccacattggaactgagacacggtccagactcctacgggaggcagcagtagggaattttcggcaatggagggaactctgaccgagcaacgccgcgtgaacgaagaaggccttcgggtcgtaaagttttgttgtttaggatgaaagatgcctgtagggaatgacaggcaagtgacagtactagacgaggaagtcacgg

SEQ ID NO: 351 - DNA, 490 bp, Unknown
  Ascusbbf_427611, encodes 16S rRNA
agagtttgatcctggctcaggacgaacgctggcggcgcgcttaacacatgcaagtcgaacggacgaccccggaacagagattcgttgacgggaaggggaagttagtggcgaacgggtgagtaacacgtgaagaacctgcctcagagagggggataacacttagaaataggtgctaataccgcatatgaccacactaccgcatggtagagaggtgaaaggagcaatccgctctgagatggcttcgcgtccgattagctagatggcggggtaacggcccaccatggcgacgatcggtagccggactgagaggtcgatcggccacattgggactgagacacggcccagactcctacgggaggcagcagtggggaatattgcacaatggaggaaactctgatgcagcgacgccgcgtgagggaagaaggttttcggattgtaaacctctgtcctcggggacgaaaaaatgacggtactcggggaggaagccacg

SEQ ID NO: 352 - DNA, 490 bp, Unknown
  Ascusbbf_438855, encodes 16S rRNA
agagtttgatcctggctcaggataaacgctggcggcgcacataagacatgcaagtcgaacggacttaactcgaagtttactttgagagcggttagtggcggactggtgagtaacgcgtgagcaacctgcctatcagaggggaataacagtgagaaatcattgctaataccgcatatgctcacagtaacacatgttacagtgaggaaaggagcaatccgctgatagatgggctcgcgtctgattagctagttggtggggtaaaggcctaccaaggcgacgatcagtagccggactgagaggttgaacggccacattgggactgagatacggcccagactcctacgggaggcagcagtcgggaatattgcgcaatggaggaaactctgacgcagtgacgccgcgtatgggaagaaggttttcggattgtaaaccattgtcgttagggaagaaaaaaatgacagtacctaaggaggaagctccggctaactat

SEQ ID NO: 353 - DNA, 490 bp, Unknown
  Ascusbbf_715972, encodes 16S rRNA
agagtttgatcatggctcaggatgaacgctggcggtgtgcctaatacatgcaagtcgaacggagttgatgggagcttgctccttgatacttagtggcgaacgggtgagtaacacgtaggtaacctgccctttagcttgggatacccagaggaaactttggctaataccggataacaacaaccgaggcatctcggatgcttgaaaggcccttttgggtcactaaaggatggacctgcggcgcattagctagttggtgagataatagcccaccaaggcgaggatgcgtagccgaactgagaggttgatcggccacatggaaactgagacacggttccaactcctacgggaggcagcagtaaggagttttcggcaatgggggaaaccctgaccgagcaacaccgcgtgagtgatgacggccctatgggttgtaaagctctgttgtaggggaagaaatgtgagggtagtggaatgaccttcacttgacggtacc

SEQ ID NO: 354 - DNA, 490 bp, Unknown
  Ascusbbf_1778922, encodes 16S rRNA
agagtttgatcatggctcaggatgaacgctggcggcgtgcctaacacatgcaagtcgaacgaggctcttccctttgatgtttcgactgattagggaagatcaccgagtggcggatgggtgagtaacgcgtggagaacctgcccccatcagggggataacaactggaaacggttgataataccgcatatatgataggaccgcatgatcctatcaggaaagatttatcggatggggatggctccgcgttggattagttagttggtggggtaacggcctaccaagaccgcgatccatagccggcctgagagggcgaccggccacattgggactgagacacggcccagactcctacgggaggcagcagtggggaatattgcacaatgggcgcaagcctgatgcagcgacgccgcgtggagggggaagtatttcggtatgtaaactcctatcagcagggaagaaaatgacggtacctgactaagaagccccggct

SEQ ID NO: 355 - DNA, 490 bp, Unknown
  Ascusbbf_1068486, encodes 16S rRNA
agagtttgatcctggctcaggatgaacgctggcggcgtgcttaacacatgcaagtcgaacggagtattgacgctgcagagatttcggtcgaagcttgttaatacttagtggcggacgggtgagtaacgcgtgggtaacctgccgtatgcagggggacaacagttggaaacgactgctaataccgcataagcgcacggttttgcatgaaacagtgtgaaaagatttatcggcatacgatggacccgcgtttgattagctagttggtgaggtaacggcccaccaaggctacgatcaatagccggcctgagagggcaatcggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagatgatgacggtacctgactaagaagccccgg

SEQ ID NO: 356 - DNA, 490 bp, Unknown
  Ascusbbf_734500, encodes 16S rRNA
agagtttgatcctggctcaggatgaacgctggcggcgtgcttaacacatgcaagtcgaacgaagcgcttgaacagatctcttcggagtgacgttcttgtgacttagtggcggacgggtgagtaacgcgtgggtaacctgcccttatctgggggataacagttagaaatgactgctaataccgcataagcgcacactgaggcatctcagagtgtgaaaagatttatcggataaggatggacccgcgttagattagccggttggcggggtaacggcccaccaaagctacgatctatagccggcctgagagggcgaccggccacattgggactgagacacggcccaaactcctacgggaggcagcagtgaggaatattgcacaatgggggaaaccctgatgcagcgacgccgcgtgagtgatgaagtatttcggtatgtaaaactctatcagcagggaagaagaaggacggtacctgactaagaagccccggc

SEQ ID NO: 357 - DNA, 490 bp, Unknown
  Ascusbbf_866920, encodes 16S rRNA
agagtttgatcctggctcaggatgaacgctggcggcgtgcttaatacatgcaagtcgaacgagagagtttagatagcttgctatttgaatgatctagtggcgaacgggtgagtaatacataggcaatctaccctaaggactgggataacgattagaaatgatcgctaataccggataggtaataagaaggcatcttcatattattaaagttgggtttccaacaccataggatgagcttatgctgtattagcttgttggcgggataacagcccaccaaggcgatgatacatagctggtctgagaggatgaacagccacattgggactgagacacggcccagactcctacgggaggcagcagtaaggaattttcggcaatgggcgaaagcctgaccgagcaacgccgcgtgagtgatgaaggttttcggatcgtaaagctctgttgtaaaggaagaatattatatataggaaatgatatataagtgacggta

SEQ ID NO: 358 - DNA, 490 bp, Unknown
  Ascusbbf_4999, encodes 16S rRNA
agagtttgatcatggctcagattgaacgctggcggcaggcttaatacatgcaagtcgaacggtagcagcaggaaagcttgcttttctggctgacgagtggcggacgggtgagtaatacctgggaaactgcctataagagggggataacacctggaaacgggtgctaataccgcataaaccctgaggggaaaaggatgggaaaccatgcgcttatagatgtgcccaggagggattagctagttggggaggtaaaggctcaccaaggcgacgatctctagctggtctgagaggatgatcagccacattgggactgggacacggcccaaactcctacgggaggcagcagtagggaatattgcacaatgggggaaaccctgatgcagccatgccgcgtgtgtgaagaaggccttcgggttgtaaagcactttcagcggggaggaagctgaagttcgaacagggcagaaagcagacgttacccgcagaagaagcg

SEQ ID NO: 359 - DNA, 490 bp, Unknown
  Ascusbbf_34298, encodes 16S rRNA
agagtttgatcatggctcaggatgaacgctggcggcgtgcctaatacatgcaagtcgaacgggtgcagcaatgcattagtggcgaacgggtgagtaacacgttggtgacctgccccaaagatgggaatatcacctggaaacgggtggcaaaaccgaataagcttgaccgagttagagaaagtcaagtaaaagagagatctactttgggaggggcctgcggcccatcagttagttggtgagggtaacggcccaccaagacgaagacgggtaggggacctgagagggtggtcccccacaatggaactgaaacacggtccatacacctgcgggtggcagcagtagggaatattgcttaatgggcgaaagcctgaagcagcaacgccgcgtggatgaagaaggccttcgggtcgtaaaatccttttacaggggacgaggaaggacggtaccctgtgaataagtctcggctaactacgtgccagcagccgcggta

SEQ ID NO: 360 - DNA, 490 bp, Unknown
  Ascusbbf_30981, encodes 16S rRNA
agagtttgatcctggctcaggatgaacgctagcggcaggcctaacacatgcaagtcgaggggtagaggggagcttgctctccttgagaccggcggacgggtgagtagcgcgtatggaatctgccttgtacaggggaatagcccagggaaacttggattaatgccccatagtgttgaggggcggcattgttcttcaactaaagatttatcggtacaagatgaccatgcgtcccattagcttgttggtgtggtaacggcacaccaaggctacgatgggtaggggccctgagagggggatcccccacactggtactgagacacggaccagactcctacgggaggcagcagtgaggaatattggacaatgggcgagagcctgatccagccatgccgcgtgcaggaagactgccctatgggttgtaaactgcttttatacgggaagaaacactccgacgtgtcggggcttgacggtaccgtatgaataaggatcg

SEQ ID NO: 361 - DNA, 490 bp, Unknown
  Ascusbbf_24303, encodes 16S rRNA
agagtttgatcatggctcaggacgaacgctggcggcgtgcctaatacatgcaagtcgagcggaccttagcgatcttcggatcgctcttggttagcggcggacgggtgagtaacacgtaggcaacctgcccgtaagaccgggataactaccggaaacggtagctaataccggataatttatcgcttcgcatggagtgataatgaaagacggagcaatctgtcacttacggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcgggtagagtaactgctacccgagtgacggtac

SEQ ID NO: 362 - DNA, 490 bp, Unknown
  Ascusbbf_7496, encodes 16S rRNA
agagtttgatcatggctcagattgaacgctagcgggatgccttacacatgcaagtcgaacggcagcgcgggcttcggcctggcggcgagtggcgaacgggtgagtaatgcatcggaacgtgcccagtagtgggggataaccacgcgaaagcgtggctaataccgcatacgcccttagggggaaagggggggatccttcgggacctctcgctattggagcggccgatgtcggattagctagttggtggggtaaaggcctaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaataggcctggctaatacctgggctgaatgacggtacctgcagaataagc

SEQ ID NO: 363 - DNA, 488 bp, Unknown
  Ascusbbf_740, encodes 16S rRNA
agagtttgatcctggctcagaacgaacgctggcggcaggcttaacacatgcaagttgagcgggattgattggtagcttgctactgatcatgagagcagcgcactggtgagtaacacgtgggaacataccttttggtgggggacaacagagggaaacttctgctaataccgcataagccctgagggggaaagatttattgccgaaagattggcccgcggaagattaggtagttggtggggtaacggcctaccaagcccgcgatctatagctggtctgagaggacgatcagccacattgggactgagacacggcccagactcctacgggaggcagcagtgaggaatattgggcaatggaggaaactctgacccagccatgccgcgtgagtgaagaaggttttcggattgtaaagctctttcggacgtgaagatgatgacggtagcgtctaaagaagccccggctaacttcgtgccagcagccgcggtaat

SEQ ID NO: 364 - DNA, 490 bp, Unknown
  Ascusbbf_66340, encodes 16S rRNA
agagtttgatcctggctcaggatgaacgctagcgggaggcttaacacatgcaagccgagggagaagttgttttcggacaacggacaccggcggacgggtgagtaacatgtatgcaacttgcctctatcagtgggataacccggggaaacccggactaataccgcataacaaatggatcagcattgatttattttaaaagatttatcggatagagataggcatgcgtaggattagttagttggtgaggtaacggctcaccaagacgatgatccttagggggcctgagagggtgatcccccacactggtactgagacacggaccagactcctacgggaggcagcagtgaggaatattggacaatgggtgagagcctgatccagccatcccgcgtgcaggaagacggccctatgggttgtaaactgcttttatacaggaataaacctactcacgtgtgagtagttgaaggtactgtaagaataagcatcggct

SEQ ID NO: 365 - DNA, 490 bp, Unknown
  Ascusbbf_12995, encodes 16S rRNA
agagtttgatcctggctcaggatgaacgctagcggcaggcttaacacatgcaagtcgaggggcatcgcggagtagcaatactctggcggcgaccggcgaaagggtgagtaacgcgtgagcaacatgcccgcatctgggggatagtcgatggaaacgtcgcgtaataccccgtaacaacagaggccgcatgacctttgtttaagagattcattgaatgcggattggctcgcgtgccattagatagttggtgaggtaacggcccaccaagtcgacgatggctaggggttctgagaggaaggtcccccacattggaactgagacacggtccagactcctacgggaggcagcagtgaggaatattggacaatggccgagaggctgatccagccatgccgcgtgcgggatgaaggccctatgggtcgtaaaccgcttttgtcggggagcaataagtgttacgtgtaacacgatgagagtacctggcgaataagca

SEQ ID NO: 366 - DNA, 489 bp, Unknown
  Ascusbbf_488214, encodes 16S rRNA
agagtttgatcctggctcaggatgaacgctggcggcgtgcctaacacatgcaagtcgagcgatttacttttgtaaagagcggcggacgggtgagtaacgcgtgggtaacctgccctgtacacacggataacataccgaaaggtatgctaatacgagatgatatacttttatcacatggtggaagtatcaaagcttttgcggtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaat

SEQ ID NO: 367 - DNA, 490 bp, Unknown
  Ascusbbf_31955, encodes 16S rRNA
agagtttgatcatggctcaggataaacgctggcaccatgcctaatacatgcatgtcgtacgagagtccttcgggactcgagtggcaaatgggtgagtaacacgtaaggaacttcccctagcgacgaggataacggttggaaacgactgctaatactggatagtacatcggaccgcatgatctgatgtttaaaggcccgtttgggtcacgctaggatggccttgcggcgcattagatagttggtgaggtaacggcccaccaagtctatgatgcgtagctgcactgagaggtgaaacagccacattgggactgagacacggcccaaactcctacgggaggcagcagtagggaattttcggcaatgagcgaaagcttgaccgagcaatggtgcgtgagcgatgaaggtctttggattgtaaagctcttttattggggaagaaaaactcgattaggaaatgaatcgaaattgacggtacccattgaataagccc

SEQ ID NO: 368 - DNA, 490 bp, Unknown
  Ascusbbf_13629, encodes 16S rRNA
agagtttgatcatggctcaggacgaacgctggcggcgtgcctaacacatgcaagtcgaacggagttgaaaggagcttgcttttttcaactcagtggcggacgggtgagtaacgcgtgagtaacctgcctttcagagggggataacgttctgaaaagaacgctaataccgcataagattgtagtttcgcatgggacagcaatcaaaggagcaatccgctgaaagatggactcgcgtccgattagatagttggcggggtaacggcccaccaagtcgacgatcggtagccggactgagaggttgatcggccacattgggactgagacacggcccagactcctacgggaggcagcagtgagggatattgggcaatgggggaaaccctgacccagcaacgccgcgtgagggatgacggttttcggattgtaaacctctgtcctctgtgaagatagtgacggtagcagaggaggaagctccggctaactacgtgcc

SEQ ID NO: 369 - DNA, 490 bp, Unknown
  Ascusbbf_5034, encodes 16S rRNA
agagtttgatcatggctcaggacgaacgctggcggcgtgcctaacacatgcaagtcgaacggactgattcccttcggggatgaaagttagtggcggacgggtgagtaacgcgtgagtaacctgcctttcagagggggataacgtttggaaacgaacgctaataccgcataacatatcggtaccgcatgatactgatatcaaaggagcaatccgctgaaagatggactcgcgtctgattagatagttggcggggtaacggcccaccaagtcgacgatcagtagccggactgagaggttgaacggccacattgggactgagacacggcccagactcctacgggaggcagcagtgagggatattgcacaatgggcgcaagcctgatgcagcaacgccgcgtgaaggatgacggttttcggattgtaaacttctgttctcagtgatgataatgacattagctgaggagaaagccacggctaactacgtgccagc

SEQ ID NO: 370 - DNA, 490 bp, Unknown
  Ascusbbf_16329, encodes 16S rRNA
agagtttgatcatggctcaggatgaacgctggcggcgtgcctaatacatgcaagtcgaacgagagcgaccagcttgctggtcaatcgagtggcgaacgggtgagtaacacataaacaatctgccctgaagactgggataacgtagggaaacccacgctaataccggataggcagtgagggggcatcctcttactgttaaagctgggctacagcactgcaggatgagtttatgtcgcattagttagttggtgaggtaacggcccaccaagacgatgatgcgtagccggtctgagaggatgaacggccacattgggactgagacacggcccagactcctacgggaggcagcagtagggaattttcggcaatgggggaaaccctgaccgagcaacgccgcgtgaacgatgaaggtttttggatcgcagagttctgttgtaagggaagaaagctacggatagggaatgatctgtagttgacggtaccttaccag

SEQ ID NO: 371 - DNA, 490 bp, Unknown
  Ascusbbf_496686, encodes 16S rRNA
agagtttgatcctggctcaggacgaacgctggcggcatgcctaacacatgcaagtcgaacggaataagaatggctgtagcgatactttcgttcttatttagtggcgaacgggtgagtaacacgtgagcaacctgccttctactcagggataacagccggaaacggctgctaataccagataagaccacgccgaggcatctcggaggggtcaaagcgttttagcggtagaagatgggctcgcgtcccattagctagttggtgagataacagcccaccaaggcgacgatgggtagccgacttgagagagtgatcggccacattggaactgagacacggtccagactccttcgggaggcagcagtggggaatattgggcaatggaggaaactcttacccagcaatgccgcgtgaatgaagaaggccttcgggctgtaaagttcttttattgatgataaagaaagtgatattagtcaatgaataagccccggct

SEQ ID NO: 372 - DNA, 490 bp, Unknown
  Ascusbbf_53115, encodes 16S rRNA
agagtttgatcatggctcaggacgaacgctggcggcgtgcctaacacatgcaagtcgaacgaggtccgatcggtggcaacaccgtgaaatacctagtggcgaacgggtgagtaacacgtgaggaacctgccccgaagaccgggataactctccgaaaggagtgctaataccggatacccccacctaatcgcatgatctggtgaggaaatggattccgcttcgggagggcctcgcggcctatcagcttgttggtgaggtaacggctcaccaaggcatcgacgggtagctggtctgagaggacgatcagccacactgggactgagacacggcccagactcctacgggaggcagcagtggggaatcttgcgcaatgggcgaaagcctgacgcagcaacgccgcgtgggggatgaaggctctcgggttgtaaacccctttcagcaggaacgaatcaagacggtacctgcagaagaagccccggctaactacgtg

SEQ ID NO: 373 - DNA, 490 bp, Unknown
  Ascusbbf_84611, encodes 16S rRNA
agagtttgatcatggctcaggatgaacgctagcggcaggcctaatacatgcaagtcgaacgagattatccagcttgctggatatgaaagtggcgcacgggtgcgtaacgcgtgagcaacctacccttgtcagggggatagcccggcgaaagtcggattaataccgcataacatcacgagatggcatcattttgtgatcaaatatttataggacaaggatgggctcgcgtgacattagttagttggtaaggtaacggcttaccaaggctacgatgtctaggggctctgagaggagaatcccccacactggtactgagacacggaccagactcctacgggaggcagcagtaaggaatattggtcaatggacgcaagtctgaaccagccatgccgcgtgcaggaagacggccctctgggttgtaaactgcttttgtacgggaacaaacccctttacgtgtaaagggctgagtgtaccgtaagaataaggatcg

SEQ ID NO: 374 - DNA, 490 bp, Unknown
  Ascusbbf_1800207, encodes 16S rRNA
agagtttgatcctggctcaggacgaacgctggcggcgtgcttaacacatgcaagtggagcgacgaaccagggcttgccctggggcaaagccgcgaacgggtgagtaacacgtgagtaatctgccccgataaccgggacaacccgaggaaactcgggctaataccggatgtggcgtacaggcataagcctgtccgttaaaggtagcttcggcttctgtatcgggaggggctcgcggcccattagcttgttggtggggtaaaggcctaccaaggcaacgatgggtagctggtctgagaggacgatcagccacactgggactgagacacggcccagactcctacgggaggcagcagtggggaatcttgcgcaatgcgcgaaagcgtgacgcagcaacgccgcgtgagggaagacggccttcgggttgtaaacctctttcaggagggacgaaggttcaccggtgaatagccgtgtggattgacggtacctccag

SEQ ID NO: 375 - DNA, 490 bp, Unknown
  Ascusbbf_644267, encodes 16S rRNA
agagtttgatcatggctcagattgaacgctggcggcgtgcctaacacatgcaagtcgaacgttagagcatagcaatatgctcaaaagtggcgaacgggtgagtaacacgtgggtaacctgccgcgcagagggggataacgactggaaacggtcgctaataccgcatagtaccaagaggaatggtctccttttggttaaaactttggtgctgcgcgaggggcctgcgcccgattagctagttggtgaggtaaaggctcaccaaggcgatgatcggtagctagtctgagaggatgattagccacacgggaactgagacacggtcccgactcctacggggggcagcagtgaggaatattgcacaatggacgaaagtctgatgcagcaacgccgcgtggaggatgacggcccttgggttgtaaactccttttttcagggaagagaatggacggtacctgaagaataagtcacggctaactacgtgccagcagcc

SEQ ID NO: 376 - DNA, 261 bp, Unknown
  Ascusbbf_1042016, encodes 16S rRNA
agagtttgatcctggctcaggatgaacgctagctacaggcttaacacatgcaagtcgaggggcatcaggtactgtgcttgcacggtatgctggcgaccggcgcacgggtgagtaacgcgtatccaaccttcccatgactccggttcagcccgccgaaaggcggattactcccggatggtttccgaagagggcctctgatttggaataaagatttatcggtcatggatggggatgcgtctgattagccagcagccgcggaat

SEQ ID NO: 377 - DNA, 490 bp, Unknown
  Ascusbbf_7357, encodes 16S rRNA
agagtttgatcatggctcaggacgaacgctggcggcgtgcctaacacatgcaagtcgaacggagttattttgaatgaaaatttcggttggattttaaagtgacttagtggcggacgggtgagtaacgcgtgagtaacctgcctagaagagggggataacgttctgaaaagaacgctaataccgcataatatatcgaagccgcatgactttgatatcaaaggagcaatccgcttttagatggactcgcgtccgattagcttgttggcggggtaacagcccaccaaggcgacgatcggtagccggactgagaggttgaacggccacattgggactgagacacggcccagactcctacgggaggcagcagtgggggatattgcgcaatgggggaaaccctgacgcagcaacgccgcgtgaaggacgaaggtcttcggattgtaaacttcttttgttaaggacgaagaaagtgacggtacttaacgaataagct

SEQ ID NO: 378 - DNA, 490 bp, Unknown
  Ascusbbf_1774766, encodes 16S rRNA
agagtttgatcctggctcaggatgaatgctggcggcgtgcctaatacatgcaagtcgagcggtaacagggagtctcaccgtttccttgacacacctagcgctttattcgtaggttgttgatctcgagggaacagtgagaccctgctgacgagcggcggacggctgagtaacgcgtgggaacggaccccaaactgagggataactagtcgaaagattaactaataccgcatatgctcttcggagtaaagctttcgggcggtttgggactggcctgcgtacgattagatagttggcggggtaatggcccaccaagtcgacgatcgttagatggtttgagaagatgaccatccagactgggactgagacacggcccagactcctacgggaggcagcagtagggaatctttcacaatgggcgaaagcctgatggagcaacgccgcgtgcaggatgacggccttcgggttgtaaactgcttttataagcgagaaa

SEQ ID NO: 379 - DNA, 490 bp, Unknown
  Ascusbbf_1365, encodes 16S rRNA
agagtttgatcctggctcaggatgaacgctggcggcatgcctaatacatgcaagtcgaacggagaaggaaggtgcttgcatcttccggatcagtggcgaacgggtgagtaacacgtaggtaacctgcccatgtacccgggacaacggttggaaacgactgctaaaaccggataggcatatggaaggcatcttcgatatgttaaaggggccacggccctggacatggatggacctgcggtgcattagccagttggtgaggtaacggcccaccaaggcgacgatgcatagccgacctgagagggcgaacggccacattgggactgagacacggcccaaactcctacgggaggcagcagtagggaattttcgtcaatggggggaaccctgaacgagcaatgccgcgtgagtgaagacggtcttcggattgtaaagctctgttgcgagagaaaaaggacaggaagagggaatgcttccggtttgatggtatctc

SEQ ID NO: 380 - DNA, 490 bp, Unknown
  Ascusbbf_11678, encodes 16S rRNA
agagtttgatcctggctcagaatgaacgttggtggcgtggattaggcatgcaagtcgtgcgcgaaagtcccttcggggactggagagcggcgaacggggtagtaatgcgtcggaacgtacccttgggtctgggataaccgcgggaaactgcgggtaataccggatgacctctttggagcaaaggtgagactccgcccgaggagcggccgacgtgataccagctagttggtgaggtaatggctcaccaaggctcagacgtctagggggtgtgagagcatggcccccaccactgggactgagacactgcccagacacctacgggtggctgcagtcgagaatcttcggcaatgggcgaaagcctgaccgagcgacgccacgtgcgggatgacggccctcgggttgtaaaccgctgtcgagggggatgaagtcattgggagctatctcccgatgttgacagagccctggaggaagcgcgggctaagtacgtgcc

SEQ ID NO: 381 - DNA, 490 bp, Unknown
  Ascusbbf_49371, encodes 16S rRNA
agagtttgatcctggctcaggacgaacgctggcggcgtgcctaacacatgcaagtcgaacggactgattcgcttcggtgatgaaagttagtggcggacgggtgagtaacgcgtgagtaacctgccttacagagggggataacgtttggaaacgaacgctaataccgcatgacacatcgttgtcgcatggcagtgatgtcaaaggagtaacatccgctgtaagatggactcgcgtccgattagatagttggcggggtaacggcccaccaagtcgacgatcggtagccggactgagaggttgaacggccacattgggactgagacacggcccagactcctacgggaggcagcagtgagggatattgcacaatgggcgaaagcctgatgcagcaacgccgcgtgagggatgacggttttcggattgtaaacctctgttctcagtgaagataatgacattagctgaggagaaagccacggctaactacgtgcca

SEQ ID NO: 382 - DNA, 490 bp, Unknown
  Ascusbbf_22247, encodes 16S rRNA
agagtttgatcctggctcaggacgaacgctggcggcgtgcttaacacatgcaagtcgaacgaagcttgattaacgatttcttcggaatgaattatgatatgactgagtggcggacgggtgagtaacgcgtgagtaacctgcccttcggagggggatagtgtttggaaacgaacagtaataccgcataatgtgcattaggggcatccctgatgtaccaaagatttatcgccgaaggatggactcgcgtctgattagatagttggtgaggtaacggctcaccaagtcgacgatcagtagccggactgagaggttgaacggccacattgggactgagacacggcccagactcctacgggaggcagcagtggggaatattgcacaatgggggaaaccctgatgcagcaacgccgcgtggaggaagacggttttcggattgtaaactcctgttcttagggaagaagaaagtgacggtacctaaggagcaagccac

SEQ ID NO: 383 - DNA, 490 bp, Unknown
  Ascusbbf_157437, encodes 16S rRNA
agagtttgatcatggctcaggataaacgctagcggcaggcctaacacatgcaagtcgagcggcagcgggagtggcaacacttgccggcgagcggcggacgggtgagtaacgcgtatgcaacctgcccaccacacggagatagccgaccgaaaggacgattaaactccgatggcattgggactcggcatcgggatccaattaaatattcataggtggtggatgggcatgcgtggcattagttagttggcggggcaacggcccaccaagacggtgatgcctatgggttctaaaaggaagatcccacacatcggtactgagacacggaccgaactcctacgggaggcagcagtgaggaatattggacaatgggggcaaccctgatccagccaaaccgcgtgggggaaggaggtcgttaagatcgtaaaccccttttatatgggagcaatccgccctatgcatagggcgttgagagtaccatttgaataagcat

SEQ ID NO: 384 - DNA, 490 bp, Unknown
  Ascusbbf_719881, encodes 16S rRNA
agagtttgatcatggctcaggatgaacgctggcggcgtgcataacacattcaagtcgaacggtgaagtaccttcgggtacggagcagtggcggacgggtgagtaacgcgtgagcaacctgccatacagtgggggataacacagggaaacttgtgctaataccgcatgacacattgggaccgcatgattctgatgtcaaagatttattgctgtatgatgggctcgcgtatgattagacagttggcagggtaacggcctaccaaatcaacgatcattagccgaactgagaagttgaacggccacattggaactgagaaacggtccagactcctacgggaggcagcagtggggaatattgggcaatgggcgaaagcctgacccagcgacgccgcgtgagggaagaaggtcttcggattgtaaacctttttcagcagggaagaagtcagtgacggtacctgcagaagaagccacggctaactacgtgccagcag

SEQ ID NO: 385 - DNA, 490 bp, Unknown
  Ascusbbf_149127, encodes 16S rRNA
agagtttgatcctggctcaggataaacgctggcggcgcacataagacatgcaagtcgaacggaagtcgttataatgattttgatttagatttgaagattcgtctgatatgaagaagatgatgacttataacaatggctttagtggcggactggtgagtaacgcgtaagcaatctgcctattagaggggaataacagtgagaaatcattgctaataccgcatatgccatagttatcgcatgataatagtgggaaaggagtaatccgctaatagatgagcttgcgtctgattagctagttggtggggtaacggcctaccaaggcgacgatcagtagccggactgagaggttgaacggccacattgggactgagatacggcccagactcctacgggaggcagcagtcgggaatattgcgcaatggaggaaactctgacgcagtgacgccgcgtataggatgaaggttttcggattgtaaactattgtcgttag

SEQ ID NO: 386 - DNA, 490 bp, Unknown
  Ascusbbf_335572, encodes 16S rRNA
agagtttgatcctggctcaggatgaacgctggcggcgtgcctaacacatgcaagtcgaacggagaggtgatgtgtgcggttgaattgcttgcaaggagaccaaacttttcactttcttagtggcggacgggtgagtaacgcgtggacaacctgccttaatccgggggatagcagctggaaacggctgataataccgcataagcgcacagcacggcatcgtggagtgtgaaaagatttatcgggttaagatggatccgcgtctgattagccagttggcggggtaacggcccaccaaagcgacgatcagtagccggcctgagagggcggacggccacattgggactgagacacggcccagactcctacgggaggcagcagtgggggatattgcacaatgggcgcaagcctgatgcagcgacgccgcgtgagtgaagaagtatttcggtatgtaaagctctatcagcagggaagaaaggcccgcaagggagat

SEQ ID NO: 387 - DNA, 490 bp, Unknown
  Ascusbbf_33157, encodes 16S rRNA
agagtttgatcatggctcaggatgaacgctagctacaggcttaacacatgcaagtcgagcgggactctttcgggagtctagcggcagacgggtgagtaacacgtatccaacctttcccttactcgggtatagcctcgggaaactgagagtaatccccgatgtggtgcacgaacagcattatttgcgcacgaaagatttatcggtaaggggtggggatgcgttccattaggtagtaggcggggcaacggcccacctagccgatgatggataggggttctgagaggaaggtcccccacattggaactgcgacacggtccaaactcctacgggaggcagcagtgaggaatattggtcaatggccggaaggctgaaccagccaagtagcgtgcaggatgacggccctatgggttgtaaactgcttttatgcgggaataacgttcgccacgtgtggtgaagtgcatgtaccgcatgaataaggatcggctaactc

SEQ ID NO: 388 - DNA, 490 bp, Unknown
  Ascusbbf_1467466, encodes 16S rRNA
agagtttgatcctggctcaggatgaacgctggcggcgtgcctaatacatgcaagtcgaacgagggtgcttgcaccctagtggcgaacgggtgagtaacacgtaggtaacctgcccttaagcttgggatacccagaggaaactttggctaataccggataacaacagatgaggcatctcaactgtttgaaaggccctttcgggtcacttaaggatggacctgcggcgcattagctagttggtgagataacagcccaccaaggcaaggatgcgtagccgaactgagaggttgatcggccacattggaactgagacacggtccaaactcctacgggaggcagcagtaaggagttttcggcaatgggggaaaccctgaccgagcaacgccgcgtgagtgatgacggccctatgggttgtaaagctcttttattagagacgaatggtaggtataggaaatgatatctacttgactgtatcttttgaataagccac

SEQ ID NO: 389 - DNA, 490 bp, Unknown
  Ascusbbf_184755, encodes 16S rRNA
agagtttgatcatggctcaggacgaacgctggcggcgtgcttaacacatgcaagtcgagcggggacattgttggaagggtttcggcctggaagggaatgtttcagcggcggacgggtgagtaacgcgtgaacaatctgtcccggacagggggataacagatggaaacatctgctaataccgcataagaccacgacccggcatcgggttgaggtaaaaggaggaatccggttcggggtgagttcgcgtccgattagctagttggcgaggtaacggcccaccaaggcgacgatcggtagccgacctgagagggtgatcggccacattggaactgagagacggtccaaactcctacgggaggcagcagtgggaatattgggcaatgggcgaaagcctgacccagcaacgccgcgtgagggaagaaggttttcggattgtaaacctctatcgtggacgacgaaggaagtgacggtagtccacaaggaagccccg

SEQ ID NO: 390 - DNA, 490 bp, Unknown
  Ascusbbf_477518, encodes 16S rRNA
agagtttgatcctggctcaggacgaacgctggcggcgtgcttaacacatgcaagtcgaacggggcgattgaaagcttgcttttatgagcctagtggcaaacgggtgagtaacgcgtgggcaacctaccggaaagatggggacaacatcccgaaaggggtgctaataccgaatgttgtacgagaggcgcatgcttctcgtattaaaggattttatccgctttccgatgggcccgcgtccgattagctagttgggggggcaacggcccaccaaggcgacgatcggtagccggcctgagagggtgaacggccacattgggactgagacacggcccagactcctacgggaggcagcagtggggaatcttccgcaatgggcgaaagcctgacggagcaacgccgcgtgagtgaagaaggccttcgggccgtaaagctctgttgccggggaagagtgatgcgaggggactcgcatagggacggtacccggcgagga

SEQ ID NO: 391 - DNA, 490 bp, Unknown
  Ascusbbf_42043, encodes 16S rRNA
agagtttgatcatggctcaggacgaacgctggcggcgtgcctaacacatgcaagtcgagcggagacagacggaaagcttgctttttgtctgtttcagcggcggacgggtgagtaacgcgtgagcaacctgcctttaacaggggaataacgcatcgaaagatgtgctaataccgcataagaccacagcatcacatggtgcaggggtcaaaggagcaatccggttaaagatgggctcgcgtccgattagctggttggtgagacaacagcccaccaaggcgacgatcggtagccgacctgagagggtgatcggccacattggaactgagatacggtccagactcctacgggaggcagcagtgggaatattgggcaatgggcgaaagcctgacccagcaacgccgcgtgagggaagaagggtttcggctcgtaaacctctgtcctatgggacgaaggaagtgacggtaccataggaggaagccccggctaacta

SEQ ID NO: 392 - DNA, 490 bp, Unknown
  Ascusbbf_3711, encodes 16S rRNA
agagtttgatcatggctcaggatgaacgctggcggtgtgcctaatacatgcaagtcgatcgggcgtagcaatacgtcagaggcgtacgggtgagtaacacgtaggtaacctacctttaagactgggatacccagacgaaagtttggctaataccggataacaacatttgagacatctcttttgtttgaaaggcgctgcaaggcgccacttttagatggacctgcgtcgcattagctagttggtgagataaaagcccaccaaggctgggatgcgtagccgatctgagaggatgaccggccacaatgggactgagacacggcccatactcctacgggaggcagcagtagggagttttcggcaatgggggaaaccctgaccgagcaacaccgcgtgagtgatgaaggtcttcggatcgtaaagctctgttacgagggacgaatgatcgctttaggaaatgagagcggtttgacggtacctcgccagaaagcga

SEQ ID NO: 393 - DNA, 490 bp, Unknown
  Ascusbbf_94610, encodes 16S rRNA
agagtttgatcctggctcaggatgaacgctagcggcaggcctaatacatgcaagtcggacgggatttaagctaaagcttgctttagcttaatgagagtggcgcacgggtgcgtaacgcgtgagcaacctacctccatcagggggatagcctctcgaaagagagattaacaccgcataatatcaacagttcgcatgttcagttgattaaatatttataggatggagatgggctcgcgtgacattagctagttggtagggtaacggcttaccaaggcgacgatgtctaggggctctgagaggagaatcccccacactggtactgagacacggaccagactcctacgggaggcagcagtaaggaatattggtcaatgggcggaagcctgaaccagccatgccgcgtgcaggatgactgccctatgggttgtaaactgcttttgtccgggaataaacctccttacgtgtagggagctgaatgtaccggaagaat

SEQ ID NO: 394 - DNA, 490 bp, Unknown
  Ascusbbf_251885, encodes 16S rRNA
agagtttgatcatggctcagattgaacgctggcggcatgctttacacatgcaagtcgaacggcagcacgggagcttgctcctggtggcgagtggcgaacgggtgagtacaacatcggaacgtgaccgtttgtgggggacaaccacccgaaagggtggctaataccgcatgagacctgagggtgaaagccggggaccgcaaggcctggcgcgaacggagcggccgatgactgattagctggttggcggggtaagagcccaccaaggcgacgatcagtagctggtctgagaggacgaccagccacactggaactgagacacggtccagactcctacgggaggcagcagtggggaattttggacaatgggggaaaccctgatccagccatgccgcgtgcgggatgaaggccttcgggttgtaaaccgcttttgtcggggacgaaaagggagagtttaagagacacttctgctgacggtacccgaagaataagc

SEQ ID NO: 395 - DNA, 490 bp, Unknown
  Ascusbbf_1492526, encodes 16S rRNA
agatttgatcctggctcaggacgaacgctggcggcatgcttcatacatgcaagtcgaacgataaggtctcttcggagatacataagtggcggacgggtgagtaatatgtagaaaatctgccttagagagggggacaacagagggaaacttttgctaataccccatatgagcgtacctgaaatggtattcttgaaaactccggtgctctaagatgagcctgcatctgattagctagttggtggtgtaatggactaccaaggcgacgatcagtagctggtttgagaggatgatcagccacaatgggactgagacacggcccatactcctacgggaggcagcagtagggaattttgcgcaatgggcgaaagcctgacgcagcaatgccgcgtgaatgttaaacccttcggggtgtaaagttctgtcagtgggtacgaattttgacggtacccacagaggaagcaccggctaactccgtgccagcagccgcggt

SEQ ID NO: 396 - DNA, 490 bp, Unknown
  Ascusbbf_86092, encodes 16S rRNA
agagtttgatcctggctcaggacgaacgctggcggcgtgcttcatacatgcaagtcgaacgagaatctggcttcggtcagaggaaagtggcggacgggtgagtaaaatgtagagaatctgccctttagtgggggacaacagttggaaacgactgctaataccccatatgcgcgtagctgagatgctattcgtgaaaactccggtgctaaaggatgagtctgcatctgattagctagtaggtggtgtaatggaccccctaggcgacgatcagtagctggtttgagaggatgatcagccacaatgggactgagacacggcccatactcctacgggaggcagcagtagggaattttgcgcaatgggggaaaccctgacgcagcaacgccgcgtgattgaagaagcccttcggggtgtaaagatctgtcagtggggacgaaacttgacggtacccacagaggaagcatcggctaactccgtgccagcagccgcg

SEQ ID NO: 397 - DNA, 490 bp, Unknown
  Ascusbbf_38920, encodes 16S rRNA
agagtttgatcatggctcagaatgaacgttggcggcgtggattaggcatgcaagtcgcgcgagaaatctccttcgggagatggacagcggcgaaagggagaggaataagtagaaatctgccctcgggacggggatagcggtgggaaactgccagtaatacccgataacatctaaggatcaaatggtgtgattccgcctgaggatgagtctacttcctattagcttgttggtgtggtaatggctcaccaaggcaacgatgggtagcgggtgtgagagcacgatccgcctcactgggactgagacactgcccagacacctacgggtggctgcagtcgagaatcttcggcaatgggggaaaccctgaccgagcgacgccgcgtgcgggatgaaggccttcgggttgtaaaccgctgtcgtaagggaacaaatccactggggtactcccctttggttgagtgatcttaggaggaaggacgggctaagttcgtgc

SEQ ID NO: 398 - DNA, 490 bp, Unknown
  Ascusbbf_116197, encodes 16S rRNA
agagtttgatcctggctcaggacgaacgctggcggcgtgcctaatacatgcaagtcgaacgcactgacgtcgaccgaagctgcttgcagtggacgttgattgacgtgagtggcggacgggtgagtaacacgtgggtaacctacccttaagtgggggataacatttggaaacagatgctaataccgcataaccattcagaccacatggtctgaatgtaaaagacggcctttggctgtcacttttggacggacccgcggcgtattagttagttggtaaggtaacggcttaccaagacaatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttaggatcgtaaaactctgttgttggagaagaacagggactagagtaactgtt

SEQ ID NO: 399 - DNA, 490 bp, Unknown
  Ascusbbf_393478, encodes 16S rRNA
agagtttgatcctggctcagattgaacgctagcggaatgccttacacatgcaagtcgaacggcagcacggacttcggtctggtggcgagtggcgaacgggtgagtaatgtatcggaacgtgcccagtagcgggggataactacgcgaaagcgtggctaataccgcatacgccctacgggggaaagggggggatcgcaagacctctcactattggagcggccgatatcggattagctagttggtggggtaaaggcctaccaaggcgacgatccgtagctggtttgagaggacgaccagccacactgggactgagacacggcccagactcctacgggaggcagcagtggggaattttggacaatgggggaaaccctgatccagccattccgcgtgtgcgatgaaggccttcgggttgtaaagcacttttggcaggaaagaaatcgcatggactaatactctgtgcggatgacggtacctgcagaataagcac

SEQ ID NO: 400 - DNA, 490 bp, Unknown
  Ascusbbf_100925, encodes 16S rRNA
agagtttgatcctggctcaggacgaacgctggcggcgtgcttaacacatgcaagtcgagcggaaaggcctcttcgggggtactcgagcggcgaacgggtgagtaacacgtgagtaatctgcccctggctttgggatagccaccggaaacggtgattaataccggatacgacaacttctcgcatgggatggttgtggaaagtttttcggccagggatgtgctcgcggcctatcagcttgatggtgaggtaatggctcaccatggcttcgacgggtagccggcctgagagggtgaccggtcacactgggactgagacacggcccagactcctacgggaggcagcagtggggaatattggacaatgggcggaagcctgatccagcaacgccgcgtgagggatgacggccttcgggttgtaaacctctttcagtaccgacgaagcgcaagtgacggtaggtacagaagaagcaccggccaactacgtgccagca

SEQ ID NO: 401 - DNA, 490 bp, Unknown
  Ascusbbf_1863182, encodes 16S rRNA
agagtttgatcatggctcaggatgaacgctagctacaggcttaacacatgcaagtcgaggggcatcatgaagtcagcttgctgactttgatggcgaccggcgcacgggtgagtaacgcgtatccgacctgccctgtactcggggatagccttttgaaaggaagattaatacccgatgttttcatactgccgcatgacggtatgaacaaagatttatcggtacaggatggggatgcgttccattagatagtaggcggggtaacggcccacctagtcagcgatggataggggttctgagaggaaggtcccccacattggaactgagacacggtccaaactcctacgggaggcagcagtgaggaatattggtcaatgggcgagagcctgaaccagccaagtagcgtgcaggaagaatgccctatgggttgtaaactgcttttgtccgggggtaaagatgtccacgtgtgggcagttgcaagtatcggacgaat

SEQ ID NO: 402 - DNA, 490 bp, Unknown
  Ascusbbf_255632, encodes 16S rRNA
agagtttgatcctggctcagaatgaacgttggcggcatggattaggcatgcaagtcgagcgagaaggagtccaaagtttactttgggctctggaaagcggcgcaagggagagtaatgcgtagttatctaccctaaggaccggaatagccacgggaaactgtgggtaatgccggataatatccccggatcaaaggtgtgattccgccttgggaggagactgcgttgtactagcttgttggtagggtaatggcctaccaaggctacgatgcatagcgggcgtgagagcgtggcccgtctcactgggactgaaacactgcccagacacctacgggtggctgcagtcgagaatcttcggcaatgggcgaaagcctgaccgagcaatgccgcgtgcgggatgaaggccttcgggttgtaaaccgctgtcgtaggggagaaaggtctcgcgaagagcgagatttgatctatcctaggaggaagtccgggctaagtt

SEQ ID NO: 403 - DNA, 490 bp, Unknown
  Ascusbbf_1002000, encodes 16S rRNA
agagtttgatcctggctcaggatgaacgctggcggcgtgcctaacacatgcaagtcgagcgagaagcttcggagtagattcttcggatgacacactgaagtggacagcggcggacgggtgagtaacgcgtgggcaacctgcccctttccggaggatagccaagggaaactttgaataatactccataaagcagtgacatcacatggtgatactgccaaagatttatcggagagggatgggcccgcgtctgattagccagttggtgaggtagcggctcaccaaagcgacgatcggtagccggcctgagagggtgaacggccacattggaactgagacacggtccagactcctacgggaggcagcagtggggagtattgcacaatgggcggaagcctgatgcagcaacgccgcgtgaaggatgaaggttttcggatcgtaaacttctgtccctggggaagaagaaagtgacggtacccaaggaggaagcccc

SEQ ID NO: 404 - DNA, 490 bp, Unknown
  Ascusbbf_1883769, encodes 16S rRNA
agagtttgatcctggctcaggatgaacgctggcggcgtgcctaacacatgcaagtcgaacgattaacccgccttcgggcggtcatagagtggcgaacgggtgagtaacacgtgaccaacctgccctccccaccgggataacgcggcgaaagccgcgctaataccggatatgccggcgcccccgcatgggggcgccgggaaagctccggcgggggaggatggggtcgcgtcccattaggtagttggcggggcgacggcccaccaagccgacgatgggtagccgggttgagagaccgatcggccacattgggactgggatacggcccagactcctacgggaggcagcagtggggaatcttgcgcaatgggggaaaccctgacgcagcaacgccgcgtgcgggatgacggccttcgggttgtaaaccgctttcagcagggaagaacctatgacggtacctgcagaagaagccccggctaactacgtgccagca

SEQ ID NO: 405 - DNA, 470 bp, Unknown
  Ascusbbf_7763, encodes 16S rRNA
agagtttgatcctggctcagaacgaacgctggcggcaggcctaacacatgcaagtcgaacggacccttcggggtcagtggcagacgggtgagtaacgcgtgggaatctacccagttcttcggaataacccagggaaacttgggctaataccggatacgcccttagggggaaagatttatcggaattggatgagcccgcgtcggattagctagttggtggggtaatggcctaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagcggggaagataatgacggtacccgcagaagaagccccggctaacttcgtgccagcagccgcggtaat

SEQ ID NO: 406 - DNA, 490 bp, Unknown
  Ascusbbf_1093, encodes 16S rRNA
agagtttgatcctggctcaggatgaacgctagcggcaggcctaatacatgcaagtcgaacggtaaatgtcccttcggggatatgagagtggcgcacgggtgcgtaacgcgtatgcaacccacccgctgtcgggggatagcccgtagaaatgcgaattaataccccatgaggagaaagggcggcatcgtccttttttcaaaactttggtgacggcggacgggcatgcgtgccattagatagttggcggggtaacggcccaccaagtcgacgatggctaggggatctgagaggacggtcccccacactggtactgagacacggaccagactcctacgggaggcagcagtaagggatattggtcaatggggggaaccctgaaccagccatgccgcgtgagggaataaggccctacgggtcgtaaacctcttttgccgggggataaggacgcccacgtgtgggtgtttgaaggtacccggagaataagcatcgg

SEQ ID NO: 407 - DNA, 490 bp, Unknown
  Ascusbbf_73845, encodes 16S rRNA
agagtttgatcctggctcaggatgaacgctagcggcaggcttaacacatgcaagtcgaggggcagcgagaggtagcaatactttgtcggcgaccggcgcaagggtgcgtaacacgtgagtaacatgcccgatacaggaggataatccatggaaacgtggtctaatactccatattataatatgtacgcatgtacctattatgaaattttcgaaggtatcggattggctcgcgcaacattagccagttggtagggtaacggcctaccaaagcgacgatgtttaggggtcctgagagggaggtcccccacactggaactgagacacggtccagactcctacgggaggcagcagtgaggaatattggacaatggatggaaatctgatccagccatgccgcgtgcgggatgacggtcctatggattgtaaaccgcttttaaatgggagcaataaggtgtacgtgtacaccgatgagagtaccattggaataagc

SEQ ID NO: 408 - DNA, 490 bp, Unknown
  Ascusbbf_206449, encodes 16S rRNA
agagtttgatcctggctcagattgaacgctggcggcatgctttacacatgcaagtcgaacggcagcgcgggcttcggcctggcggcgagtggcgaacgggtgagtaatacatcggaacgtacccagtagtgggggatagctcggcgaaagccggattaataccgcatacgacccatgggtgaaagcgggggaccttcgggcctcgcgctattggagcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgatgaaggccttcgggttgtaaagcacttttggcaggaacgaaaaggaccgtgttaataccgtggtctgatgacggtacctgcagaataagcac

SEQ ID NO: 409 - DNA, 490 bp, Unknown
  Ascusbbf_54050, encodes 16S rRNA
agagtttgatcctggctcaggatgaacgctagcgacaggcctaacacatgcaagtcgaggggcatcgagccgtagcaatacggtgtcggcgaccggcgaatgggtgagtaacgcgtatgcaacctttccgcaaaacggggatagccttccgaaaggaagattaatacccgatggccttggccgtccgcatgagtggccaagtaaaaatttattgattgcgggtgggcatgcgtcccattaggcagttggcggggtaacggcccaccaaaccgacgatgggtaggggttctgagaggaaaatcccccacattggaactgagacacggtccaaactcctacgggaggcagcagtgaggaatattggtcaatgggcggaagcctgaaccagccaagtcgcgtgcgggacgaaggccctacgggtcgtaaaccgcttttgtacgggaataaagtcatccacgtgtgggtgtttgtaggtaccgtaagaataagg

SEQ ID NO: 410 - DNA, 490 bp, Unknown
  Ascusbbf_24458, encodes 16S rRNA
agagtttgatcatggctcagaacgaacgctggtggcgtgtcttatacatgcaagtcgagcggtgtagcaatacatagcggcgaacgggtgagtaacgcgtaagcaatctgccccacactcgggaatagccgtgccaacgcgcgggtaataccggatatcgtggccctggacatccggggttgacgaaagatttatcggtgtgggatgagcttgcgtccgattagctagtaggcggggtaacggcccacctaggcgacgatcggtagccggcctgagagggtgatcggccacattgggactgagatacggcccagactcctacgggaggcagcagtagggaatattgcacaatggggggaaccctgatgcagcaacgccacgtgtgggaagaagcatttcggtgtgtaaaccactgtcgtgagggaataaggctatttttcggagtagttgaatgtacctcgaaaggaagcaccggcaaacttcgtgccag

SEQ ID NO: 411 - DNA, 490 bp, Unknown
  Ascusbbf_9530, encodes 16S rRNA
agagtttgatcctggctcaggacaaacgctggcggcgtgcttaacacatgcaagtcgaacggagtacctgagaatgaagcttcggcagaatttttggaatacttagtggcggacgggtgagtaacacgtgagtaacctgcccccaagcgtgggataacactccgaaaggagtgctaataccgcataaaatatatatgccgcatggtatatatatcaaagaattatcgcttagggatgggctcgcgcccgattaggtagttggtgaggtaaaggctcaccaagccgacgatcggtagccggactgagaggttggacggccacattgggactgagacacggcccagactcctacgggaggcagcagtggggaatattgcacaatgggggaaaccctgatgcagcgacgccgcgtgaaggaagaaggtcttcggattgtaaacttatgtcttcagggaagaaaagatgacggtacctgaggaggaagccacgg

SEQ ID NO: 412 - DNA, 490 bp, Unknown
  Ascusbbf_5740, encodes 16S rRNA
agagtttgatcatggctcaggatgaacgctggcggcgtgcttaacacatgcaagtcgaacggagtttaagaaggaagcttgctttcattttaaacttagtggcggacgggtgagtaacgcgtgaggaacctgcccttcagtggggaacaacaactagaaatggttgctaataccgcataatgtcggattgccgcatgacagaccgaccaaaggatttattcgctgaaggatggcctcgcgtccgattagatagttggtgaggtaacggcccaccaagtctacgatcggtagccgaactgagaggttgatcggccacattgggactgagacacggcccagactcctacgggaggcagcagtggggaatattgggcaatgggcgaaagcctgacccagcaacgccgcgtgaaggatgacggtcttcggattgtaaacttctttaattggggaagaataaatgacctacccaaagaataagtcacggctaact

SEQ ID NO: 413 - DNA, 490 bp, Unknown
  Ascusbbf_18863, encodes 16S rRNA
agagtttgatcatggctcaggatgaacgctggcggcgtgcctaatacatgcaagtcgaacgagggtgcttgcaccctagtggcgaacgggtgagtaacacgtaggtaacctgccctttagtttgggatacccagaggaaactttggctaataccggatatgaattcgagaggcatctcttgaatttgaaaggagcgtttgctccgctttaggatggacctgcggcgcattagctagttggtgagataacagcccaccaaggcgaggatgcgtatccgatctgagaggatgaccggacacattggaactgagacacggtccaaactcctacgggaggcagcagtaaggagttttcggcaatgggggaaaccctgaccgagcaacgccgcgtgagtgatgacggccctatgggttgtaaagctctgttgtaagggacgaatgacgaggttaggaaatgagcttcgtttgacggtaccttaccagaaagccac

SEQ ID NO: 414 - DNA, 485 bp, Unknown
  Ascusbbf_6332, encodes 16S rRNA
agagtttgatcctggctcagaacgaacgctggcggcaggcctaacacatgcaagtcgagcgaggacttcggtcctagcggcggacgggtgagtaacgcgtgggaacgtgccccttgctgcggaatagccccgggaaactgggattaataccgcatgatccccctgatcatggagatctgggggcaaagatttatcggcaagggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccctagggttgtaaagctctttcagctgggaagataatgactgtaccagcagaagaagccccggctaactccgtgccagcagccgcggtaat

SEQ ID NO: 415 - DNA, 490 bp, Unknown
  Ascusbbf_20539, encodes 16S rRNA
agagtttgatcatggctcagaacgaacgctggcggcatggattaggcatgcaagtcgaacgaggtagcaataccgagtggcggaagggtgaggaacgcgtgagcaatctgccctccagttgggaataacagttggaaacgactgctaataccgaatgtggctcgttggtcgcatgactgacgggctaaagatttatcgctggaggatgagctcgcgtcccattagctagttggtgaggtaacggcccaccaaggcgacgatgggtagctggtctgagaggatggtcagccacactgggactgagacactgcccagactcctacgggaggctgcagtcgagaatcttgggcaatgcgcgaaagcgtgacccagcaatgccgcgtgcgggatgaaggtcttcggattgtaaaccgctgtcaaccgggacgaacacaatgactgtaccggtgaaggaagccacggctaactacgtgccagcagccgcggtaat

SEQ ID NO: 416 - DNA, 490 bp, Unknown
  Ascusbbf_12810, encodes 16S rRNA
agagtttgatcatggctcaggatgaacgctagcggcaggcttaacacatgcaagtcgaggggtaacagggagtagcaatactctgctgacgaccggcgcacgggtgcgtaacgcgtatgcaacctacctgtaacaggggaataacggagggaaacttccactaatgccccatattgttattctttcgcatgttaggataacgaaagcttcggtggttacggatgggcatgcgtgacattagctagttggtaaggtaacggcttaccaaggcgacgatgtctaggggagctgagaggcttatcccccacactggtactgagacacggaccagactcctacgggaggcagcagtgaggaatattggtcaatggagggaactctgaaccagccatgccgcgtggaggaagaaggtcctatgggttgtaaactccttttgtccgagagtaataagtgccttgcgaggcacgatgagagtatcgggcgaataagc

SEQ ID NO: 417 - DNA, 486 bp, Unknown
  Ascusbbf_9338, encodes 16S rRNA
agagtttgatcctggctcagaacgaacgctggcggcatgcttaacacatgcaagtcgaacggtgttgttcagtacttgtattgagcaacatagtggcaaacgggtgagtaacgcgtgggaacgtacccaacagtattggataacgtttggaaacgaacgctaatacaatatacgcttgagagaggaaagagagatcgctgatggagcggcccgcgttagattaggtagttggtggggtaaaggcctaccaagccgatgatctatagctggtctgagaggatgaacagccacattgggactgagacacggcccagactcctacgggaggcagcagtggggaatattggacaatgggggaaaccctgatccagcaatgccgcgtgagtgaagaaggccttcgggttgtaaaactcttttataagtgaagatgatgacggtaacttatgaataagctccggctaacttcgtgccagcagccgcggtaat

SEQ ID NO: 418 - DNA, 490 bp, Unknown
  Ascusbbf_95594, encodes 16S rRNA
agagtttgatcctggctcaggatgaacgctagctacaggcttaacacatgcaagtcgaggggtaacgtgagggaagcttgcttcccttgacgacgaccggcgcacgggtgagtaacgcgtatccaacctgcccatgactcagggataaccttccgaaagggagcctaatacctgatgttgtgtgacgatggcatcagaatcacaccaaggatttcatcggtcatggatggggatgcgtaggattaggtagacggcggggtaacggcccaccgtgcctacgatccttaggggttctgagaggaaggtcccccacactggtactgagacacggaccagactcctacgggaggcagcagtgaggaatattggtcaatgggcgggagcctgaaccagccaagtagcgtgcaggaagacggccctatgggttgtaaactgcttttatgaggggataaagtgcgggacttgtcccgttttgcaggtacctcatgaa

SEQ ID NO: 419 - DNA, 490 bp, Unknown
  Ascusbbf_717106, encodes 16S rRNA
agagtttgatcatggctcaggacgaacgctggcggcgtgcctaatacatgcaagtcgaatggtagcaataccatggcgaacgggtgggtaacgcgtaggtaacctgtctttaagacgaggataaccgttggaaacgacggataatactcgataggtgatttgagggcatccttagatcattaaagatttatcacttagagaggggcctgcggcgcattagctagatggcggtgtaatggaccaccatggcgatgatgcgtagccggactgagaggttgaacggccacaatggaactgagaacggtccatactcctacgggaggcagcagtagggaattttcggcaatgggcgaaagcctgaccgagcaacgccgcgtgaacgaagaagtatttcggtatgtaaagttcttttatcggggaggaaaaatattcaaattgacggtacccgatgaataagctccggctaactacgtgccagcagccgcggtaa

SEQ ID NO: 420 - DNA, 490 bp, Unknown
  Ascusbbf_148160, encodes 16S rRNA
agagtttgatcatggctcaggacgaacgctggcggcatgcctaacacatgcaagtcgaacggagccatcttgatgatcccttcggggtgattcaggggaagcttagtggcggacgggtgagtaacgcgtgagtaacctgcctttgagaggggaataacgttccgaaaggaacgctaataccgcataacgtgattttaccgcatgatagaatcaccaaagatttatcgctcagagatggactcgcgtctgattagctagttggtgaggtaacggctcaccaaggcgacgatcagtagccgagctgagaggctgatcggccacattgggactgagacacggcccagactcctacgggaggcagcagtgggggatattgcgcaatggggggaaccctgacgcagcaatgccgcgtgaaggaagaaggtcttcggatcgtaaacttttgtcttcagggacgataatgacggtacctgaggaggaagccacggct

SEQ ID NO: 421 - DNA, 490 bp, Unknown
  Ascusbbf_1520121, encodes 16S rRNA
agagtttgatcctggctcaggatgagcgctggcggcgtgcctaatacatgcaagtcggacggtatcagcgatgatatagtggcgaacgggtgagtaacacgttggtgacctgccccaaagatggggatatcacctggaaacgggtggcaaaaccgaataagcttaccccctttagaaaagggtaagtaaaagtgaaaactactttgggaggggcctgcggcccatcagttagttggtgagggtaacggcccaccaagacagcgacgggtaggggacctgagagggtggtcccccacaatggaactgaaacacggtccatacacctgcgggtggcagcagtagggaatattgctaaatgggcgaaagcctgaagcagcaacgccgcgtggacgaaggaggccttcgggtcgtaaagtccttttatgagggaaaaggaaggatggtacctcatgaataagtctcggctaactacgtgccagcagccgcggta

SEQ ID NO: 422 - DNA, 490 bp, Unknown
  Ascusbbf_88772, encodes 16S rRNA
agagtttgatcatggctcaggatgaacgctagcggcaggcttaacacatgcaagtcgaggggcagcgggtgtagcaatacatgccggcgaccggcgaaagggtgagtaacgcgtgagcaacgtgcccggtattgggggatagtcattggaaacgatgcgtaataccccgtaacaacaaggatcgcatggttcatgtttaaaagatttattgataccggatcggctcgcgtaccattaggtagacggcggggtaacggcccaccgtgccgacgatggttaggggttctgagaggaaggtcccccacattggaactgagacacggtccagactcctacgggaggcagcagtgaggaatattggtcaatggccgagaggctgaaccagccatgccgcgtgcgggaagacggccctatgggttgtaaaccgcttttgtcggggagcaataagtgctacgtgtagcacgatgagagtacctggcgaataagcatc

SEQ ID NO: 423 - DNA, 490 bp, Unknown
  Ascusbbf_67296, encodes 16S rRNA
agagtttgatcatggctcagaacgaacgctggcggcgcgtcttaagcatgcaagtcgagcggtaagatatagcttgctatatcctagagcggcggactggtgagtaacacgtgggtgacataccctccggaccgggatagctcctagaaataggagataatacctgatacgatttctgttgtcagaggacaggaaggaaaggtgcttcggcaccgccggaggagtggcccgcggcccattagctggttggtgaggtaacggcccaccaaggcgacgatgggtatccggcctaagagggtggacggacacattgggactgagatacggcccagactcctacgggaggcagcagctaagaatattccgcaatgggcgaaagcctgacggagcgacgccgcgtggacgatgaaggccgaaaggttgtaaagtccttttgaatctgacgaataagcagtgcaggaaatggcattgtggtgacggtaggatttga

SEQ ID NO: 424 - DNA, 490 bp, Unknown
  Ascusbbf_111334, encodes 16S rRNA
agagtttgatcatggctcaggatgaacgctagcggcaggcttaacacatgcaagtcgaggggcagcgctgggtagcaataccctggcggcgaccggcgcacgggtgcgtaacgcgtatgcaacctgcccgcgacagggggataacctggagaaattcggactaataccccgtaacacaatccgaggcatctcgggctgttgaaaggagcgatccggtcgcggatgggcatgcgtgacattaggtagttggcggggcgacggcccaccaagccgacgatgtctaggggaactgagaggttagtcccccacactggtactgagacacggaccagactcctacgggaggcagcagtgaggaatattggtcaatggtcggaagactgaaccagccatgccgcgtgagggaagaaggccctacgggttgtaaacctcttttacgggggagcaataagcgccgtgcgcggcgcgatgagagtaccccgggaataag

SEQ ID NO: 425 - DNA, 490 bp, Unknown
  Ascusbbf_73932, encodes 16S rRNA
agagtttgatcatggctcaggatgaacgctagcggcaggcttaacacatgcaagtcgaggggcagcgggtctagcaatagatgccggcgaccggcgaaagggtgagtaacgcgtgagcaacgtgcccgtatgtgggggatagtcgatggaaacgtcgcgtaataccccgtaacatatggagctgcatggttccatattgaaagattaattgcatacggatcggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggaggacggccctatgggttgtaaaccgcttttgcgggggagcaataagtgttacgtgtaacacgatgagagtaccctgcgaataagcatc

SEQ ID NO: 426 - DNA, 490 bp, Unknown
  Ascusbbf_123297, encodes 16S rRNA
agagtttgatcctggctcaggatgaacgctagctacaggcttaacacatgcaagtcgaggggcagcatgggggtgcttcggcacctctgatggcgaccggcggatgggtgagtaacgcgtatccaacctgccccgcgcccggggacagcccttagaaatgaggattaacccccgatagatgtgttatgcgcatgcatgacacatgaaacagacgcgggatggggatgcgttccattaggcagcaggcggggtaacggcccacctggccgacgatggataggggttctgagaggaaggtcccccacactggaactgagacacggtccagactcctacgggaggcagcagtgaggaatattggtcaatgggcgggagcctgaaccagccaagtagcgtgcgggatgaaggccctacgggttgtaaaccgcttttgcgcggggataaagagggggacttgtcccccgttgcaggtaccgcgcgaataaggacc

SEQ ID NO: 427 - DNA, 490 bp, Unknown
  Ascusbbf_629267, encodes 16S rRNA
agagtttgatcatggctcaggatgaacgctggcggcgtgcctaacacatgcaagtcgaacggggtctatccgctgatgaagcttcggcagaatcttggaaagacttagtggcggacgggtgagtaacgcgtgggcaacctgccctgtactgggggatagcagctggaaacggctggtaataccgcataagcgcacagtatcgcatgatacagtgtgaaaagctccgacggtacaggatgggcccgcgtccgattagccagttggcggggtaacggcccaccaaagcaacgatcggtagccggcctgagagggcggacggccacattgggactgagacacggcccagactcctacgggaggcagcagtgggggatattgcacaatgggggaaaccctgatgcagcgacgccgcgtgggtgatagaagtatttcggtatgtaaagccctatcagcagggacgataatgacggtacctgagtaagaagccccg

SEQ ID NO: 428 - DNA, 490 bp, Unknown
  Ascusbbf_246820, encodes 16S rRNA
agagtttgatcatggctcaggacgaacgctggcggcgtgcttaacacatgcaagtcgaacgggggatattttagcttgctatgatattcctagtggcgaacgggtgagtaacgcgtaggcaacctgcccttgggatggggacaacaggccgaaaggcctgctaataccgaatgaagtaagtctgccgcatgacggacttatgaaagatggcctctacttgtaagctatcacccaaggatgggcctgcgtctgattagctagttggtggggtaaaggcccaccaaggcgacgatcagtagccggtctgagaggatgaacggccacattgggactgagacacggcccagactcctacgggaggcagcagtggggaatcttccgcaatgggcgaaagcctgacggagcaacgccgcgtgagtgaagaagggtttaggctcgtaaagctctgttgcaggggacgaaggccttggaggtgaataatctctgagga

SEQ ID NO: 429 - DNA, 490 bp, Unknown
  Ascusbbf_114004, encodes 16S rRNA
agagtttgatcatggctcaggatgaacgctggcggcgtgcctaatacatgcaagtcgaacgaggcggatgggagcttgctccttgaaacctagtggcgaacgggtgagtaacacgtaggtaacctgcctttaagcttgggatacccagaggaaactttggctaataccggataacaacagaagcggcatcgcttttgcttgaaaggccccttcaagggtcacttaaagatggacctgcggcgcattagctagttggtgagataacagcccaccaaggcaaggatgcgtagccgacctgagagggtgatcggccacattggaactgagacacggtccaaactcctacgggaggcagcagtaaggagttttcggcaatgggggaaaccctgaccgagcaacgccgcgtgaatgatgacggccctatgggttgtaaagttcttttataagggacgaatggttggtttaggaaatgaaaccaatttgacagtac

SEQ ID NO: 430 - DNA, 490 bp, Unknown
  Ascusbbf_111234, encodes 16S rRNA
agagtttgatcctggctcaggatgaacgctggcggcgtgcttaacacatgcaagtcgaacgaatttcttttggacggaggcttcggctgacagaagattgaagtgagtggcggacgggtgagtaacgcgtgggtaacctgccttacaccgggggataacagagggaaacttctgctaataccgcataagaccacggtaccgcatggtattgaggtaaaagctccggcgatgtaagatggacccgcgtctgattagccagttggcggggtaacggcccaccaaagcgacgatcagtagccgacctgagagggtgatcggccacattgggactgagacacggcccaaactcctacgggaggcagcagtggggaatattgggcaatgggcgcaagcctgacccagcgacgccgcgtgagtgaagaagtatttcggtatgtaaagctctttaagcagggaagataatgacggtacctgcagaataagcaccggc

SEQ ID NO: 431 - DNA, 490 bp, Unknown
  Ascusbbf_777870, encodes 16S rRNA
agagtttgatcatggctcaggacgaacgctggcggcgtgcttaacacatgcaagtcgagcggaaaggcccttcggggtactcgagcggcgaacgggtgagtaacacgtgagcaacctgcccctgactctgggataagcccgggaaactgggtctaataccggatatgacctccgcccgcatgggctggtggtggaaagtttttcggttggggatgggctcgcggcctatcagcttgttggtggggtagtggcctaccaaggcgacgacgggtagccggcctgagagggcgaccggccacactgggactgagacacggcccagactcctacgggaggcagcagtgggaatattgcgcaatgggcgaaagcctgacgcagcgacgccgcgtgggggatgacggccttcgggttgtaaacctctttcagcagggacgaagttgacgtgtacctgcagaagaagcgccggctaactacgtgccagcagccgcgg

SEQ ID NO: 432 - DNA, 490 bp, Unknown
  Ascusbbf_92558, encodes 16S rRNA
agagtttgatcatggctcaggatgaacgctagctacaggcttaacacatgcaagtcgcggggcagcatggagtcagcttgctgactttgatggcgaccggcgcacgggtgcgtaacgcgtaccgaacctgccccagtcagggggacagccctctgaaaggaggattaataccccatggtccctgtttgctgcatggcattcggggtaaaggtattccggactgggatggcggtgcgtaggattagctagtcggcggggtaacggcccaccgaggctacgatccttaggggttctgagaggaaggtcccccacactggtactgagacacggaccagactcctacgggaggcagcagtgaggaatattggtcaatggccgagaggctgaaccagccaagtagcgtgcaggatgacggccctctgggttgtaaactgcttttatacgggaacaaatttcgccacgtgtggtgttttgcgtgtaccgtaagaaa

SEQ ID NO: 433 - DNA, 490 bp, Unknown
  Ascusbbf_737388, encodes 16S rRNA
agagtttgatcatggctcaggatgaacgctggcggcgtgcttaacacatgcaagtcgaacggagatgcattttagaagttttcggatggaagagatacatcttagtggcggacgggtgagtaacacgtaaacaatctgcctttgagagcgggacaacagatagaaatatttgctaataccgcataagaccacaacatcgcatggtgaaggggtaaaaggggagcaatctcgctcaaagatgagtttgcggactattagctagttggtgaggtaacggcccaccaaggcagagatggttagccgacctgagagggtgatcggccacactggaactgagatacggtccagactcctacgggaggcagcagtgaggaatattgggcaatggaggaaactctgacccagcaacgccgcgtgaaggaagaaggttttcggattgtaaacttctgttataggggaaaaaggaagtgatggtaccctatgagcaagc

SEQ ID NO: 434 - DNA, 490 bp, Unknown
  Ascusbbf_674964, encodes 16S rRNA
agagtttgatcatggctcaggatgaacgctagcgacaggcttaacacatgcaagtcgagaggcagcgcggaggtagcaatacttctggcggcgaccggcgcactggtgagtaacacgtatgcaacctgccccgcgcagggggataatccggagaaatctggtctaataccccgtacgccgcgcctccgcatgggcacgcggtgaaaggagcgatccggcacgggatgggcatgcggcgcattagctagtcggcggggcgacggcccaccgaggcgacgatgcgtaggggttctgagaggaaggtcccccacactggtactgagacacggaccagactcctacgggaggcagcagtgaggaatattggtcaatggacggaggtctgaaccagccaagtcgcgtgagggaggacggccctacgggttgtaaacctcttttgcgggggagcaaagtgagccacgcgtggctcattgcgagtaccccgagaaaa

SEQ ID NO: 435 - DNA, 490 bp, Unknown
  Ascusbbf_734398, encodes 16S rRNA
agagtttgatcctggctcaggatgaacgctggcggcaggcctaatacatgcaagtcgcgcgggaattgccctttcgggggtgatgagagcggcggacgggtgcgtaacgcgtatgcaaccaacccccgacaggcggatagccggtggaaacgccggataatacgccatgaaccctttttggggcatcccagggaggggaaagcggagacgcggtcggggacgggcatgcgtcccattagatggttggcggggtgacggcccaccaagtctttgatgggtaggggatctgagaggacggtcccccacactggcactgagacacgggccagactcctgcgggaggcagcagtaggggatattgggcaatgggggcaaccctgacccagccatgccgcgtgagggaatgaggccctacgggtcgtgaacctcttttgcacggggacaaagtcctgcacgggatgcgggattgagggtaccgtgagaataagca

SEQ ID NO: 436 - DNA, 490 bp, Unknown
  Ascusbbf_353344, encodes 16S rRNA
agagtttgatcctggctcaggattaacgctggcggcatgcctaagacatgcaagtcgaacgaagtgccccattgaagtctgaatgaagttgaaaagcttgcttggatatggaatgacgatggatgtggattctgcactgagtggcgaacgggtgagtaacacgtgggttacctgcctctaagttggggacaacagttggaaacgactgctaataccgaatgtgatagtaatattaaaggtgccttaaagcatcgcttagagatgggcctgcggcgtattagctagttggtggggtaatggcctaccaaggcgacgatgcgtagccggactgagaggttgaacggccacactgggactgagacacggcccagactcctacgggagacagcagttaggaatattcggcaatgggggaaaccctgaccgagcaatgccgcgtgtgagatgaaggtcctctggattgtaaatcacttttattaagaaagaattg

SEQ ID NO: 437 - DNA, 490 bp, Unknown
  Ascusbbf_1794961, encodes 16S rRNA
agagtttgatcctggctcagattgaacgctggcggcaggcctaacacatgcaagtcgagcggaaacgatggaagcttgcttccaggcgtcgagcggcggacgggtgagtaatgcataggaatctgcccggtagtgggggataacctggggaaactcaggctaataccgcatacgtcctacgggagaaagcaggggctcttcggaccttgcgctatcggatgagcctatgccggattagctagttggtgaggtaatggctcaccaaggccgcgatccgtagctggtctgagaggatgatcagccacatcgggactgagacacggcccgaactcctacgggaggcagcagtggggaatattggacaatgggcgcaagcctgatccagccatgccgcgtgtgtgaagaaggccctcgggttgtaaagcactttcagtgaggaagaacgcctggcggctaatacctgccagggaagacatcactcacagaagaa

SEQ ID NO: 438 - DNA, 490 bp, Unknown
  Ascusbbf_1766462, encodes 16S rRNA
agagtttgatcctggctcaggatgaacgctggcggcacgcctaacacatgcaagtcgaacggagtttaagagagcttgctcttttaaacttagtggcggacgggtgggtaacacgtgatcaacctgcctttcagagagggatagcttctggaaacggatggtaatacctcataacatatgaatttggcatcttattcatatcaaagatttatcgctgaaagatgggctcgcgtctgattagcttgttggtgaggtaacggcccaccaaggcaacgatcagtagccggactgagaggttgaacggccacaatgggactgagacacggcccagactcctacgggaggcagcagtggggaatattgcacaatgggcgcaagcctgatgcagcgatgccgcgtgagggaagaaggttttcggattgtaaacctctgtcatcggggacgaaaatgacggtacccgaggaggaagctccggctaactacgtgccag

SEQ ID NO: 439 - DNA, 490 bp, Unknown
  Ascusbbf_712240, encodes 16S rRNA
agagtttgatcctggctcaggataaacgctggcggcgcacataagacatgcaagtcgaacggaagtcgttatactgattttgaaatgaacggagaacttgttcaaagggactggaagaagatttataacaatggctttagtggcggactggtgagtaatacgtaagcaacctgcctattagaggggaacaacagttagaaatgactgctaataccgcatatgccttaattaccacatggtagtagagggaaaggagtaatccgctgatagatgggcttacggctgattagctagttggaagggtaacggcctaccaaggcgacgatcagtagccggactgagaggtcaggcggccacattgggactgagatacggcccagactcctacgggaggcagcagtcgggaattttgcgcaatggaggaaactctgacgcagtgacgccgcgtgcaggaagaaggttttcggattgtaaactgctttagacaggg

SEQ ID NO: 440 - DNA, 490 bp, Unknown
  Ascusbbf_1837274, encodes 16S rRNA
agagtttgatcatggctcaggatgaacgctagcggcaggcttaacacatgcaagtcgaggggcagcgtgttggtagcaataccgacgacggcgaccggcgcacgggtgagtaacgcgtatgcaacctttcccagacagggggatagcccagggaaacttggattaataccccgtaggccgggggacggcatcgtccttcggttaaagttccggcggtctggggtgggcatgcgtgccattaggtggttggcggggtaacggcccaccaagccgacgatggctacggggtctaaaaggatggtcccgcacattggaactgagacacggtccaaactcctacgggaggcagcagtgaggaatattggtcaatggggggaaccctgaaccagccatgccgcgtggaggaagacggccctacgggttgtaaactcctttagcacgggaataaactcggccacgcgtggccgactgaaggtaccgtgagaataag

SEQ ID NO: 441 - DNA, 490 bp, Unknown
  Ascusbbf_1625041, encodes 16S rRNA
agagtttgatcatggctcaggacgaacgctggcggcgtgcctaatacatgcaagtcgagcgaatctgagggagcttgctcccgaagattagcggcggacgggtgagtaacacgtgggtaacctgcctgtaagattgggataactccgggaaaccggagctaataccggataacatattgaaccgcatggttcaatattgaaagatggtttcggctatcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtacgagagtaactgctcgtaccttgacggtaccta

SEQ ID NO: 442 - DNA, 489 bp, Unknown
  Ascusbbf_207014, encodes 16S rRNA
agagtttgatcctggctcaggacgaacgctggcggcgtgcctaagacatgcaagtcgaacgagggagcaatccctagtggcgaacggcggagtaagacataagcaacgtgccctgaagactgggatatacggtcgaaagaccgggtaataccggatgtggccgagactcggcatcgagtcttgactaaatggtttttcgcttcaggagcggcttatgacacatcaggtagttggtggggtaacggcctaccaagccgacgacgtgtagggggtctgagaggatgatccccccgagtgggactgagacacggcccacacacctacgggtggcagcagttaggaatcttgcccaatgggggaaaccctgaggcagcgacgccgcgtggaggatgaaggatttaggtctgtaaactccttttaccaggaaagacttaggacggtacctggtgaataagccccggctaactccgtgccagcagccgcggtaat

SEQ ID NO: 443 - DNA, 472 bp, Unknown
  Ascusbbf_82126, encodes 16S rRNA
agagtttgatcctggctcagaacgaacgctggcggcatgcctaacacatgcaagtcgaacgcctgtagcaatacaggagtggcggacgggtgagtaacgcgtgggaacctgcccaacagtacgggataaccaagggaaactttggctaataccgcatacgcccttcgggggaaagatttatcgctgatggatgggcccgcgtcggattagctagttggtgaggtaatggctcaccaaggctacgatccgtagctggtctgagaggacgaccagccacactgggactgagacacggcccagactcctacgggaggcagcagtggggaatattggacaatgggggaaaccctgatccagcaatgccgcgtgagtgatgaaggccttagggttgtaaagctctttcgacggggacgatgatgacggtacccgtagaagaagccccggctaacttcgtgccagcagccgcggtaat

SEQ ID NO: 444 - DNA, 490 bp, Unknown
  Ascusbbf_393618, encodes 16S rRNA
agagtttgatcatggctcaggatgaacgctagcgggaggcctaacacatgcaagccgaggggtatgattctttcggggatcggagaccggcgcacgggtgcgtaacgcgtatgtaacttaccccattcactgggatagcccttcgaaaggaggattaataccggataacactaaagtgggcatccactttggttgaaagattaatcggaatgggatagacatgcgtcagattagctagttggtgaggtaacggctcaccaaggcgatgatctgtagggggcctgagagggtgaccccccacactggtactgagacacggaccagactcctacgggaggcagcagtgaggaatattggacaatgggtgagagcctgatccagccatcccgcgtgcaggaagacggccctatgggttgtaaactgcttttgtatgggaataaaccaccttacgtgtagggtgttgaaggtaccatacgaataagcaccggct

SEQ ID NO: 445 - DNA, 490 bp, Unknown
  Ascusbbf_1806235, encodes 16S rRNA
agagtttgatcctggctcaggatgaacgctagctacaggcttaacacatgcaagtcgaggggcatcatgaacttagcttgctaagtttgatggcgaccggcgcacgggtgagtaacgcgtatccaacctgcccatgactcagggacagccctctgaaaggaggattaatacctgatgccgtcacgtcgcgacatcgcgtcgtgccgaaagattcatcggtcatggatggggatgcgtctgattaggcagtaggcggggtaacggcccacctagccgacgatcagtaggggttctgagaggaaggtcccccacattggaactgagacacggtccaaactcctacgggaggcagcagtgaggaatattggtcaatgggcgcgagcctgaaccagccaagtagcgtgaaggatgactgccctacgggttgtaaacttcttttattggggaataaccggcggcacgcgtgccgccctgcatgtaccctatgaat

SEQ ID NO: 446 - DNA, 490 bp, Unknown
  Ascusbbf_433411, encodes 16S rRNA
agagtttgatcatggctcaggatgaacgctagcggcaggcttaacacatgcaagtcgaggggcagcgtggtgtagcaatacaccgacggcgaccggcggaagggtgagtaacgcgtgagcaacatgccaccttcagggggatagtcattggaaacgatgcgtaataccccgtatacatttgttccgcatggggcggatgtgaaagatttatcgggaggtgattggctcgcgtgccattaggtagacggcggggtaacggcccaccgtgccgacgatggctaggggttctgagaggaagatcccccacattgggactgagacacggcccagactcctacgggaggcagcagtgaggaatattggacaatggaaggaattctgatccagccatgccgcgtgcgggaggacggccctatgggttgtaaaccgcttttgtgtgggagcaataaggtgtacgtgtacaccgacgagagtaccatacgaataagca

SEQ ID NO: 447 - DNA, 490 bp, Unknown
  Ascusbbf_754484, encodes 16S rRNA
agagtttgatcatggctcagaacgaacgctggcggcgcgtcttaagcatgcaagtcgagcgggattacctagcttgctaggtatgagagcggcggactggtgagtaacgcgtgggtgacgcacccttgggccggggatagccttaagaaattaagggtaatacaggatacggtcccttacgttggaggtaagggaggaaaggagccacggctccacccgaggaacggcccgcgacccatcagctggttggcggggaaaaggcccaccaaggcaatgacgggtatccggcctcagagggcgaccggacacattgggactgagatacggcccagactcctacgggaggcagcagctaagaatattccgcaatggggggaaccctgacggagcgacgccgcgtggacgatgaaggccggaaggttgtaaagtccttttctgacggaggaagaagtgccggagggaatgccggcatggtgactgtaggtcagga

SEQ ID NO: 448 - DNA, 490 bp, Unknown
  Ascusbbf_263802, encodes 16S rRNA
agagtttgatcctggctcaggatgaacgctggcggcacgcttaacacatgcaagtcgaacgaagtgcaaagagtttactttttacacttagtggcggacgggtgcgtaacgcgtgggtaacctacccttgacagggggataacgtatagaaatgtacgctaataccgcataagcccacggagtcgcatggctctgggggaaaagcgaatacggtcaaggatgggcccgcgtctgattaggtagttggcagggtaaaggcctaccaagcccacgatcagtagccggtctgagaggatggacggccacattgggactgagacacggcccaaactcctacgggaggcagcagtggggaatattgcacaatgggggaaaccctgatgcagcgatgccgcgtgaaggaagaagtgtttcggcacgtaaacttctatcagcaaggaagaaatcggacagtacttgagtaagcagccccggctaactacgtgccagc

SEQ ID NO: 449 - DNA, 490 bp, Unknown
  Ascusbbf_1804036, encodes 16S rRNA
agagtttgatcctggctcaggacgaacgctggcggcgtgcctaacacatgcaagtcgagcggggatgaattggatgagagcttcggcaggattctggtttattccagcggcggacgggtgagtaacgcgtgaacgatctgtcccatacagggggataacacttggaaacaggtgctaataccgcataagaccacggagccgcatggttctgaggtaaaaggagcgatccggtatggggtgagttcgcgtctgattagctggttggtgaggtaacggcccaccaaggcgacgatcagtagccgacctgagagggtgatcagccacattggaactgagacacggtccaaactcctacgggaggcagcagtgggaatattgggcaatgggcgaaagcctgacccagcaacgccgcgtgagggaagaaggttttcggattgtaacctctgtccttagtgacgaaggaagtgacggtagccaaggaggaagcccc

SEQ ID NO: 450 - DNA, 490 bp, Unknown
  Ascusbbf_255558, encodes 16S rRNA
agagtttgatcatggctcagattgaacgctggcggcatgccttacacatgcaagtcgaacggcagcacggggcaacctggtggcgagtggcgaacgggtgagtaaagcatcggaacgtaccctagagtgggggataactatccgaaaggatagctaataccgcatattctatgagtaggaaagcgggggatcttcggacctcgcgctctaggagcggccgatgtcagattagctagttggtggggtaaaggcctaccaaggcgacgatctgtagcgggtctgagaggatgatccgccacactgggactgagacacggcccagactcctacgggaggcagcagtggggaattttggacaatgggggcaaccctgatccagccatgccgcgtgagtgaagaaggccttcgggttgtaaagctctttcggccgggaagaaatcgtgtgggctaataccctgcatggatgacggtaccggaataagaagcaccg

SEQ ID NO: 451 - DNA, 490 bp, Unknown
  Ascusbbf_1044938, encodes 16S rRNA
agagtttgatcctggctcaggacgaacgctggcggcacgcttaacacatgcaagtcgaacggagaaactggatttattcattttcttagtggcggacgggtgagtaacacgtgagcaacctgcctttgagaggggaatagcttcgggaaactgatggtaataccctataatatatttgtaaggcatcttatggatatcaaagatttatcactcaaagatgggctcgcgtctgattagctagttggtgaggtaacggctcaccaaggcgacgatcagtagccggactgagaggttgaacggccacattgggactgagacacggcccagactcctacgggaggcagcagtggggaatattgcacaatggggggaaccctgatgcagcgatgccgcgtggaggaagaaggttttcggattgtaaactccttttgtctgggaagataatgactgtaccagatgaataagctccggctaactacgtgccagcagc

SEQ ID NO: 452 - DNA, 490 bp, Unknown
  Ascusbbf_1051995, encodes 16S rRNA
agagtttgatcctggctcaggacgaacgctggcggcgtgcttaacacatgcaagtcgaacggggcgataagaagcttgcttttttgagcctagtggcaaacgggtgagtaacgcgtggacaacctgccggagagatggggacaacatcccgaaagggttgctaataccgaatgacgtacgatgggcgcatgcccgatgtaccaaaggattctatccgctcttcgatgggtccgcgtccgattagctagttgggggggtaacggcccaccaaggcgacgatcggtagccggcctgagagggtgaacggccacattgggactgagacacggcccagactcctacgggaggcagcagtggggaatcttccgcaatgggcgcaagcctgacggagcaacgccgcgtgagtgaagaaggccttcgggccgtaaagctctgttgccggggaagagtggcaggaggggactcctgcagggacggtacccggcgagga

SEQ ID NO: 453 - DNA, 490 bp, Unknown
  Ascusbbf_1872870, encodes 16S rRNA
agagtttgatcctggctcaggataaacgctggcggcgtgcataacacattcaagtcgaacgaagcactttcgaacgagacttcggtcaagtttggatttgacttagtggcggacgggtgagtaacgcgtgagcaatctgccttggggtgcgggataacgtcgggaaactgacgctaataccgcatgacgcatactgatcgcatggtcggtatgccaaagatatattgccctgagatgagctcgcgtccgattagacagttggcggggtaacggcccaccaaatcaacgatcggtagccggactgagaggttgaacggccacattggaactgagatacggtccagactcctacgggaggcagcagtggggaatattgggcaatgggcgaaagcctgacccagcgacgccgcgtgagggaagaaggtcttcggattgtaaacctctttcagcagggaagaaggaagtgacggtacctgcagaagaagccacg

SEQ ID NO: 454 - DNA, 490 bp, Unknown
  Ascusbbf_48553, encodes 16S rRNA
agagtttgatcatggctcaggatgaacgctggcggcgtgcttaacacatgcaagtcgaacgaagcacttgagattgattcttcggaagatttctcttgtgacttagtggcggacgggtgagtaacgcgtgggtaacctgcctcacacagggggataacagttggaaacgaccgctaataccgcataacccgctagggccgcatggcccggacggaaaagatttatcggtgtgagatggacccgcgttggattagctagttggcagggtaacggcctaccaaggcgacgatccatagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggct

SEQ ID NO: 455 - DNA, 490 bp, Unknown
  Ascusbbf_210128, encodes 16S rRNA
agagtttgatcatggctcaggacgaacgctggcggcgtgcctaatacatgcaagtcgagcggaccgaacgggagcttgcttctgttcggttagcggcggacgggtgagtaacacgtgggtaacctgcccgtaagaccgggataactccgggaaaccggggctaataccggataacaccgaagaccgcatggtcttcggttgaaaggtggcttttgctaccacttacggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggtcttcggatcgtaaagctctgttgttagggaagaagaagtaccgttcgaatagggcggtacggtgacggtac

SEQ ID NO: 456 - DNA, 480 bp, Unknown
  Ascusbbf_21071, encodes 16S rRNA
agagtttgatcctggctcaggatgaacgctggcggcgtgcctaacacatgcaagtcgtacggaaaggcccttcggggtactcgagtggcggacggctgagtaacgcgtgggaacgtgccccaaagtgagggataacttcgagaaatcggagctaataccgcatatgatcttcggattaaagaatttattcgctttgggagcggcctgcgtcggattagatagttggtgaggtaatggctcaccaagtcgacgatccgtagctggtctgagaggatgaccagccagactggaactgagacacggtccagactcctacgggaggcagcagtgaggaatcttccacaatgggcgaaagcctgatggagcaacgccgcgtgcaggatgaaggccttcgggttgtaaactgcttttattagtgaggaatatgacggtaactaatgaataaggatcggctaactacgtgccagcagccgcggtaat

SEQ ID NO: 457 - DNA, 490 bp, Unknown
  Ascusbbf_112555, encodes 16S rRNA
agagtttgatcatggctcaggatgaacgctggcggcgtgccttagacatgcaagtcgaacgaagcacctttttttgatcccttcggggtgatgagtttggtgacttagtggcgaacgggtgagtaacacgtgagtgacctgccccgaagtgcggcataacagggggaaacccttgctaattccgcatagtctcccacctcttgtggtgtgagtaaagatttatcgcttcgggatgggctcgcggtccatcagctagttggtagggtaatggcctaccaaggcgacgacggatagccggcctgagagggtgtacggccacagggacactgagatacgggtcccactcctacgggaggcagcagttaggaatcttccacaatgggcgaaagcctgatggagcgacgccgcgtgaaggatgaaggtcctcggatcgtaaacttctaaaagagggacgataatgacggtacctcttgaaaagcaccggctaact

SEQ ID NO: 458 - DNA, 490 bp, Unknown
  Ascusbbf_155351, encodes 16S rRNA
agagtttgatcctggctcaggacgaacgctggcggcgtgcttaacacatgcaagtcgaacgctgaagctcccagcttgctgggggtggatgagtggcgaacgggtgagtaacacgtgagtaacctgcccctgactctgggataagcgctggaaacggtgtctaatactggatatgagcaacggtcgcatggcctgttgttggaaagatttattggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggggaaaccctgatgcagcaacgccgcgtgagggatgaatgccttcgggttgtaaacctcttttagtagggaagaagcctttgggtgacggtacctgcagaaaaagcaccggctaactac

SEQ ID NO: 459 - DNA, 490 bp, Unknown
  Ascusbbf_29395, encodes 16S rRNA
agagtttgatcatggctcaggatgaacgctggcggcgtgccttagacatgcaagtcgaacgaagcacccactaccgatcgcttcggtgtgaggaaatgggtgacttagtggcgaacgggtgagtaacacgtgagtgacctgccccgaagttcggcataacagggggaaacccttgctaattccgaatgtgctcccacctcttgtggtgtgagtaaagatttatcgcttcgggatgggctcgcggtccatcagctagttggtagggtaatggcctaccaaggcgacgacggatagccggcctgagagggtgtacggccacaggggcactgagatacgggtcccactcctacgggaggcagcagttaggaatcttccacaatgggcgaaagcctgatggagcgacgccgcgtgagggatgaaggtctttggatcgtaaacctctaaaagtgggacgataatgacggtaccacttgaaaagcaccggctaact

SEQ ID NO: 460 - DNA, 490 bp, Unknown
  Ascusbbf_10068, encodes 16S rRNA
agagtttgatcatggctcaggacgaacgctggcggcatgcctaacacatgcaagtcgaacgaggatagcaatatccgagtggcgaacgggtgagtaacacgtgagcaacctgccttacacaacgggatacctactggaaacagtagttaatacggtataagaccacagtaccgcatgatacagtggtaaaagatttatcggtgtaagatgggctcgcggcgcattagctagttggagaggtaacggctcaccaaggcgacgatgcgtagccgacctgagagggtgatcggccacattgggactgagatacggcccagactcctacgggaggcagcagtggggaatattgggcaatggaggaaactcttacccagcaatgccgcgtgaacgaagaaggtcgtaagattgtaaagttctttagtcagggactaataaatgaaggatctgaagaataagctccggctaactacgtgccagcagccgcggtaat

SEQ ID NO: 461 - DNA, 490 bp, Unknown
  Ascusbbf_2859, encodes 16S rRNA
agagtttgatcctggctcaggatgaacgctagctacaggcttaacacatgcaagtcgcggggcatcatggtgtgtagcaatacacactgatggcgaccggcggatgggtgagtaacgcgtatccaacctggccctatctcgggcacagcccctcgaaagagggattaattcccgatgttcccacgagttcgcatgttcttgtgggcaaaggcctttgccggatagggatggggatgcgttccattaggcagtcggcggggtaacggcccaccgagccttcgatggataggggttctgagaggaaggccccccacactgggactgagacacggcccagactcctacgggaggcagcagtgaggaatattggtcaatggcggcaacgctgaaccagccaagtagcgtgagggattacggccctatgggttttaaacctcttttgttggggagcaacctgtgccactagtggcacactgcgagtacccttcga

SEQ ID NO: 462 - DNA, 490 bp, Unknown
  Ascusbbf_7777, encodes 16S rRNA
agagtttgatcatggctcagaatgaacgctggcggcatggattaggcatgcaagtcgaacgagaaagcggcttcggccgcgagtaaagtggcgaaagggtgagtaacacgtgaggaacctgccccctggcccggaacaagcctgtgaaaacgggtctgaaaccggatgaggccccctcccgcatgggggggcggccaaatattcatagccaagggatggcctcgcggcccattagctagttggcggggtgacggcccaccaaggctacgacgggtaggtggtctgagaggatggtcacccacactgggactgagacactgcccagactcctacgggaggctgcagtcgagaatcttccgcaatgggcgcaagcctgacggagcgatgccgcgtgagggacgaaggccttcgggtcgtaaacctctgtcgaggggaacgaacgcaatgacggtacccctcaagaaagccacggctaaccacgtgccagcag

SEQ ID NO: 463 - DNA, 490 bp, Unknown
  Ascusbbf_30355, encodes 16S rRNA
agagtttgatcctggctcaggacgaacgctggcggcgcgcttaacacatgcaagtcgaacggtgaaggtgcttcggcaccggatcagtggcggacgggtgagtaacacgtgagcaacctgcccttcagagggggataacattgagaaatcagtgctaataccgcataagaccacagtaaggcatcttacaggggtcaaaggagagatccgctgaaggatgggctcgcgtcccattaggcagttggcggggtaacggcccaccaaacctgtgatgggtagccgtgctgagaggcaggccggccacactggaactgagacacggtccagactcctacgggaggcagcagtggggaatattgggcaatggacgaaagtctgacccagcgacgccgcgtggaggaagaaggccctcgggttgtaaactcctgtgacaggggacgaaggaagtgacggtaccctgagaggaagccccggctaactacgtgccagc

SEQ ID NO: 464 - DNA, 490 bp, Unknown
  Ascusbbf_40659, encodes 16S rRNA
agagtttgatcctggctcaggatgaacgctagcgggaggcttaacacatgcaagccgagggagataatatgacttgtcatatttgacaccggcggacgggtgagtaacatgtatgcaacttgcctctatcagtgggataacccggggaaactcggactaataccgcataataacctaatcaaccttgattaagtttaaaagatttatcggatagagataggcatgcgtaggattagttagttggtgaggtaacggctcaccaagacgatgatccttagggggcctgagagggtgatcccccacactggtactgagacacggaccagactcctacgggaggcagcagtgaggaatattggacaatgggtgagagcctgatccagccatcccgcgtgcaggaagacggccctatgggttgtaaactgcttttatacaggaataaaccaccttacgagtagggtgttgaaggtactgtaggaataagcatcgg

SEQ ID NO: 465 - DNA, 467 bp, Unknown
  Ascusbbf_1469229, encodes 16S rRNA
agagtttgatcctggctcagaacgaacgctggcggcaggcttaacacatgcaagtcgagcgccccgcaaggggagcggcagacgggtgagtaacacgtgggaatctacccatctctacgggataaccagggaaacttggactaataccgtatacgtccttcgggagaaagatttatcggagatggatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggagaagataatgacggtacccggagaagaagccccggctaacttcgtgccagcagccgcggtaat

SEQ ID NO: 466 - DNA, 490 bp, Unknown
  Ascusbbf_627804, encodes 16S rRNA
agagtttgatcatggctcaggatgaacgctagcggcaggcctaatacatgcaagtcgaacgggatccagattgtagcttgctacagtttggtgagagtggcgtacgggtgcgtaacgcgtgagcaacctacccatatcaggggtatagcccggcgaaagtcggattaacaccgcataacaatgcagtaccgcatggtaccgtatttaaatatttataggatatggatgggctcgcgtgacattagctagttggtaaggtaacggcttaccaaggctatgatgtcaaggggctctgagaggagaatcccccacactggtactgagacacggaccagactcctacgggaggcagcagtaaggaatattggtcaatggagggaactctgaaccagccatgccgcgtgcaggatgactgccctacgggttgtaaactgcttttatacgggaacaaaccctactacgtgtagtaggctgagtgtactgtaggaat

SEQ ID NO: 467 - DNA, 490 bp, Unknown
  Ascusbbf_672977, encodes 16S rRNA
agagtttgatcatggctcaggatgaacgctagcggcaggcctaatacatgcaagtcggacgggattgcagtatagcttgctatactgcatgagagtggcgcacgggtgcgtaacgcgtgagcaacctgcccatgtcagggggatagcccgttgaaagacggattaataccgcataacacatagagaccacctggtttctatgtcaaatatttataggacatggatgggctcgcgtggcattagttagttggtaaggtaacggcttaccaagacgatgatgcctaggggctctgagaggagtgacccccacactggtactgagacacggaccagactcctacgggaggcagcagtagggaatattggtcaatgggcgggagcctgaaccagccatgccgcgtgcgggacgaaggccctatgggtcgtaaaccgcttttatacgggaacaaccgcagttacgagtaactgtctgagtgtaccgtaggaataa

SEQ ID NO: 468 - DNA, 490 bp, Unknown
  Ascusbbf_171726, encodes 16S rRNA
agagtttgatcctggctcaggacgaacgctggcggcgtgcctaacacatgcaagtcgagcggggatgtatggaggaagttttcggatggaatcgatacattctagcggcggacgggtgagtaacgcgtgagcaacctgcctttcacagggggataacggatcgaaagattcactaataccgcatgagaccacgataccgagtggtataggggtcaaaggagcaatccggtgaaagatgggctcgcgtccgattaggtagttggtggggtaatggctcaccaagccaatgatcggtagccgacctgagagggtgatcggccacactggaactgagagacggtccagactcctacgggaggcagcagtggggaatattgggcaatgggggaaaccctgacccagcaacgccgcgtgagggaagaaggttttcggattgtaaacctctgtccttggtgaagagcagaagacggtagccaaggaggaagccccg

SEQ ID NO: 469 - DNA, 490 bp, Unknown
  Ascusbbf_366845, encodes 16S rRNA
agagtttgatcctggctcaggacgaacgctggcggcgtgcttaacacatgcaagtcgagcggtaaggctccttcgggagtacacgagcggcgaacgggtgagtaacacgtgagcaatctgcccttcacttcgggataaccaccggaaacggtggctaataccgaatgcgaccacttcaggcatctgatggtggtggaaagttccggcggtgaaggatgagctcgcggcctatcagcttgttggtgaggtaatggctcaccaaggcttcgacgggtagccggcctgagagggtgaccggccacactgggactgagacacggcccagactcctacgggaggcagcagtggggaatattggacaatgggcgaaagcctgatccagcaacgccgcgtgagggatgaatgccttcgggttgtaaacctctttcagcggggacgaagcgaaagtgacggtacccgcagaagaaggaccggccaactacgtgccagc

SEQ ID NO: 470 - DNA, 490 bp, Unknown
  Ascusbbf_1491448, encodes 16S rRNA
agagtttgatcctggctcagattgaacgctagcgggatgctttacacatgcaagtcgaacggcagcacgaaataaacttgcttatcttggtggcgagtggcgaacgggtgagtaatgtatcggaacgtgcccagtagcgggggataactactcgaaagagtggctaataccgcatacgccctacgggggaaagggggggatcgcaagacctctcactattggagcggccgatatcggattagctagttggtggggtaaaggcctaccaaggctgcgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcagggaagaaaaggcgcaggataataccttgcgccgctgacggtacctgcaga

SEQ ID NO: 471 - DNA, 490 bp, Unknown
  Ascusbbf_451791, encodes 16S rRNA
agagtttgatcctggctcagaatgaacgttggtggcgtggattaggcatgcaagtcgtgcgcgatggtccctttcgggggatcggagagcggcgaacggggtagtaaggcgtcggaacgtgcccacgggtccgggatagcggcgggaaactgccggtaataccggataattctccttggagcaaaggtgagattccgcctgtggagcggccgacgtgataccagcttgttggtgaggtaatggctcaccaaggctcagacgtctagggggtgtgagagcatggcccccaccactgggactgagacactgcccagacacctacgggtggctgcagtcgagaatcttcggcaatgggcgaaagcctgaccgagcgacgccacgtgcgggatgacggccctcgggttgtaaaccgctgtcgagggggatgaaatcacggttggcaatccaatcgtgttgacaaagccctggaggaagcgcgggctaagtacgt

SEQ ID NO: 472 - DNA, 490 bp, Unknown
  Ascusbbf_5094, encodes 16S rRNA
agagtttgatcctggctcaggatcaacgctggcggcgtgcctaatgcatgcaagtcgaacggggtggccttcgggtcacttacgtggcggacgggtgaggaacacgtgggcaacctgcctgatggagggggataaccgctggaaacagtgggtaataccgcataatcctggatctcgagtgggagatatagggaaagtcgcaagacgccgacagaggggcctgcgtccgattagctagacggtggggtaacggcctaccgtggcagtgatcggtagctggtttgagaggatgatcagccacacggggactgagacacggccccgactcctacgggaggcagcagcaaggaattttccgcaatgggcgaaagcctgacggagcaacgccgcgtgtgggatgacgcttttcggagtgtaaaccactgttcgtggggacgaagcactgacggtacccacggaggaaggcccggctaactacgtgccagcagcc

SEQ ID NO: 473 - DNA, 490 bp, Unknown
  Ascusbbf_15609, encodes 16S rRNA
agagtttgatcatggctcaggacgaacgctggcggcatgcctaacacatgcaagtcgaacggagttaagagaagcttgcttttcttaacttagtggcggacgggtgagtaacgcgtgagcaatctgcctttcagtggggaataatgttctgaaaagggcactaataccgcataatgtacagtgaccgcatgatcgttgtaccaaagatttatcgctgagagatgagctcgcgtccgattagccggttggtggggtaacggcctaccaaagctacgatcggtagccggactgagaggttgaacggccacattgggactgagacacggcccagactcctacgggaggcagcagtgggggatattgcgcaatgggggaaaccctgacgcagcaatgccgcgtgaaggatgaaggtcttcggattgtaaacttcttttgtcagggacgaacaatgacggtacctgacgaataagctccggctaactacgtgcca

SEQ ID NO: 474 - DNA, 490 bp, Unknown
  Ascusbbf_2826, encodes 16S rRNA
agagtttgatcatggctcaggacgaacgctggcggcgtgcttaatacatgcaagtcgagcgagctacttcggtagcgagcggcgcacgggtgagtaacgcgtagatgatctaccctcgagactgagatacctccgggaaactggagttaataccagataacgcacattggttggttctgatgtgttaaagcggtgcaagtcgcacttgaggatgagtctgcggcctatcagctagttggtggggtaacggcctaccaaggcgaagacgggtagctgatctgagaggatgatcagccacattgggactgagacacggcccaaactcctacgggaggcagcagtagggaatattgcgcaatggggggaaccctgacgcagcgacgccgcgtgagtgatgacggcctttttggttgtaaagctctgtaaagagggaaaaatgttatagtgaagagctataattgatggtacctctaaagtaaggaccggctaa

SEQ ID NO: 475 - DNA, 490 bp, Unknown
  Ascusbbf_87020, encodes 16S rRNA
agagtttgatcctggctcaggacgaacgctggcggcgtgcttaacacatgcaagtcgagcggaaaggctccttcgggggtactcgagcggcgaacgggtgagtaacacgtgagtaatctgcctctggcttcgggatagccctccgaaagggggattaataccggatatgaccagctactgcatggtggttggtggaaagttttttcggccagggatgtgctcgcggcctatcagcttgatggtggggtaatggcctaccatggcttcgacgggtagccggcctgagagggtgaccggtcacactgggactgagacacggcccagactcctacgggaggcagcagtggggaatattggacaatgggcggaagcctgatccagcaacgccgcgtgagggatgactgccttcgggttgtaaacctctttcagtaccgacgaagcgaaagtgacggtaggtacagaagaagcaccggccaactacgtgccagca

SEQ ID NO: 476 - DNA, 490 bp, Unknown
  Ascusbbf_1593, encodes 16S rRNA
agagtttgatcatggctcaggatgaacgctggcggcgtgcataacacattcaagtcgaacggacgaggccccttcggggactgagttagtggcggacgggtgagtaacgcgtgagcaacctacctatgcgagggggataacagttggaaacgactgctaataccgcataacatatgaatgaggcatctcagacatatcaaagattcattgcgcatagatgggctcgcgtccgattagatagttggtgaggtaacggcccaccaagtcgacgatcggtagccggactgagaggttgaacggccacattggaactgagagacggtccagactcctacgggaggcagcagtggggaatattgggcaatgggcgaaagcctgacccagcgacgccgcgtgagtgaagaaggtcttcggattgtaaagcttagttatcggggaagaaggaagtgacggtacccgaagagaaagccacggctaactacgtgccagc

SEQ ID NO: 477 - DNA, 490 bp, Unknown
  Ascusbbf_92019, encodes 16S rRNA
agagtttgatcatggctcaggacgaacgctggcggcgtgcctaatacatgcaagtcgagcggacctgaatggagcttgctccagacaggttagcggcggacgggtgagtaacacgtaggcaacctgcccgcaagaccgggataacgtagggaaacttacgctaataccggatagggcactctctcgcatgagagagtgcggaaaggtggcgcaagctaccacttgcggatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatgggcgaaagcctgatggagcaacgccgcgtgaacgatgaaggtcttcggattgtaaagttctgttgtcagggacgaataagtaccgttcgaacagggcggtaccttgacggtac

SEQ ID NO: 478 - DNA, 490 bp, Unknown
  Ascusbbf_97646, encodes 16S rRNA
agagtttgatcctggctcaggatgaacgctagcgggaggcctaacacatgcaagccgagcggtagaaagtagcttgctacttttgagagcggcgtacgggtgcgtaacacgtgtgcaacctgcctttatctggggaatagcctttcgaaaggaagattaatgctccataacatattgaatggcatcatttaatattgaaagctccggcggatagagatgggcacgcgcaagattagttagttggtgaggtaacggctcaccaaggcgatgatctttagggggcctgagagggtgatcccccacactggtactgagacacggaccagactcctacgggaggcagcagtgaggaatattggacaatgggtgaaagcctgatccagccatcccgcgtgaaggatgacggccctatgggttgtaaacttcttttgtatagggataaacctaccctcgtgagggtagctgaaggtactgtacgaataagcaccgg

SEQ ID NO: 479 - DNA, 490 bp, Unknown
  Ascusbbf_41062, encodes 16S rRNA
agagtttgatcatggctcagaacgaacgctggcggcgcgtcttaagcatgcaagtcggacggcagggcaccttcgggtgtccgagagtggcgaacgggtgagtaacacgtaagtgatctgccccatggacggggatagcctgtggaaacacagggtaataccggatgagatgtcaatgattgaactatgacatgaaagtggctacggccacgccgtgggatgagcttgcggctcattagctagttgggggtgtaacggaccaccaaggcgacgatgagtagccggcctgagagggtgaacggccacattgggactgagacacggcccagactcctacgggaggcagcagctaagaatattccgcaatggggggaaccctgacggagcgacgccgcgtgaacgatgaaggcagagatgttgtaaagttcttttatcgctgaagaataaccggtgcagggaatggcaccgggatgacgttaggcgatgaata

SEQ ID NO: 480 - DNA, 490 bp, Unknown
  Ascusbbf_171455, encodes 16S rRNA
agagtttgatcctggctcagaacgaacgctggcggcgcgtcttaagcatgcaagtcgggcggcaaggaggtgcttgcacctccctagagcggcggactggtgagtaacgcgtaggtgacgcaccccccggacggggatagcctgcagaaatgcagggtaataccggatacggtcccgggccctggaagcccgggaggaaaggagcctcggctccgccgggggagcggcctgcgtcccatcagctagatggcggtgtaacggaccaccatggcgatgacgggtacccggcctgagagggtgagcgggcacattgggactgagatacggcccagactcctacgggaggcagcagctaagaatattccgcaatgcgcgaaagcgtgacggagcgacgccgcgtggacgatgaaggccggaaggttgcagagtcctttggcgcccgaggaaaggccgggggaggcaatgcccccggggtgactgtagggcgaga

SEQ ID NO: 481 - DNA, 490 bp, Unknown
  Ascusbbf_117259, encodes 16S rRNA
agagtttgatcctggctcaggatgaacgctggcggcgtgcttaatacatgcaagtcgaacgctgaagctgactagcttgctagttagtggatgagtggcgaacgggtgagtaatacgtaggtaacctgccctaaagtgggggatagcagttggaaacgactattaataccccataggtaattgaatggcatctttcaattattaaagacgcgtttgcgtcgctgtaggatggacttacggtgcattagcttgttggtgaggtaacggctcaccaaggcgatgatgcatagccggcctgagagggtgaacggccacattgggactgagacacggcccagactcctacgggaggcagcagtaaggaattttcggcaatgggcgaaagcctgaccgagcaacgccgcgtgagtgatgaaggtcttcggatcgtaaagctctgttgtaaaggaagaactgatacttgaggaaatgctagtatcttgacggtact

SEQ ID NO: 482 - DNA, 490 bp, Unknown
  Ascusbbf_1750, encodes 16S rRNA
agagtttgatcatggctcaggatgaacgctggcggcgtgcctaatacatgcaagtcgaacggataccttcgggtattagtggcgaacgggtgagtaacacgtaggtaatctaccttaaagacggggataacagatggaaacgactgttaataccggatagtatatggaatcgcatggtttcatatttaaagttcctccgggaacactttaagatgagcctgcggcgcattagttagttggcggggtaaaggcccaccaagacgatgatgcgtagccggactgagaggttgaacggccacattgggactgagaacggcccagactcctacgggaggcagcagtagggaattttcggcaatgggggaaaccctgaccgagcaacgccgcgtgattgaagaagtatttcggtatgtaaaaatcttttttagaggacgaacgaccatatcagggaatgggtatggagtgacggtactttaagaataagccccgg

SEQ ID NO: 483 - DNA, 490 bp, Unknown
  Ascusbbf_654949, encodes 16S rRNA
agagtttgatcatggctcagattgaacgctggcggcaggcctaatacatgcaagtcggacggtatcagcgatgatatagtggcgaacgggtgagtaacacgttggtgacctgccccaaagatgggaatatcacctggaaacgggtggcaaaaccgaataagcttggcgtagttagagaaagtcaagtaaaagagtgatctactttgggaggggcctgcggcccatcagttagttagtgagggtaacggcccaccaagacggcgacgggtaggggacctgagagggtggtcccccacaatggaactgaaacacggtccatacacctgcgggtggcagcagtagggaatattgcttaatgggcgaaagcctgaagcagcaacgccgcgtggacgaaggaggccttcgggtcgtaaagtccttttataggggaaaaggaaggatggtaccctatgaataagtctcggctaactacgtgccagcagccgcggta

SEQ ID NO: 484 - DNA, 490 bp, Unknown
  Ascusbbf_1465, encodes 16S rRNA
agagtttgatcatggctcagaacgaacgctggcggcaggcttaacacatgcaagttggacgggaatcggaaggtagcttgctacctgaagaggagagtagcgcacgggtgagtaacacgtgggaacatacctattagtgggggataacaattggaaacgattgataataccgcataagccctgagggggaaaggaggaattcgctgatagaatggcccgcggaagattaggcagttggtggggtaaaggcctaccaaacctacgatctatagctggtctgagaggacgatcagccacattgggactgagacacggcccaaactcctacgggaggcagcagtgaggaatattgggcaatgggggcaaccctgacccagccatgccgcgtgagtgaagaaggttttcgaattgtaaagctctttcagatgtgaagatgatgacggtagcatcagaagaagccccggcaaacttcgtgccagcagccgcggta

SEQ ID NO: 485 - DNA, 490 bp, Unknown
  Ascusbbf_20688, encodes 16S rRNA
agagtttgatcatggctcaggacgaacgctggcggcatgcctaatacatgcaagtcgaacgagcttccgttgaatgacgtgcttgcactgatttcaacaatgaagcgagtggcgaactggtgagtaacacgtgggaaatctgcccagaagcaggggataacacttggaaacaggtgctaataccgtataacaacaaaatccgcatggattttgtttgaaaggtggcttcggctatcacttctggatgatcccgcggcgtattagttagttggtgaggtaaaggcccaccaagacgatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacacctttgagagtaactgttc

SEQ ID NO: 486 - DNA, 490 bp, Unknown
  Ascusbbf_2983, encodes 16S rRNA
agagtttgatcatggctcaggacgaacgctggcggcatgcctaacacatgcaagtcgaacggagcttaagaagcttgctttttaagcttagtggcggacgggtgagtaacgcgtgagtaacctgcctcttagtggggaataatgtactgaaaaggacactaataccgcataatgtattgagatcgcatggttttgataccaaagatttatcgctgagagatggactcgcgtccgattagccagttggtggggtaacggcctaccaaagcgacgatcggtagccggactgagaggttgaacggccacattgggactgagacacggcccagactcctacgggaggcagcagtgggggatattgcgcaatgggggaaaccctgacgcagcaatgccgcgtggaggatgaaggtcttcggattgtaaactccttttgtcagggacgaaaatgacggtacctgacgaataagctccggctaactacgtgccagca

SEQ ID NO: 487 - DNA, 490 bp, Unknown
  Ascusbbf_28640, encodes 16S rRNA
agagtttgatcctggctcaggatgaacgctagctacaggcttaacacatgcaagtcgaggggtaacatggcgggagcttgctcctgccgatgacgaccggcgcacgggtgagtaacgcgtatccaacctgcccctgagtcggggataaccttccgaaagggagcctaatacccgatgttgtgcgaggagggcatctgatttgcaccaaagatttatcgctcagggatggggatgcgtaggattaggcagcaggcggggtaacggcccacctggccggcgatccttaggggttctgagaggaaggtcccccacactggtactgagacacggaccagactcctacgggaggcagcagtgaggaatattggtcaatgggcgagagcctgaaccagccaagtagcgtgcaggatgacggccctacgggttgtaaactgcttttatgcggggataaagtgtgccatgtgtggcatattgcaggtaccgcatgaat

SEQ ID NO: 488 - DNA, 490 bp, Unknown
  Ascusbbf_6998, encodes 16S rRNA
agagtttgatcatggctcaggacgaacgctggcggcatgcctaacacatgcaagtcgaacggagttttgaggagcttgctccttaaaacttagtggcggacgggtgagtaacgcgtgagcaacctgcctttcagtggggaataatgttttgaaaagaacactaataccgcataatgtatagagatcgcatgatttttgtaccaaaggatttattcgctgagagatgggctcgcgtccgattagccagttggtggggtaacggcctaccaaagcaacgatcggtagccggactgagaggttgaacggccacattgggactgagacacggcccagactcctacgggaggcagcagtgggggatattgcgcaatgggggaaaccctgacgcagcaatgccgcgtgaaggatgaaggttttcggattgtaaacttcttttgtcagggacgaacgatgacggtacctgacgaataagctccggctaactacgtgc

SEQ ID NO: 489 - DNA, 490 bp, Unknown
  Ascusbbf_30922, encodes 16S rRNA
agagtttgatcatggctcaggatgaacgctggcggcgtgcctaacacatgcaagtcgaacgggactgattctacggagattcgtcgaagcagatgaaagtttagtggcggacgggtgagtaacgcgtgggtaacctgcctcatagagggggacaacagctggaaacggctgctaataccgcataagcccacactgccgcatggcagagggggaaaagatttatcgctatgagatggacccgcgtttgattagctagttggcggtgtaacggaccaccaaggcgacgatcaatagccggactgagaggttgaacggccacattgggactgagacacggcccaaactcctacgggaggcagcagtggggaatattgcacaatgggggaaaccctgatgcagcgacgccgcgtgggtgaagaagtttttcggaatgtaaagccctatcagcagggaagataatgacggtacctgactaagaagccccggctaa

SEQ ID NO: 490 - DNA, 490 bp, Unknown
  Ascusbbf_10079, encodes 16S rRNA
agagtttgatcatggctcaggattaacgctggcggcgtgcctaatacatgcaagtcgaatggtagcaataccatggcgaacgggtgagtaacacgtaggcaacctgtctttaagacgaggataaccactggaaacggtggataatactggataggatggtaaaaatcgcatgattaaccatttaaagtagcgatacacttagagaggggcctgcggcgcattagctagttggtaaggtaaaggcctaccaaggcgatgatgcgtagccggactgagaggttgaacggccacaatgggactgagaacggcccatactcctacgggaggcagcagtagggaattttcggcaatgggcgaaagcctgaccgagcaacgccgcgtgaacgaagaagtatttcggtatgtaaagttcttttattggggaagaaaaaattaaaattgacggtacccaatgaataagcaccggctaactacgtgccagcagccgcgg

SEQ ID NO: 491 - DNA, 490 bp, Unknown
  Ascusbbf_20163, encodes 16S rRNA
agagtttgatcatggctcaggatgaacgctggcggcgtgcctaacacatgcaagtcgaacgaagcatcttccttcggggagatgactgagtggcggacgggtgagtaacgcgtgggtaacctgccctttacagggggacaacagtcagaaatgactgctaataccgcatgagcgcacgagggggcatcctctcgtgtgaaaaactgaggtggtaaaggatgggcccgcgtctgattagctggttggcggggtaacggcccaccaaggcgacgatcagtagccggtctgagaggatgaacggccacattggaactgagacacggtccaaactcctacgggaggcagcagtgagggatattgcacaatggggggaaccctgatgcagcaacgccgcgtgggtgaagaagtatttcgatatgtaaagccctatcagcagggaagatgatgacggtacctgacgaagaagctccggctaaatacgtgccagcag

SEQ ID NO: 492 - DNA, 490 bp, Unknown
  Ascusbbf_47840, encodes 16S rRNA
agagtttgatcatggctcagaacgaacgctggcggcgcgtcttaagcatgcaagtcggacgggatatggtagcttgctaccattgagagtggcggactggtgagtaacgcgtgggtgacgtaccctggtgaccgggacagctcctagaaataggaggtaataccggatacgctggatgctgtcagagggcattcaggaaagcagcttttgctgcgcacgaggagcggcccgcgtgccattagctggttggtggggtaacggcctaccaaggcgatgatggctacccggcctaagagggtgaacgggcacattgggactgagatacggcccagactcctacgggaggcagcagctaagaatattccgcaatgggggaaaccctgacggagcgacgccgcgtggacgatgaaggccggaaggttgtaaagtccttttatgactgatgaataaggaaggtgagagaaacgccttctggtgacggtaggtcatg

SEQ ID NO: 493 - DNA, 490 bp, Unknown
  Ascusbbf_31385, encodes 16S rRNA
agagtttgatcatggctcaggatgaacgctggcggcaggcttaatacatgcaagtcgaacggtaaggccgagtgcagcaatgcatgaggcacacgagtggcgcacgggtgcgtaacgcgtatgcaacctgcccctaaccgggacaaaacgtcgagaaattggcgctaatatcccatgtggacactggacggcatcttccggtgtctaaagattcattggttagggatgggcatgcgtaacattagcttgttggcggggtaacggcccaccaaggcgacgatgtttaggggttctgagaggatggtcccccacactggaactgagacacggtccagactcctacgggaggcagcagtagggaatattgggcaatggaagcaattctgacccagccatgccgcgtgcaggaagacggccctatgggttgtaaactgctttttccgcggagtaaccgccgggacgcgtcccggcctgagagtacgcggggaat

SEQ ID NO: 494 - DNA, 490 bp, Unknown
  Ascusbbf_170085, encodes 16S rRNA
agagtttgatcatggctcaggatgaacgctggcggcgtgcctaacacatgcaagtcgaacggagatcatacagatggaggcttcggtcaaaagaagtttgatcttagtggcggacgggtgagtaacgcgtggagaacctgccctgtacagggggataacaggcagaaatgcctgctaataccgcataagcgcacgggagcgcatgcttctgtgtgaaaaactccggtggtacaggatggctccgcgttggattagctggttggcggggcaacggcccaccaaggcgacgatccatagccggcctgagagggtggacggccacattgggactgagacacggcccagactcctacgggaggcagcagtggggaatattgcacaatggggggaaccctgatgcagcgacgccgcgtgaaggaagaagtatctcggtatgtaaacttctatcagcagggaagagactgacggtacctgcacaagaagccccggc

SEQ ID NO: 495 - DNA, 490 bp, Unknown
  Ascusbbf_231015, encodes 16S rRNA
agagtttgatcatggctcaggacgaacgctggcggcgtgcttaacacatgcaagtcgaacgagattaagttggaagcttgcttttaacttagtcgagtggcggacgggtgagtaacgcgtgaataatctgtcctatacagggggataacgcatcgaaagatgtgctaataccgcgtaggaccacagcatcgcatggtgcaggggtgaaaggagcaatccagtatagggtgagttcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgaaagcctgacccagcaacgccgcgtgaaggaagaaggttttcggattgtaaacttctgtcctatgtgaagaggaagagacggtagcataggaggaagccccggctaacta

SEQ ID NO: 496 - DNA, 490 bp, Unknown
  Ascusbbf_37974, encodes 16S rRNA
agagtttgatcatggctcaggacgaacgctggcggcgtgcttaacacatgcaagtcgaacgaggataatgacttcggttgttattcgagtggcggacgggtgagtaacgcgtgagcaatctgtccttaagagggggataccaactggaaacagttgctaataccgcataagaccacggcctcacatggggctgaggtaaaagaaggaattcgcttaagggtgagctcgcgtctgattaggcagttggcggggtaacggcccaccaaaccgacgatcagtagccgacctgagagggtgaccggccacattgggactgagacacggcccagactcctacgggaggcagcagtggggaatattgggcaatgggcgcaagcctgacccagcaacgccgcgtgagggaagaaggttttcggattgtaaacctctgtcctgaaggacgaaggaagtgacggtacttcaggaggaagccccggctaactacgtgcca

SEQ ID NO: 497 - DNA, 490 bp, Unknown
  Ascusbbf_1012382, encodes 16S rRNA
agagtttgatcctggctcaggatgaacgctagcgggatgctttacacatgcaagtcgaacggcagcgcggacttcggtctggcggcgagtggcgaacgggtgagtaatgtatcggaacgtgcccagtagcgggggataactacgcgaaagcgtggctaataccgcatacgcccttatggggaaagcgggggaccttcgggcctcgcactattggagcggccgatatcggattagctagttggtggggtaaaggctcaccaaggcgacggtccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcaggaaagaaacggctctggataatacctggagttactgacggtacctgcagaataagcac

SEQ ID NO: 498 - DNA, 490 bp, Unknown
  Ascusbbf_224120, encodes 16S rRNA
agagtttgatcatggctcaggataaacgctggcggcgcacataagacatgcaagtcgaacgaacttaatcgattcttttagtttcgaagcggttagtggcggactggtgagtaacacgtaagtaacctgcctattagaggggaataacagtgagaaatcattgctaataccgcataagctaacaatatcgcatgatatagttagaaaaggagcaatccgctaatagatgggctcgcgtctgattagctagttggtgaggtaacggcttaccaaggcgacgatcagtagccgaactgagaggttgaacggccacattgggactgagatacggcccagactcctacgggaggcagcagtcgggaatattgcgcaatggaggaaactctgacgcagtgacgccgcgtataggaagaaggttttcggattgtaaactattgtcgttagggaagatacaagacagtacctaaggaggaagctccggctaactatg

SEQ ID NO: 499 - DNA, 490 bp, Unknown
  Ascusbbf_245933, encodes 16S rRNA
agagtttgatcctggctcagaacgaacgctggtagcgtggattaggcatgcaagtcgaacgggatcagctggttagcaataattggctgtgagagtggcggattggggaggaacacgtgagcaacctgcctttgagttggggaaaaccattggaaacgatggctaataccggatgtggcgcctggcgacatcgctggagcgctaaagggggccgcaaggctctcgctcggagaggggctcgcgcaccatcagcttgttggcggggtaacggcccaccaaggcatacggttagctggtctgagaggatgaccagccccactgggactgagatactgcccagactcctacgggaggctgcagtcgaggatcatttgcaatgggcgaaagcctgacaatgcgacgctgcgtggaggatgaaggccttcgggttgtaaactcctgtcatgagggaacaggcgatgtgacctaatacgtcacaaagttgagtgta

SEQ ID NO: 500 - DNA, 490 bp, Unknown
  Ascusbbf_144267, encodes 16S rRNA
agagtttgatcctggctcaggatgaacgctagcggcaggcttaacacatgcaagtcgaggggcagcgcggggtagcaatactctggcggcgaccggcggaagggtgcgtaacgcgtgagcaacatgcccgtatgagggggataagcactggaaacggtgtctaataccccgtaacactttgaaccgcatgattcgaagttaaaagatttatcgcatacggattggctcgcgtgacattagctagttggcggggtaacggcccaccaaggcgacgatgtctaggggttctgagaggaaggtcccccacactggaactgagacacggtccagactcctacgggaggcagcagtgaggaatattggtcaatgggcggaagcctgaaccagccatgccgcgtgaaggaataaggccctatgggtcgtaaacttcttttgacggggagcaataagggcgtcgcgcacgtccgatgagagtactcgtcgaataagc

SEQ ID NO: 501 - DNA, 490 bp, Unknown
  Ascusbbf_285995, encodes 16S rRNA
agagtttgatcctggctcagaacgaacgccggcggcgcgtcttaagcatgcaagtcgggcgggattccagtgcttgcactggatgagagcggcggactggcgaggaacgcgtgggcgacgtgccccccgcaccgggacagccggcagaaatgccgggtgatacgggatgcggtcgcaacctgtggtgggttgcgaggaaagctgccacggcagcggcgggggagcggcccgcgtcccatcagctagtaggcggggcaaaggcccacctaggcgacgacgggtacccggactgagaggtcggacgggcgcattgggactgagatacggcccagactcctacgggaggcagcagctaagaatattccgcaatgggcgaaagcctgacggagcgacgccgcgtggacgatggaggccggaaggttgtaaagtcctctggcgggggaagaaaaactgtcgcagggaatggcggcagcgtgaccgtaccccgaga

SEQ ID NO: 502 - DNA, 490 bp, Unknown
  Ascusbbf_732331, encodes 16S rRNA
agagtttgatcatggctcaggacgaacgctggcggcgtgcttaacacatgcaagtcgaacgagcctactggagcagcaatggtccggtaagcgagtggcggacgggtgagtaacgcgtgagcaatctgtccatgcgagggggataacatttggaaacagatgctaataccgcataagaccacgaggccgcatggcgatggggtcaaaggagaaatccgcgcatgggtgagctcgcgtcccattagatagttggtgaggtaacggccaccaagtcgacgatgggtagccgatctgagaggatgaccggccacattggaactgagaaacggtccaaactcctacgggaggcagcagtgggaatattgggcaatgggcgcaagcctgacccagcaacgccgcgtgagggaagaaggttttcggattgtaaacctctatcgtcggggacgagtgagagacggtacccggcaaggaagctccggctaactacgtg

SEQ ID NO: 503 - DNA, 490 bp, Unknown
  Ascusbbf_196124, encodes 16S rRNA
agagtttgatcatggctcaggatgaacgctggcggcgtgcctaacacatgcaagtcgaacggagttatcaaaggaagctcttcggagcggaagctgataacttagtggcggactggtgagtaacgcgtgagcaacctgcctttcagaggggaataacacatggaaacgtgtgctaataccgcataacgtatatttaaggcatcttagatataccaaaggagcaatccgctgagagatgggctcgcgtctgattagttagttggcggggtaacggcccaccaagacaacgatcagtagccgaactgagaggttgatcggccacattgggactgagatacggcccagactcctacgggaggcagcagtggggaatattgggcaatggacgaaagtctgacccagcaacgccgcgtgaaggaagaaggtcttcggattgtaaacttttgtctttggagacgaacagatgacggtatccaaaaaggaagctccg

SEQ ID NO: 504 - DNA, 490 bp, Unknown
  Ascusbbf_89432, encodes 16S rRNA
agagtttgatcctggctcaggataaacgctggcggcgtgcctaatacatgcaagtcgatcgctggaattcaagcttgcttgaatgaaggagaggcgaacgggtgagtaatacataagcaacctgcccacgaagactgggataatccctggaaacggggactaataccggataggtaacatattcgcatgaagatgttattaaagattagaagcactggtggatgggcttatggcgcattagttagttggtgaggtaacggcccaccaagacgatgatgcgtagccggcctgagagggtgaacggccacattgggactgagacacggcccagactcctacgggaggcagcagtagggaattttcggcaatgggcgcaagcctgaccgagcaacgccgcgtgagtgatgacggccttcgggttgtaaagctctgttgtaagggaagaaaaccccggataggatccgggactgacggtaccttaccagaaagc

SEQ ID NO: 505 - DNA, 490 bp, Unknown
  Ascusbbf_166154, encodes 16S rRNA
agagtttgatcatggctcaggatgaacgctggcggcgtgcctaacacatgcaagtcgagcgagacgcgacggaacataacttcggttttgggaagtcgccgatagcggcggacgggtgagtaacgcgtgggcaacctgccccttactgggagatagccgagggaaacttcgagtaataccccataacgcatagacgagacatctcgattatgccaaagatttatcggtaagggatgggcccgcgtccgattagctggttggtgaggcagcggctcaccaaggcgacgatcggtagccggcctgagagggcggacggccacattggaactgagacacggtccagactcctacgggaggcagcagtggggaatattgcacaatggagggaactctgatgcagcaacgccgcgtgaaggaagaagggtttcgacccgtaaacttctgtccttggggaagaaaaagatgacggtacccatggaggaagccccgg

SEQ ID NO: 506 - DNA, 490 bp, Unknown
  Ascusbbf_1830708, encodes 16S rRNA
agagtttgatcctggctcagaacgaacgctggcggcgcgtcttaagcatgcaagtcgagcggcagcagcaatgcgagagcggcggacgggtgagtaacacgtgggtaatctgccctccagtcggggatagcctgtggaaacacaggataataccggatgcgatggtcagtcataagactgattaggaaaggggctatggccccgctggaggatgagcccgcgtcccattagctagatggcagggtaaaggcctaccatggcgatgatgggtagccggcctgagagggtgaacggccacattggaactgagacacggtccagactcctacgggaggcagcagctaagaatcttccacaatggacggaagtctgatggagcgacgccgcgtgcgcgatgaaggccgtgaggttgtaaagcgcttttcttgagggggaacaacgcctgcagggaatggcaggcggatgacgtgaatcgaggaataagccccgg

SEQ ID NO: 507 - DNA, 490 bp, Unknown
  Ascusbbf_744892, encodes 16S rRNA
agagtttgatcctggctcaggatgaacgctagctacaggcttaacacatgcaagtcgaggggcatcatgagagttgcttgcaacttttgatggcgaccggcgcacgggtgcgtaacgcgtatcgaacctaccctatacacggggatagccttgcgaaagcaagattaatacccgatgttttgccattactgcatggtattggtaataaagatttatcggtataggatggcgatgcgtcccattagttagttggcggggtaacggcccaccaagacatcgatgggtaggggttctgagaggaaggtcccccacactggaactgagacacggtccagactcctacgggaggcagcagtgaggaatattggtcaatggtcgtaagactgaaccagccaagtagcgtgcaggaatacagccttataggttttaaactgcttttatgcgagagtaaagttaggcacgtgtgcttatttgcaagtatcgcaagaaa

SEQ ID NO: 508 - DNA, 490 bp, Unknown
  Ascusbbf_1869528, encodes 16S rRNA
agagtttgatcctggctcaggatgaacgctggcggcatgcctaagacatgcaagtcgaacgaggtgtcccattgaagatgaagtgcttgcacggatttggatttggatttgcacctagtggcgaacgggtgagtaacacatgggtgacctacctttaagactgggatacctattggaaacgatagttaataccggataacacgtatattcgtttatacgttgaaaggagcctttaaagctctacttttagatgggcctgtggggtattagatagttggtggggtaatggcctaccaagtcaacgatgcctagccgaactgagaggttgatcggccacattgggactgagacacggcccaaactcctacgggagacagcagttaggaatattcgtcaatgggggaaaccctgaacgagcaatgccgcgtgaacgatgacggccctatgggttgtaaagttctgttgcgtgggacgaacgattaggatagga

SEQ ID NO: 509 - DNA, 490 bp, Unknown
  Ascusbbf_1293741, encodes 16S rRNA
agagtttgatcctggctcaggacgaacgctggcggcgtgcttaacacatgcaagtcgaacgagggtgcaggagagcttgcccgaatgcagccgaatggcggacgggtgagtaacgcgtgaacaatctgtctcatacagggggataacgcgtcgaaagacgtgctaataccgcgtaggaccacagcaccgcatggtgcgggggtgaaaggcttcggccggtatggggtgagttcgcgtctgattagatagttggtgaggtaacggctcaccaagtcaacgatcagtagccgacctgagagggtgatcggccacattgggactgagacacggcccagactcctacgggaggcagcagtggggaatattgggcaatgggcggaagcctgacccagcaacgccgcgtgagggaagaaggttttcggattgtaaacctctgtcctgtatgaagagaaggagacggtagtacaggaggaagccccggctaactacg

SEQ ID NO: 510 - DNA, 490 bp, Unknown
  Ascusbbf_292302, encodes 16S rRNA
agagtttgatcatggctcaggataaacgctggcggcgtgcataacacattcaagtcgaacgaagctccggaacttgcttgcaagggaaggaagacttagtggcggacgggtgagtaacgcgtgagcaacctgcctcggggtgcgggataacgtttggaaacgaacgctaataccgcatgacgcacggagatcgcatggtcactgtgccaaagatttattgccctgagatgggctcgcgtccgattagacagttggtgaggtaacggctcaccaaatcaacgatcggtagccggactgagaggttgaacggccacattggaactgagatacggtccagactcctacgggaggcagcagtggggaatattgggcaatgggcgaaagcctgacccagcgacgccgcgtgagggaagaaggtcttcggattgtaaacctctttcagcagggaagaaggaagtgacggtacctgcagaagaagccacggctaact

SEQ ID NO: 511 - DNA, 490 bp, Unknown
  Ascusbbf_208454, encodes 16S rRNA
agagtttgatcctggctcaggacgaacgctggcggcgtgcttaacacatgcaagtcgaacggggctgattagcttgctaagaaagcccagtggcaaacgggtgagtaacgcgtaggcaacctgccgcggagatggggacaacaccccgaaaggggtgctaataccgaatgaagtacgagggacgcatgtcccatgtaccaaagggcgaaagcccgctccgcgatgggcctgcgtccgattagctggttggcggggcagcggcccaccaaggcgacgatcggtagccggtctgagaggatgaacggccacattgggactgagacacggcccagactcctacgggaggcagcagtggggaatcttccgcaatgggcgaaagcctgacggagcaacgccgcgtgagtgaagaaggccttcgggccgtaaagctctgttgtcggggacgagtgcccgggttggaagcccgggagggacggtacctgacgaggaa

SEQ ID NO: 512 - DNA, 490 bp, Unknown
  Ascusbbf_143555, encodes 16S rRNA
agagtttgatcctggctcaggacgaacgctggcggcgtgcttcatacatgcaagtcgaacgagaagctaaagcttgctttagtggaaagtggcggacgggtgagtaatgtgtagagaatctgccctacagtgggggatagcagttggaaacgactattaataccccatatgagcgtaattgagatattattcttgaaagatttatcgctgtaggatgagtctgcatctgattagcttgttgggggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgatcgtagaagcccttcggggtgtaaagatctgtcagtagggacgaaaaatgactgtacctacagaggaagcaccggctaactccgtgccagcagccg

SEQ ID NO: 513 - DNA, 490 bp, Unknown
  Ascusbbf_454, encodes 16S rRNA
agagtttgatcatggctcaggatgaacgctagcggcaggcttaacacatgcaagtcgaggggcagcgcgaggtagcaatactttggcggcgaccggcgaaagggtgcgtaacgcgtgagcaacttgcccgtatctgggacataagcggtggaaacgccgtctaatttcccataacaacagaggccgcatgacttctgtttgaaagatccgtcggatacggatgggctcgcgagacattagctagtcggcgtggtaacggcacaccgaggcgacgatgtctaggggttctgagaggaaggtcccccacactggaactgagacacggtccagactcctacgggaggcagcagtgaggaatattggtcaatgggcgcaagcctgaaccagccatgccgcgtgaaggaataaggccctatgggtcgtaaacttcttttgtggtggagcaataaggtgtacgtgtacaccgatgagagtacatcacgaataagca

SEQ ID NO: 514 - DNA, 480 bp, Unknown
  Ascusbbf_23084, encodes 16S rRNA
agagtttgatcatggctcagaacgaacgctggcggcaggcttaacacatgcaagtcgaacgagaagtcaccttcgggtgatggaaagtggcagacgggtgagtaacgcgtgggaacctacctagtggtacggaataactcagggaaacttgggctaataccgtatgtgcccgaaaggggaaagatttatcgccattagatgggcccgcgtcggattagctagttggtggggtaacggcccaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcgacggggacgataatgacggtacccgtagaagaagccccggctaacttcgtgccagcagccgcggtaat

SEQ ID NO: 515 - DNA, 487 bp, Unknown
  Ascusbbf_68, encodes 16S rRNA
agagtttgatcatggctcagaacgaacgctggcggcaggcttaacacatgcaagttgaacgggaatgtttgatagcttgctattaagcatgagagtagcgcactggtgagtaacacgtgggaacgtgccttttagtgggggacaacagttggaaacgactgctaataccgcatacgccctgagggggaaagatttatcgctaaaagatcggcccgcggaagattaggtagtaggtggggtaaaggcctacctagccgacgatctatagctggtctgagaggacgatcagccacattggaactgagacacggtccagactcctacgggaggcagcagtgaggaatattgggcaatggagggaactctgacccagccatgccgcgtgagtgagaaggtcttcggattgtaaagctctttcggatgggacgatgatgacggtaccatctaaagaagccccggcaaacttcgtgccagcagccgcggtaat

SEQ ID NO: 516 - DNA, 490 bp, Unknown
  Ascusbbf_671845, encodes 16S rRNA
agagtttgatcatggctcaggacgaacgctggcggcgtgcttcatacatgcaagttgaacgagaaacttacttcggtaagtggaaagtggcggacgggtgagtaatgtgtagagaatctgccccggagagggggacaacagagggaaacttctgctaataccccatatgagcgtagttgtgatactattcttgaaagatttatcgctccgggatgagtctgcatctgattagctagttgggggtgtaatggaccaccaaggcgacgatcagtagctggtttgagaggatgatcagccacaatgggactgggacacggcccatactcctacgggaggcagcagtagggaattttgcgcaatgggcgaaagcctgacgcagcaacgccgcgtgatcgcagacggccttcgggttgtaaagatctgtcagtagggacgaacaatgactgtacctacagaggaagcaccggctaactccgtgccagcagccgcg

SEQ ID NO: 517 - DNA, 490 bp, Unknown
  Ascusbbf_5975, encodes 16S rRNA
agagtttgatcctggctcaggacgaacgctggcggcgtgcttcatacatgcaagtcgaacgagaacttagagcttgctctaagggaaagtggcggacgggtgagtaatatgtagagaatctgcccttgagcgggggacaacagagggaaacttctgctaataccccatatgagcttggttgaaataccaatcttgaaaactccggtgctcaaggatgagtctgcatctgattagcttgttggcggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgaacgattaagcccttcggggtgtaaagttctgtcagtagggacgaatcttgacggtacctacagaggaagcaccggctaactccgtgccagcagccg

SEQ ID NO: 518 - DNA, 490 bp, Unknown
  Ascusbbf_11230, encodes 16S rRNA
agagtttgatcctggctcaggatgaatgctggcggcatgcctaatacatgcaagtcgagcggcagcgaggatctcatcctattctggattcattcaagaatagaatgagatctgtcggcgagcggcggacggctgagtaacgcatgggaacgcaccccaaactgagggataactagtcgaaagattagctaataccgcatgtgatcttcggattaaagctttcgggcggtttgggagcggcctgtgtacgattagatagttggtgaggtaatggctcaccaagtcgacgatcgttagatggtttgagaggatgatcatccagactgggactgagacacggcccagactcctacgggaggcagcagtagggaatctttcacaatgggcgaaagcctgatggagcaatgccgcgtgcaggacgaaggccttcgggttgtaaactgcttttataagcgaggaatatgacggtaacttatgaataaggatcggc

SEQ ID NO: 519 - DNA, 490 bp, Unknown
  Ascusbbf_30955, encodes 16S rRNA
agagtttgatcatggctcaggatgaacgctggcggcgtgcataacacattcaagtcgaacggacgagggggcttcggtccccgagttagtggcggacgggtgagtaacgcgtgagcaacctgcccttttgtgggggataacgacgggaaactgtcgctaataccgcataaccagatagtaccgcatggtacagtctgcaaagatttattgcgaaaggatgggctcgcgtccgattaggcagttggtgaggtaacggctcaccaaaccgacgatcggtagccggactgagaggttgaacggccacattggaactgagatacggtccagactcctacgggaggcagcagtggggaatattgggcaatgggcgaaagcctgacccagcgacgccgcgtgagggaagaaggtcttcggattgtaaaccttaaacaacagggacgaagaagtgacggtacctgttaggaagccacggctaactacgtgccagcag

SEQ ID NO: 520 - DNA, 490 bp, Unknown
  Ascusbbf_120181, encodes 16S rRNA
agagtttgatcctggctcaggacgaacgctggcggcgtgcttaaaacatgcaagtcgaacgggattgattggagtacttgtacaaagattaatctagtggcggacgggtgagtaacgcgtgagcaatctgcctatcacaggggaataacgactggaaacgggcgctaataccgcatatgaccacgacctggcatcaggaaggggtgaaaggagagatccggtgatagatgagcttgcgtctcattagctagttggtgaggtaacggcccaccaaggcaacgatgagtagccgatctgagaggatgaacggccacattggaactgagagacggtccaaactcctacgggaggcagcagttaggaatattgggcaatggaggaaactctgacccagcaacgccgcgtgaaggaagaaggtcttcggattgtaaacttctgatctgtggaaaaaataaagtgatggtaccacaggagcaagccacggctaact

SEQ ID NO: 521 - DNA, 490 bp, Unknown
  Ascusbbf_708709, encodes 16S rRNA
agagtttgatcatggctcaggacgaacgctggcggcgtgcctaatacatgcaagtcgagcggagctaatcttttcttcggaaaagatgatgcttagcggcggacgggtgagtaacacgtaggtaacctgcccataagactgggataacattcggaaacggatgctaataccagataatcaagtttctcgcatgagagacttgggaaaggcggagcaatctgtcacttatggatggacctgcggtgcattagctagttggtgaggtaacggctcaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggccttcgggtcgtaaagctctgttgccagggaagaacgctcaggagagtaactgctcctgaggtgacggt

SEQ ID NO: 522 - DNA, 490 bp, Unknown
  Ascusbbf_350639, encodes 16S rRNA
agagtttgatcatggctcaggatgaacgctagctacaggcttaacacatgcaagtcgaggggcagcacgggcattgcttgcaatgcctggtggcgaccggcgaatgggtgagtaacgcgtatccaacctgccccgtgcccgggaatagcccttggaaacgaggattaacgcccgatggcgtgccgcttccgcatggcggcggcactaaatgcgaaggctcgggatggggatgcgttccattaggttgttggcggggtaacggcccaccaagcccgcgatggataggggttctgagaggaaggtcccccacattggaactgagacacggtccaaactcctacgggaggcagcagtgaggaatattggtcaatgggcggaagcctgaaccagccaagtagcgtgagggatgacggccctacgggttgtaaacctcttttatgcggggataaagtgctccacgcgtggagttttgcaggtaccgcatgaataa

SEQ ID NO: 523 - DNA, 490 bp, Unknown
  Ascusbbf_80729, encodes 16S rRNA
agagtttgatcatggctcaggatgaacgctagcggcaggcctaacacatgcaagtcgaggggtaggagcagcttgctgctttgagaccggcgcacgggtgcgtaacgcgtatgcaatctaccttatactaagggatagcccagagaaatttggattaataccttatagtatatttgaatggcatcatttagatattaaagatttatcggtataagatgagcatgcgtcccattagttagttggtgtggtaacggcataccaagacgatgatgggtaggggtcctgagagggagatcccccacactggtactgagacacggaccagactcctacgggaggcagcagtgaggaatattggtcaatggaggcaactctgaaccagccatgccgcgtgcaggaagacggtcctatggattgtaaactgcttttgtacgggaagaaaccatactacgtgtagtaaactgacggtaccgtaagaataaggatcggc

SEQ ID NO: 524 - DNA, 490 bp, Unknown
  Ascusbbf_1714194, encodes 16S rRNA
agagtttgatcatggctcaggacgaacgctggcggcgtgcctaacacatgcaagtcgagcggggatatccaggaggagagctacggcaggaatcgggatatccaagcggcggacgggtgagtaacgcgtgagcaacctgtcccagacagggggataccagatggaaacatctgctaataccgcataagaccacgctctcgcatgggagcgaggtaaaaggaggaatccggtttggggtgggctcgcgtccgattagctagttggtgaggtaacggctcaccaaggcgacgatcggtagccgacctgagagggtgatcggccacattggaactgagacacggtccaaactcctacgggaggcagcagtggggaatattgggcaatgggcgaaagcctgacccagcaacgccgcgtgagggaagaaggttttcggattgtaaacctctgtcctaagtgacgaaggaagtgacggtagcttaggaggaagccc

SEQ ID NO: 525 - DNA, 490 bp, Unknown
  Ascusbbf_247812, encodes 16S rRNA
agagtttgatcatggctcaggatgaacgctggcggcatgcctaatacatgcaagtcaaacggagttagcaataactcagtggcgaacgggtgagtaacacataggtaacctatcattaagacgaggataacagttggaaacgactgataatactggattgtatattttttcacatggaagaatatttaaagacgcaaccaagcgtcacttaacgaggggcctatggcgcattagctagttggtgaggtaatggcccaccaaggcgacgatgcgtagctgcgctgagaggcgaaacagccacactgggactgagacacggcccagactcctacgggaggcagcagtagggaattttcggcaatgggcgaaagcctgaccgagcaatgccgcgtgaacgaagaagatcttcggattgtaaagttctgttgttaggaaagaatactatatataggaaatgatatatagatgacggtacctaactagaaagccc

SEQ ID NO: 526 - DNA, 490 bp, Unknown
  Ascusbbf_721870, encodes 16S rRNA
agagtttgatcctggctcaggatgaacgctggcggcgtgcctaacacatgcaagtcgagcggagatatacgccgaaagaagcttcggcctatttcattgtatatcttagcggcggatgggtgaggaacgcgtggagaacctgcccttcacagggggataacagcgggaaactgctgttaataccgcatatgctcacggtaccgcatggtacagggaggaaagcgctcagcggtgaaggatggctccgcgtcggattagccagttggcggggtaacggcccaccaaagcaatgatccgtagccggcctgagagggcgaccggccacattgggactgagacacggcccaaactcctacgggaggcagcagtgggggatattgcacaatgggggaaaccctgatgcagcgacgccgcgtgaaggaagaagtgcttcggcatgtaaacttctatcagcagggaagaagatgacggtacctgcacaagaagcccc

SEQ ID NO: 527 - DNA, 490 bp, Unknown
  Ascusbbf_1300708, encodes 16S rRNA
agagtttgatcctggctcaggacgaacgctggcggcgcgcttaacacatgcaagtcgaacggagacattctgttcactgggtagtggaggcgagcgagtgtttgaaagaacaagcgtcgagcttctactgctgagtgaatagaatgtcttagtggcggacgggtgagtaacacgtgaggaacctgccttgcagtggggaataacagtccgaaaggactgctaataccgcataacgtattctgaccgcatgatcgggataccaaagatttatcgctgtgagatggcctcgcgtccgattagacagttggcggggtaacggcccaccaaatctacgatcggtagccggactgagaggttgatcggccacattgggactgagacacggcccagactcctacgggaggcagcagtgggggatattgcacaatgggcgcaagcctgatgcagcgacgccgcgtgtgggaagacggtcttcggattgtaaaccact

SEQ ID NO: 528 - DNA, 490 bp, Unknown
  Ascusbbf_971252, encodes 16S rRNA
agagtttgatcatggctcaggataaacgctggcggcgcacataagacatgcaagtcgaacggacttaactcattcttttagattgagagcggttagtggcggactggtgagtaacacgtaagcaacctgcctattagaggggaataacaatgagaaatcattgctaataccgcataagctgataatatcgcatgatatagtcagaaaaggagcaatccgctaatagatgggcttgcggctgattagctagttggtggggtaacggcctaccaaggcgacgatcagtagccgagctgagaggctctacggccacattgggactgagatacggcccagactcctacgggaggcagcagtcgggaatattgcgcaatggaggaaactctgacgcagtgacgccgcgtataggatgaaggttttcggattgtaaactattgtcgttagggaagaaatttgacagtacctaaggaggaagctccggctaactatg

SEQ ID NO: 529 - DNA, 490 bp, Unknown
  Ascusbbf_1855704, encodes 16S rRNA
agagtttgatcctggctcaggatgaacgctggcggcgtgcctaacacatgcaagtcgaacggagatgaagagaagttttcggacagacctttatcttagtggcggacgggtgagtaacgcgtggataacctgcctctttctgggggatagcagttggaaacgactgataataccgcataagctccatggaccgcatgatccatggaggagagatttatcgggaagagatggatccgtgtctgattagccagttggcggggtaacggcccaccaaagcgacgatcagtagccggcctgagagggtgaacggccacattgggactgagacacggcccaaactcctacgggaggcagcagtggggaatattgcacaatgggcgcaagcctgatgcagcgacgccgcgtgagtgaagaagtatttcggtatgtaaagctctatcagcagggaagaaaggcccttcggggagatgacggtacctgactaagaagc

SEQ ID NO: 530 - DNA, 486 bp, Unknown
  Ascusbbf_641648, encodes 16S rRNA
agagtttgatcatggctcagaatgaacgttggcggcgtggattaggcatgcaagtcgcgcgacaaggtccttcgggactggaggagcggcaaacggggtagtaaggcatcggtacgtgccctcgagacggggatagcggcgggaaactgccggtaatacccgataatctctatggagcaaaggtccgccgcttgaggagcggccgatgtggtatcaggtagttggcggggtaacggcccaccaagccatcgacgcctagggggtgtgagagcacgacccccaccactgggactgagatactgcccagacacctacgggtggctgcagtcgagaatcttcggcaatgggcgcaagcctgaccgagcgacgccgcgtgcgggatgaaggcccttgggttgtaaaccgctgtcaggggggagcaaggcgtaagcttgagcgagccccagaggaagcacgggctaagttcgtgccagcagccgcggtaat

SEQ ID NO: 531 - DNA, 490 bp, Unknown
  Ascusbbf_721212, encodes 16S rRNA
agagtttgatcctggctcaggatgaacgctggcggcgtgcctaacacatgcaagtcgagcgagatgctcatgattgaagcttcggttgattttatgagcggaaagcggcggacgggtgagtaacgcgtaggcaacctgccccttgcagagggatagcctcgggaaaccgggattaaaacctcataatgcgccaagaagacatcttcatgacgccaaagatttatcggcaagggatgggcctgcgtctgattagttagttggtggggtaacggcctaccaaggcagcgatcagtagccgacctgagagggtgatcggccacattggaactgagacacggtccaaactcctacgggaggcagcagtggggaatattgcacaatgggggaaaccctgatgcagcaacgccgcgtgaaggatgaaggcctttgggtcgtaaacttctgttctaagggaagataatgacggtaccttaggagcaagtcccggcta

SEQ ID NO: 532 - DNA, 478 bp, Unknown
  Ascusbbf_1153876, encodes 16S rRNA
agagtttgatcctggctcagaacgaacgttggcggcgtggattaggcatgcaagttgagcgtactccgcaaggagaagcagcgtaaggggcagtaaggcatgggtacctacctcgggttcgggtatagcctgtagagatacagggtaatccccgatgatgtcgtaagaccaaagctccggcgaccggagaggggcccatgtgatattagctagttggtggggtaacggcccaccaaggcgaagatgtctagcgggtgtgagagcacgacccgcgccactggcactgagacactggccagacacctacgggtggctgcagtcgaggatcttcggcaatgggcgcaagcctgaccgagcgacgccgcgtgtgcgacgaaggccttcgggttgtaaagcactgtcgagggggagaaaaccgcaaggttgatctatccctggaggaagcacgggctaagttcgtgccagcagccgcggtaat

SEQ ID NO: 533 - DNA, 490 bp, Unknown
  Ascusbbf_748203, encodes 16S rRNA
agagtttgatcctggctcaggatgaacgctggcggcatgcctaagacatgcaagtcgaacgaggcggcccgaagaattagaaggaaattggagtgcttgcacaaagatggaattttgaggacacggattctccgcctagtggcgcaagggtgagtaacacgtgggtaatctaccttagagactgggataactactggaaacggtagctaataccggatgatatgcaagacgtaaagttttgtattaaaaggtgcctttaaagcatcactttaagatgagcctgcggcgtattagctagttggtaaggtaagagcttaccaaggcgacgatgcgtagccgacctgagagggtgatcggccacactgggactgagacacggcccagactcctacgggagacagcagttaggaatattcgtcaatgggggaaaccctgaacgagcaatgccgcgtgaaggaagacggtcctatggattgtaaacttctgttgt

SEQ ID NO: 534 - DNA, 490 bp, Unknown
  Ascusbbf_1887636, encodes 16S rRNA
agagtttgatcatggctcaggatgaacgctggcggcgtgcataacacattcaagtcgaacggacgacggggagcttgctccccgaagttagtggcggacgggtgagtaacgcgtgagcaacctgccttgcaaagcgggataacacggggaaaccggtgctaatacggcataatgtacgagattcgcatggatcttgtaccaaagatttatcgatgcaagatgggctcgcgtctgattagatagttggtgaggtaacggctcaccaagtcgacgatcagtagccggactgagaggttgaacggccacattggaactgagaaacggtccagactcctacgggaggcagcagtggggaatattgggcaatgggcgaaagcctgacccagcgacgccgcgtgaaggaagaaggtcttcggattgtaaacttttgtcgacagggaagataatgacggtacctgtcaaggaagccacggctaactacgtgccagca

SEQ ID NO: 535 - DNA, 490 bp, Unknown
  Ascusbbf_26869, encodes 16S rRNA
agagtttgatcatggctcaggatgaacgctagcggcaggcttaacacatgcaagtcgaggggtaacagggagtagcaatactccgctgacgaccggcgcacgggtgcgtaacgcgtatgcaacctgccctgtacaggggtataacggagggaaacttccactaatcccccatgatgtcgcgccggcgcatgccggagcgactaaagcttcggtggtacaggatgggcatgcgtgacattaggtagttggtggggcaacggcccaccaagccgacgatgtctaggggagctgagaggcttatcccccacactggtactgagacacggaccagactcctacgggaggcagcagtgaggaatattggtcaatggagggaactctgaaccagccatgccgcgtggaggaagaatgccctatgggttgtaaactccttttgtgccggagtaataagcggcttgcgagccgcgatgagagtacggtacgaataagc

SEQ ID NO: 536 - DNA, 490 bp, Unknown
  Ascusbbf_54688, encodes 16S rRNA
agagtttgatcatggctcaggatgaacgctagcgggaggcctaacacatgcaagccgagcgggatttaaggactagcttgctagtctttgatgagagcggcgtacgggtgcggaacacgtgtgcaacctgcctttatctgggagatagcctttcgaaaggaagattaatatcccataatatattgattggcatcgattaatattgaaagctccggcggataaagatgggcacgcgcaagattagatagttggtgaggtaacggctcaccaagtcaatgatctttagggggcctgagagggtgatcccccacactggtactgagacacggaccagactcctacgggaggcagcagtgaggaatattggacaatgggtgcaagcctgatccagccatcccgcgtgaaggaataaggacctatggtttgtaaacttcttttgtacagggataaacctagatacgagtatctagctgaaggtactgtacgaata

SEQ ID NO: 537 - DNA, 490 bp, Unknown
  Ascusbbf_1878, encodes 16S rRNA
agagtttgatcatggctcaggatgaacgctggcggcgtgcctaacacatgcaagtcgaacggggttaagagaaattttcggatggaccttaacttagtggcggacgggtgagtaacgcgtggataacctgcctcacacagggggatagcagctggaaacggctggtaataccgcataagaccacggccccgcatggagctgtagtaaaagatttatcggtgtgagatggatccgcgtctgattagccagttggcggggtaacggcccaccaaagcgacgatcagtagccggcctgagagggtgaacggccacattgggactgagacacggcccaaactcctacgggaggcagcagtggggaatattgcacaatgggcgcaagcctgatgcagcaacgccgcgtgagtgaagaagtatttcggtatgtaaagctctatcagcagggaagaaaggctcttcggagagatgacggtacctgactaagaagccc

SEQ ID NO: 538 - DNA, 490 bp, Unknown
  Ascusbbf_6250, encodes 16S rRNA
agagtttgatcatggctcaggatgaacgctggcggcgtgcctaatacatgcaagtcgaacgcaaatcttcgggtttgagtggcgaacgggtgagtaacacgtaggtaatctaccgtagagacggggataacgattggaaacgatcgctaataccggatagtatatggagtcgcatgagtccatatttaaagatacaaatgtatcactctatgatgagcctgcgtcgcattagctagttggtgagataatagcccaccaaggcgatgatgcgtagccggactgagaggttgaacggccacattgggactgagacacggcccagactcctacgggaggcagcagtagggaattttcggcaatgggggaaaccctgaccgagcaacgccgcgtgaatgaagaagtatttcggtatgtaaaattcttttgtataggaagaacgatcagtagagtggaaagctacggaagtgacggtactatacgaataagcccc

SEQ ID NO: 539 - DNA, 490 bp, Unknown
  Ascusbbf_44265, encodes 16S rRNA
agagtttgatcctggctcaggatgaacgctagctacaggcttaacacatgcaagtcgcggggcatcgcatggggcggcaacgtccctggcggcgaccggcggatgggtgagtaacgcgtatccaacctggccccctctccgggacagcccctcgaaagagggattaataccggatgttcccgagtttgcgcatgcatacttgggcaaaggcttcggtcggaaggggatggggatgcgttccattaggcagccggcggggtaacggcccaccgggccttcgatggataggggttctgagaggaaggtcccccacactggtactgagacacggaccagactcctacgggaggcagcagtgaggaatattggtcaatggccgggaggctgaaccagccaagtagcgtgagggatgacggccctatgggtcttaaacctcttttgttggggagcaaagtgcgccacttgtggcgtattgcgagtacccttcgaa

SEQ ID NO: 540 - DNA, 490 bp, Unknown
  Ascusbbf_53844, encodes 16S rRNA
agagtttgatcatggctcaggacgaacgctggcggcgtgcctaacacatgcaagtcgagcggggattacggaagagtttacttggaagtaattctagcggcggacgggtgagtaacgcgtgagcaacctgccttcaacagggggataacgcttcgaaagaagtgctaataccgcgtaagaccacgaggtcacatggccatggggtcaaaggagcaatccggttgaagatgggctcgcgtccgattagctagttggtgagacaacagcccaccaaggcgacgatcggtagccgacctgagagggtgatcggccacattggaactgagaaacggtccagactcctacgggaggcagcagtgggaatattgggcaatgggcgaaagcctgacccagcaacgccgcgtgagggaagaagggtttcggctcgtaaacctctgtcctgaagggcgaagacaatgacggtacttcaggaggaagccccggctaacta

SEQ ID NO: 541 - DNA, 490 bp, Unknown
  Ascusbbf_36429, encodes 16S rRNA
agagtttgatcatggctcaggacgaacgctggcggcatgcctaatacatgcaagtcgaacgaaccatcctgaagattgaagcttgcttcatgattcagattttggtgagtggcggacgggtgagtaacacgtgggtaacctgcccaaaagtgggggataacatttggaaacaagtgctaataccgcataacaactactttcacatgatcgtagcttgaaagatggctctgctatcgcttttggatggacccgcggcgtattagctagttggtgaggtaatggctcaccaaggcaatgatacgtagccgacctgagagggtaatcggccacattgggactgagacacggcccaaactcctacgggaggcagcagtagggaatcttccacaatgggcgaaagcctgatggagcaatgccgcgtgagtgaagaaggttttcggatcgtaaaactctgttgttgaagaagaacatgcgtgagagtaactgttca

SEQ ID NO: 542 - DNA, 490 bp, Unknown
  Ascusbbf_147773, encodes 16S rRNA
agagtttgatcctggctcaggatgaacgctggcggcgtgcataacacattcaagtcgaacggaagtagcaatactttagtggcggacgggtgagtaacgcgtaagcaatctgcctctgtgagtggaataacagctggaaacggctgctaataccgcatgacgcaacggaaccgcatgattctgttgccaaagatttatcgcacggagatgagcttgcgtccgattagatagttggcggggtaacggcccaccaagtcgacgatcggtagccggactgagaggttgaacggccacattggaactgagaacggtccagactcctacgggaggcagcagtggggaatattgggcaatggacgaaagtctgacccagcgacgccgcgtgagggatgaagatcttcggattgtaaacctttgtcaacagggacgaagcaagtgacggtacctgtggaggaagccacggctaactacgtgccagcagccgcggtaa

SEQ ID NO: 543 - DNA, 490 bp, Unknown
  Ascusbbf_1486074, encodes 16S rRNA
agagtttgatcctggctcagaacgaacgctggcggcgcgtcttaagcatgcaagtcggacggcagggtgccttcgggcttccgagagtggcgaacgggtgagtaacacgtaagtgatctgccctgcagttggggatagcctgtggaaacacagggtaataccggatgagatgtcaatgattgaactatgacatgaaagtggctatggccacgctgcaggatgagcttgcggctcattagctagttgggggtgtaacggaccaccaaggcgacgatgagtagccggcctgagagggtgaacggctacattgggactgagacacggcccagactcctacgggaggcagcagctaagaatattccgcaatggggggaaccctgacggagcgacgccgcgtgaacgatgaaggcagagatgttgtaaagttcttttatcgctgaagaataaccccggtagggaatgaccgggggatgacgttaggcgatgaata

SEQ ID NO: 544 - DNA, 490 bp, Unknown
  Ascusbbf_401353, encodes 16S rRNA
agagtttgatcctggctcaggatgaacgctagcgataggcctaacacatgcaagtcgaggggcagcacatgacgtagcaatacagatggtggcgaccggcgcacgggtgagtaacacgtatgcaacctaccttccacaggagaataacccgttgaaaaacggactaatactccataacacagggatcccgcatgggaatatttgttaaagattttttcggtagaagatgggcatgcgttccattagctagttggttgaggtaacggctcaccaaggcaacgatggataggggaactgagaggtttatcccccacactggtactgagacacggaccagactcctacgggaggcagcagtgaggaatattggtcaatggaggcaactctgaaccagccacgtcgcgtgaaggatgacggccctacgggttgtaaacttcttttatacaggaataaagtgagtcacgtgtgactttttgcatgtactgtatga

SEQ ID NO: 545 - DNA, 490 bp, Unknown
  Ascusbbf_80740, encodes 16S rRNA
agagtttgatcctggctcagagtgaacgctggcggcgtggctaagacatgcaagttgagcgagaatataccttcgggtatagggaagcggcaaacgggtgagtaacacgtaagtaacctacccttgagactgggatagctcagcgaaagttgaggtaataccggatgacaacccatgatgcatgttatgggattcaaaggggtgagacgatgctcaaggaggggcttgcggcctatcagctagttgggggtgtaacggaccaccaaggcaaagacgggtagccggtctgagaggacggacggccacattggaactgagacacggtccaaacatctacggatggcagcagtttcgaattattcacaatgggcgaaagcctgatggtgcgacgtcgcgtggaggaagaaggtcttcggattgtaaactcctgtcattagggagcaaagagcgagtttgaagctcgtattgagttaacctaaagaggaagcag

SEQ ID NO: 546 - DNA, 490 bp, Unknown
  Ascusbbf_18533, encodes 16S rRNA
agagtttgatcctggctcaggacgaacgctggcggcgcgcctaacacatgcaagtcgaacggacgaggatccttcgggatccgagttagtggcgaacgggtgagtaacacgtgaggaacctacctttcagagggggataacacttagaaataggtgctaataccgcataagaccacgaccgggcatccggatgaggtcaaaggagcaatccgctgagagacggcctcgcgtccgattaggtagttggcggggcaacggcccaccaagcctacgatcggtagccggactgagaggttgaacggccacattgggactgagacacggcccagactcctacgggaggcagcagtggggaatattgggcaatgggggaaaccctgacccagcgacgccgcgtgagggaagaaggttttcggattgtaaacctctgtcttcggggacgatagtgactgtacccgaggaggaagccacggctaactacgtgccagca

SEQ ID NO: 547 - DNA, 490 bp, Unknown
  Ascusbbf_149747, encodes 16S rRNA
agagtttgatcctggctcaggatgaacgctggcggcgtgcctaatacatgcaagtcggacggtatcagcgatgatatagtggcgaacgggtgagtaacacgttggtgacctgccccaaagatgggaatatcacctggaaacgggtggcaaaaccgaataagctcggcacagttagagaaggccgagtaaaagagtgatctactttgggaggggcctgcggcccatcagttagttggtgagggtaacggcccaccaagacggcgacgggtaggggacctgagagggtggtcccccacaatggaactgaaacacggtccatacacctgcgggtggcagcagtagggaatattgctaaatgggcgaaagcctgaagcagcaacgccgcgtggacgaaggaggccttcgggtcgtaaagtccttttatgggggaaaaggaaggatggtaccccatgaataagtctcggctaactacgtgccagcagccgcggta

SEQ ID NO: 548 - DNA, 490 bp, Unknown
  Ascusbbf_52236, encodes 16S rRNA
agagtttgatcctggctcaggatgaacgctggcggcgtgcttaacacatgcaagtcgaacggaacttttctcccgaagaagcggagtgcttgcacaaagtagattcatttgaaaagtttagtggcggacgggtgagtaacgcgtgggtaacctgccttacacagggggacaacagttggaaacgactgctaataccgcataagcgcacagtaccgcatggtacagtgtgaaaaactccggtggtgtaagatggacccgcgtctgattagctagttggtgaggtaacggcccaccaaggcgacgatcagtagccggcctgagagggtgaacggccacattgggactgagacacggcccaaactcctacgggaggcagcagtggggaatattggacaatgggggaaaccctgatccagcgacgccgcgtgagtgaagaagtatttcggtatgtaaagctctatcagcaaggaagaaaatgacggtacttgac

SEQ ID NO: 549 - DNA, 481 bp, Unknown
  Ascusbbf_30819, encodes 16S rRNA
agagtttgatcatggctcagaacgaacgctggcggcaggcctgaggcatgcaagtcgaacgagaaagtgtagcaatacacgagtagagtggcgcacgggtgagtaatatatgggaatctgcccagaagtggggaataacagttggaaacgactgctaataccgcatacgccggaaacgggaaagatttatcgcttttggatgagcccatattggattagcttgttggtggggtaaaggcctaccaaggcgatgatccatagctggtttgagagaatgatcagccacactggaactgagacacggtccagactcctacgggaggcagcagctaggaatattggacaatgggggaaaccctgatccagccatgccgcgtgagtgaagaaggccttcgggttgtaaaactcttttaatggggaagatgatgacggtacccatagaataagcaccggctaacttcgtgccagcagccgcggtaat

SEQ ID NO: 550 - DNA, 490 bp, Unknown
  Ascusbbf_236153, encodes 16S rRNA
agagtttgatcctggctcagattgaacgctggcggcatgcttaacacatgcaagtcgaacggcagcatagtctagcttgctagatgggtggcgagtggcgaacgggtgagtaacgcgtaggaatatgccttaaagagggggataacttggggaaactcaagctaataccgcataagctctgaggagtaaagctggggaccttatggcctggcgctttaagattagcctgcgtccgattagctagttggtggggtaagggcctaccaaggcgacgatcggtagctggtctgagaggatgaccagccacactggaactgagacacggtccagactcctacgggaggcagcagtggggaatattggacaatggggggaaccctgatccagcaatgccgcgtgtgtgaagaaggcctgagggttgtaaagcactttcagtggggaggagggttgactggttaagagctggttaattggacgttacccacagaag

SEQ ID NO: 551 - DNA, 490 bp, Unknown
  Ascusbbf_227226, encodes 16S rRNA
agagtttgatcctggctcaggacgaacgctggcggcgcgcctaacacatgcaagtcgaacgggactagtgaccggaggatagatggaatctatcttgcgatcactagttcagtggcggacgggtgagtaaagcatgagcaacttgcctgatagagggggatagcttttggaaacagaagataataccgcatacttcaaaagtttcgcatggagtttttggaaaaggagcaatccgctatcagatgggctcatgtccgattagctagttggtgtggtaatggcataccaaggcgacgatcggtagccgtactgagaggttcaacggccacattgggactgagacacggcccagactcctacgggaggcagcagtgaggaatattgcgcaatggaggcaactctgacgcagcgacgccgcgtgaaggaagacggtcttcggattgtaaacttctgtcttcagggaagaaacaaatgacggtacctggggagg

SEQ ID NO: 552 - DNA, 470 bp, Unknown
  Ascusbbf_85793, encodes 16S rRNA
agagtttgatcctggctcagaacgaacgctggcggcaggcttaacacatgcaagtcgagcggacacttcggtgtcagcggcagacgggtgagtaacacgtggggatctgcctagtggtacggaacaacacagggaaacttgtgctaataccgtataagtccttcgggagaaagatttatcgccattagatgaacccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgaaagcctgatccagccatgccgcgtgagtgatgaaggccttagggttgtaaagctctttcgttggggaagataatgactgtacccaaagaagaagccccggctaacttcgtgccagcagccgcggtaat

SEQ ID NO: 553 - DNA, 490 bp, Unknown
  Ascusbbf_506517, encodes 16S rRNA
agagtttgatcctggctcaggatcaacgctggcggcgtgcctaatgcatgcaagtcgaacggggtcgccttcgggtggcttacgtggcggacgggtgaggaacacgtgggtaacctgcccattggtgggggctagccctcggaaacgaggggtaattccgcataagctcatgactcgagtgggagtgatgaggaaaggccttcgggtcgccgatggaggggcctgcgaccgattagctagacggtggggtaacggcctaccgtggcaatgatcggtagctggtttgagaggatgatcagccacacggggactgagacacggccccgactcctacgggaggcagcagcaaggaattttccgcaatgggcgaaagcctgacggagcaacgccgcgtgtgggatgacgcttttcggagtgtaaaccactgttcatggggacgaagcactgacggtacccatggaggaaggcccggctaactacgtgccagcag

SEQ ID NO: 554 - DNA, 490 bp, Unknown
  Ascusbbf_1188540, encodes 16S rRNA
agagtttgatcctggctcaggatgaacgctggcggcgtgcttaacacatgcaagtcgaacgggatcccaggagcttgctcctgggtgagagtggcgaacgggtgagtaatgcgtgaccgacctgccccatacaccggaatagctcctggaaacgggtggtaatgccggatgctccgacatgacgcatgtcgtgtcgggaaagattcatcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgactgggagcaagcccttcggggtgagtgtacctttcgaataagcaccggctaactacgt

SEQ ID NO: 555 - DNA, 490 bp, Unknown
  Ascusbbf_1243, encodes 16S rRNA
agagtttgatcatggctcagaacgaacgctggcggtatgctttaaccatgcaagtcgaacgagaaagagtagcaatacttgagtaaagtggcaaacgggtgagtaacacacaggaatctacccagtagaggggaataagcactggaaacggtgtctaataccgcatactacgactgtagaaatactttcggaaagggttagtagcaatactaattcgctattggatgagcctatgtcggattagctagttggtggggtaatggcctaccaaggcgatgatccgtagctgatctgagagggtgatcagccacactggaactgcgacacggtccagactcctacgggaggcagcaggtgggaatattggacaatgggcgaaagcctgatccagcaataccgcgtgaatgatgaaggccttcgggttgtaaagttcttttaatagggaagataatgacggtacctatagaataagcaccggcaaacttcgtgc

SEQ ID NO: 556 - DNA, 490 bp, Unknown
  Ascusbbf_10036, encodes 16S rRNA
agagtttgatcatggctcaggacgaacgctggcggcatgcctaacacatgcaagtcgaacgagagtagcaatactcgagtggcgaacgggtgagtaacacgtgagcaacctgccttacacaacgggatacctactggaaacagtagttaatacggtataagaccacagtaccgcatgatacagtggtaaaagatttatcggtgtaagatgggctcgcggcgcattagctagttggagaggtaacggctcaccaaggcgacgatgcgtagccgacctgagagggtgatcggccacattgggactgagatacggcccagactcctacgggaggcagcagtggggaatattgggcaatggaggaaactcttacccagcaatgccgcgtgaatgatgaaggtcgtaagattgtaaagttctttagtcagggacaaagaaagtgatggtacctgaagaataagctccggctaactacgtgccagcagccgcggta

SEQ ID NO: 557 - DNA, 490 bp, Unknown
  Ascusbbf_54933, encodes 16S rRNA
agagtttgatcatggctcaggatgaacgctggcggcgtgtttaacacatgcaagtcgagcgagaagctttccagttgattcttcggatgaaacaggattgcggaaagcggcggacgggtgagtaacgcgtaggcaacctgccccctgcagagggatagcctcgggaaaccgggattaaaacctcataatgcgcgagtgagacatctcacatgcgccaaagatttatcggcaggggatgggcctgcgtctgattagttagttggtggggtaacggcctaccaaggcgacgatcagtagccgacctgagagggtgatcggccacattggaactgagacacggtccaaactcctacgggaggcagcagtggagaatcttgcacaatgggcgaaagcctgatgcagcaacgccgcgtgaaggatgaaggcccttgggtcgtaaacttctgttctaagggaagataatgacggtaccttaggagcaagtcccggc

SEQ ID NO: 558 - DNA, 488 bp, Unknown
  Ascusbbf_14793, encodes 16S rRNA
agagtttgatcatggctcagggctaacgctggcggcgcgcctaacacatgcaagtcgaacgaacccttcggggttagtggcagacgggtgagtaacgcgtggataatgtgcctctttgctggggataccgttccgaaagggacgttaataccgaatgtgctgaaagtatcgcatggtaaattcagtaaactgttagggtgaagagagcagtccgcgttctatcagcttgttggtggggtaatggcctaccaaggctacgacggataactggtctgagaggatgatcagtcacactggaactgagacacggtccagactcctacgggaggcagcagtgaggaatcttgcacaatgggcgaaagcctgatgcagcgacgccgcgtgagggatgaaggccttcgggttgtaaacctctgtcagtggggaagaagtatgacggtacccactgaggaagcttcggctaactacgtgccagcagccgcggtaat

SEQ ID NO: 559 - DNA, 490 bp, Unknown
  Ascusbbf_73647, encodes 16S rRNA
agagtttgatcatggctcaggacaaacgctggcggcgtgcttaacacatgcaagtcgtacggagctgcaggacggaatccttcgggaggaagatcggcagcttagtggcggacgggtgagtaacgcgtgagcaacctgcccataagagggggataacagttggaaacgactgctaataccgcataagaccacaacaccgcatggtggaggggtcaaagagcaatcgcttatggatgggctcgcgtcccattaggtagttggcaggataacagcctaccaagccgacgatgggtagccgacctgagagggtgatcggccacactggaactgagacacggtccagactcctacgggaggcagcagtggggaatattgggcaatgggcgcaagcctgacccagcaacgccgcgtgagtgaagaaggcctttgggttgtaaaactctgttctatgggaagaaggaagtgacggtaccataggagaaagctccgg

SEQ ID NO: 560 - DNA, 490 bp, Unknown
  Ascusbbf_1506594, encodes 16S rRNA
agagtttgatcatggctcaggacgaacgctagctacaggcttaacacatgcaagtcgaggggcagcatgacgatagtttgctattgttgatggcgaccggcgcacgggtgcgtaacacgtatccaatctacccgtcactcggggatagcctttcgaaagaaagatcaatacccgatactgttttattgccgcatggcagtgcaaccaaagattcatcggtgtcggatgaggatgcgtctgattaggtagatggcggggtaacggcccaccatgccgacgatcagtaggggttctgagaggaaggtcccccacattggaactgagacacggtccaaactcccacgggaggcagcagtgaggaatattggtcaatggacgcaagtctgaaccagccaagtagcgtgaaggacgacggccctatgggttgtaaacttcttttgtacgggaataaagtgaggcacgcgttgcctttttgcatgtaccgtacgaa

SEQ ID NO: 561 - DNA, 490 bp, Unknown
  Ascusbbf_271153, encodes 16S rRNA
agagtttgatcctggctcaggatgaacgctggcggcgtgcttaacacatgcaagtcgaacgaagcacctctcccgtggaagatgactagcttgctaagattcggacacatttgaggtgactgagtggcggacgggtgagtaacgcgtgggtaacctgccgtatacagggggacaacagttagaaatgactgctaataccgcataagcgcacagtatcgcatgatacagtgtgaaaaactccggtggtatacgatggacccgcgtctgattagctagttggtgaggtaacggcccaccaaggcgacgatcagtagccgacttgagagagtgatcggccacattgggactgagacacggcccaaactcctacgggaggcagcagtggggaatattgcacaatgggggaaaccctgatgcagcgacgccgcgtgagtgatgaagtatttcggtacgtaaagctctatcagcagggaagataatgacggtacct

SEQ ID NO: 562 - DNA, 472 bp, Unknown
  Ascusbbf_1528381, encodes 16S rRNA
agagtttgatcatggctcagagcgaacgctggcggcatgcttaacacatgcaagtcgcacgaaggtttcggccttagtggcggacgggtgagtaacgcgtaggaatctatccgtgggtggggggtaactctgggaaactggagctaataccgcatgacacctgagggtcaaaggcgcaagtcgcctgcggaagagcctgcgtttgattagcttgttggtggggtaatggcctaccaaggcgatgatcaatagctggtctgagaggatgatcaaccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacagtaccctcagaagaagcaccggctaactccgtgccagcagccgcggtaat

SEQ ID NO: 563 - DNA, 490 bp, Unknown
  Ascusbbf_98714, encodes 16S rRNA
agagtttgatcctggctcagattgaacgctagcgggatgctttacacatgcaagtcgaacggcagcgcaaagggagcttgctctcttggcggcgagtggcgaacgggtgagtaatgtatcggaacgtgcccagtagcgggggataactactcgaaagagtggctaataccgcatacgccctacgggggaaagggggggatcgcaagacctctcactattggagcggccgatatcggattagctagttggtggggtaaaggctcaccaaggcttcgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcagggaagaaaaggttctggctaataatcagaactgctgacggtacctgcagaa

SEQ ID NO: 564 - DNA, 490 bp, Unknown
  Ascusbbf_161300, encodes 16S rRNA
agagtttgatcctggctcaggacgaacgctggcggcgtgcttcatacatgcaagtcgaacgataaggtctcttcggagacacataagtggcggacgggtgagtaaaatgtagagaatctgccctagagatggggacaacagttggaaacgactgctaatacccaatatgagcgtacctgcaatggtattcttgaaaactccggtgctctaggatgagtctgcatctgattagctagtaggcggtgtaatggaccacctaggcgacgatcagtagctggtttgagaggatgatcagccacaatgggactgagacacggcccatactcctacgggaggcagcagtagggaattttgcgcaatgggggaaaccctgacgcagcaacgccgcgtgaccgatgaagcccttcggggtgtaaaggtctgtcagtggggacgaaacttgacggtacccacagaggaagcatcggctaactccgtgccagcagccgcg

SEQ ID NO: 565 - DNA, 490 bp, Unknown
  Ascusbbf_91976, encodes 16S rRNA
agagtttgatcctggctcaggacgaacgctggcggcgtgcttaacacatgcaagtcgaacgctgaagccctttcgggggtggatgagtggcgaacgggtgagtaacacgtgggtaatctgccctgcactctgggataagccttggaaacgaggtctaataccggataggacacagcaccgcatggtggtgtgtggaaagttccggcggtgtgggatgagcccgcggcctatcagcttgttggtggggtgatggcctaccaaggcgatgacgggtagccggcctgagagggtgaccggccacactgggactgagacacggcccagactcctacgggaggcagcagtggggaatcttgcgcaatgggcgaaagcctgacgcagcaacgccgcgtgggggatgacggccttcgggttgtaaacctctttcgacactgatgaagcctcactttgtgggtggggtgacggtaggtgtagaagaagcaccggctaa

SEQ ID NO: 566 - DNA, 490 bp, Unknown
  Ascusbbf_9082, encodes 16S rRNA
agagtttgatcatggctcaggatgaacgctggcggcgtgcttaacacatgcaagtcgaacggaactgcttttgaagatttccttcgggaatgaatcagttgtagtttagtggcggacgggtgagtaacgcgtgagtaacctgcccttgagagggggataacgttctgaaaaggacgctaataccgcataacattattgagtcgcatggcttgataatcaaaactccggtgctcaaggatggactcgcgtccgattagatagttggtgaggtaacggctcaccaagtcgacgatcggtagccggactgagaggttgaacggccacattgggactgagacacggcccagactcctacgggaggcagcagtgggggatattgcgcaatgggggaaaccctgacgcagcaacgccgcgtggatgaagacggttttcggattgtaaagtccttttcttagggacgaaaattgacggtacctaaggaataagctcc

SEQ ID NO: 567 - DNA, 490 bp, Unknown
  Ascusbbf_10126, encodes 16S rRNA
agagtttgatcctggctcaggatgaacgctggcggcgtgcctaacacatgcaagtcgaacggaactattttggaaactccttcgggagcggaatctttagtttagtggcggacgggtgagtaacgcgtgagcaatctgcctttaagagggggataacagtcggaaacggctgctaataccgcataaagcatcaaattcgcatgtttttgatgccaaaggagcaatccgcttttagatgagctcgcgtctgattagctggttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggccttcgggttgtaaagatctttaatcagggacgaaaaaaatgacggtacctgaagaataagctcc

SEQ ID NO: 568 - DNA, 472 bp, Unknown
  Ascusbbf_42216, encodes 16S rRNA
agagtttgatcctggctcagaacgaacgctggcggcaggcttaacacatgcaagtcgaacgcgtgtagcaatacacgagtggcgcacgggtgagtaacgcgtggatatctgccttttggttcggaataaccccgggaaactggggctaataccggatggttcctacgggataaagatttatcgccaaaagatgagtccgcgtacgattagctagttggtgaggtaatggctcaccaaggcgacgatcgttagctggtctgagaggacgatcagccacactgggactgagacacggcccagactcctacgggaggcagcagtggggaatattggacaatgggggcaaccctgatccagccatgccgcgtgagtgatgaaggccttcgggttgtaaagctcttttggcggggacgatgatgacggtacccgcagaataagccccggctaacttcgtgccagcagccgcggtaat

SEQ ID NO: 569 - DNA, 490 bp, Unknown
  Ascusbbf_1736538, encodes 16S rRNA
agagtttgatcatggctcaggatgaacgctggcggcgtgcctaacacatgcaagtcgagcgagaagctcatgaccaatacttcggttgcgtgattgagtggaaagcggcggacgggtgagtaacgcgtaggcaacctgccccttgcagagggatagcctcgggaaaccgggattaaaacctcataacgtgtctttgagacatctcatggacgccaaagatttatcggcaagggatgggcctgcgtctgattagttagttggtggggtaacggcctaccaaggcgacgatcagtagccgacctgagagggtgatcggccacattggaactgagacacggtccaaactcctacgggaggcatcagtggggaatattgcacaataggcgaaagcctgatgcagcaacgccgcgtgaatgatgaaggcccttgggtcgtaaactactgttctaagggaagataatgacggtaccttaggagcaagtcccggcta

SEQ ID NO: 570 - DNA, 490 bp, Unknown
  Ascusbbf_13648, encodes 16S rRNA
agagtttgatcatggctcagaacgaacgctggcggcgcgtcttaagcatgcaagtcggacggcaaggggagcttgctccccctagagtggcggactggtgagtaacacgtgggtgacgtaccctttagctggggatagccggtagaaataccgggtaataccgaataagcttgcccttttgatgtagggtaaggaaaggagcttcggcttcactgaaggaacggcccgcgcactattagctagttggtggggtaacggcttaccaaggcgacgatagttatccggcctaagagggtgaacggacacattgggactgagatacggcccagactcctacgggaggcagcagctaagaatattccgcaatggaggaaactctgacggagcgacgccgcgtggatgatgaaggtcggaagattgtaaaatccttttatctgtgtggaataagttttgtaggaaatgacagaatgatgactgtagcagatgaata

SEQ ID NO: 571 - DNA, 490 bp, Unknown
  Ascusbbf_1428, encodes 16S rRNA
agagtttgatcctggctcaggacgaacgctggcggcgtgcttcatacatgcaagtcgaacgagaatccggtgcttgcaccggaggaaagtggcggacgggtgagtaatgtgtagagaatctgccctgaagcgggggacaacagagggaaacttctgctaataccccatatgcgcgtagttgagatactattcgtgaaagatttatcgcttcaggatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgatcgtagaagcccttcggggtgtaaagatctgtcagtagggacgaacaatgactgtacctacagaggaagcaccggctaactccgtgccagcagccg

SEQ ID NO: 572 - DNA, 490 bp, Unknown
  Ascusbbf_1424732, encodes 16S rRNA
agagtttgatcctggctcgggacgaacgctggcggcgtgcttaatacatgcaagtcgaacggtagcaggagaaagcttgctttcttgctgacgagtggcggacgggtgagtaatgcttgggaatctggcttatggagggggataactactggaaacggtagctaataccgcgtaatctcggaagagtaaagagtgggaccgcaaggccacttgccataagatgagcccaagtgggattaggtagttggtggggtaaaggcctaccaagccgacgatctctagctggtctgagaggatggccagccacactggaactgagacacggtccagactcctacgggaggcagcagtggggaatattgcacaatgggggaaaccctgatgcagccatgccgcgtgaatgaagaaggccttcgggttgtaaagttctttcggtgatgaggaaggtatcaaatttaatagatttggtaattgacgttagtcacagaag

SEQ ID NO: 573 - DNA, 490 bp, Unknown
  Ascusbbf_162652, encodes 16S rRNA
agagtttgatcatggctcaggacgaacgctggcggcgtgcttaacacatgcaagtcgaacggggaatattttagcttgctatgatattcctagtggcgaacgggtgagtaacgcgtaggcaacctgcccttgggatggggacaacaggccgaaaggcctgctaataccgaatgaagtgagtttatcgcatgatgagcttatgaaagatggcctctacttgtaagctatcacccaaggatgggcctgcgtctgattagctagttggtggggtaaaggcctaccaaggcgacgatcagtagccggtctgagaggatgaacggccacattgggactgagacacggcccagactcctacgggaggcagcagtggggaatcttccgcaatgggcgaaagcctgacggagcaacgccgcgtgagtgaagaagggtttaggctcgtaaagctctgttgttggggacgaagtcccggaaggtgaataatctttcgggg

SEQ ID NO: 574 - DNA, 490 bp, Unknown
  Ascusbbf_284751, encodes 16S rRNA
agagtttgatcatggctcaggataaacgctggcggcgtgcttaacacatgcaagtcgaacggagtatttcttcggacgatcgaagagcttgctcggagtgagtctttgaaatacttagtggcggacgggtgagtaacgcgtgggtaacctgcctcacacagggggataacagttggaaacgactgttaataccgcataagcgcacagggccgcatggtctggtgtgaaaaactccggtggtgtgagatggacccgcgtctgattagctagttggtgaggtaacggcccaccaaggcgacgatcagtagccggcctgagagggtgtacggccacattgggactgagacacggcccaaactcctacgggaggcagcagtggggaatattgcacaatgggggaaaccctgatgcagcgacgccgcgtgagtgatgaagtatctcggtatgtaaagctctatcagcagggaagataatgacggtacctgactaa

SEQ ID NO: 575 - DNA, 480 bp, Unknown
  Ascusbbf_106489, encodes 16S rRNA
agagtttgatcctggctcagaacgaacgctggcggcaggcctaacacatgcaagtcgaacgagaagctggcttcggtcagtggagagtggcgcacgggtgagtaacgcgtgggaatttgcctttcggtacgggataacgtctggaaacgggcgctaataccgtatgatgtctacggaccaaagatttatcgccgagagaggagcccgcgtaggattaggtagttggtggggtaatggctcaccaagccgacgatccttagctgttctgagaggaagatcagccacactgggactgagacacggcccagactcctacgggaggcagcagtggggaatattggacaatgggcgcaagcctgatccagccatgccgcgtgagtgaagaaggccctagggttgtaaagctctttcgccagggaagataatgacggtacctggtaaagaagtcccggctaactccgtgccagcagccgcggtaat

SEQ ID NO: 576 - DNA, 490 bp, Unknown
  Ascusbbf_716740, encodes 16S rRNA
agagtttgatcatggctcaggatgaacgctagcggcaggcctaacacatgcaagtcgaggggcagcggggtgtagcaatacactgccggcgaccggcgcacgggtgcgtaacgcgtatgcaacctgcctccaacagggggataaccggcggaaacgccgactaataccccgtaacgcacggtctcgcatggggctgtgctgaaagccttggcggttggagatgggcatgcgtggcattaggtagttggcggggcaacggcccaccaagccatcgatgcctaggggagctgagaggctaatcccccacactggtactgagacacggaccagactcctacgggaggcagcagtgaggaatattggtcaatggccggaaggctgaaccagccatgccgcgtgagggaagaaggccctatgggttgtaaacctctttcaccggggagtaataaggttcgtgcgcggaccgatgagagtacccggggaataagca

SEQ ID NO: 577 - DNA, 490 bp, Unknown
  Ascusbbf_1886844, encodes 16S rRNA
agagtttatcatggctcaggatgaacgctggcggcgtgcataacacattcaagtcgaacggagatagaagcttcggtttttatcttagtggcggacgggtgagtaacgcgtgagcaacctgcccctgtgtgcgggataacgtttggaaacggacgctaataccgcatgatccaacgggaccgcatgatcttgttggcaaagatatattgcacagggatgggctcgcgtccgattagatagttggcggggcaacggcccaccaagtcgacgatcggtagccggactgagaggttgaacggccacattggaactgagaaacggtccagactcctacgggaggcagcagtggggaatattgggcaatgggcgaaagcctgacccagcgacgccgcgtgaaggaagacggtcctcggattgtaaacttcttttatgtaggacgaagaaagtgacggtactacatgaataagccacggctaactacgtgccagca

SEQ ID NO: 578 - DNA, 490 bp, Unknown
  Ascusbbf_336279, encodes 16S rRNA
agagtttgatcatggctcaggatgaacgctagcggcaggcttaacacatgcaagtcgaggggcagcgcgtggtagcaatatcatggcggcgaccggcgtaagggtgagtaacgcgtgagcgacgtgcccgtcacagggggacaagcgctggaaacggcgtctgataccccataggaatgtatgcttcatggtgtatgtttgaaagatttatcggtgacggatcggctcgcgtccgattaggtagacggcggggtaacggcccaccgtgccgacgatcggtaggggttctgagaggaaggtcccccacattggaactgagacacggtccagactcctacgggaggcagcagtgaggaatattggacaatggccggaaggctgatccagccatgccgcgtgcgggatgacggccctatgggttgtaaaccgcttttgtgtgggagcaataagagccacgtgtggcttgatgagagtaccatacgaataagca

SEQ ID NO: 579 - DNA, 490 bp, Unknown
  Ascusbbf_1569003, encodes 16S rRNA
agagtttgatcctggctcaggacgaacgctggcggcgtgcctaatacatgcaagtcgagcggacttgatggagtgcttgcactcctgatggttagcggcggacgggtgagtaacacgtaggcaacctgcctgtaagactgggataactaccggaaacggtagctaataccggataatttaccttgccgcatggggaggtaatgaaagacggagcaatctgtcacttacggatgggcctgcggcgcattagctagttggtgaggtaacggctcaccaaggcgacgatgcgtagccgacctgggagggtgaacggccacactgggactgagacacggcccagactcctacgggaggcagcagtagggaatcttccgcaatggacgcaagtctgacggagcaacgccgcgtgagtgaagaaggttttcggatcgtaaagctctgttgccagggaagaacgtctttgggagtaactgcccaaggagtaacggta

SEQ ID NO: 580 - DNA, 490 bp, Unknown
  Ascusbbf_1871402, encodes 16S rRNA
agagtttgatcatggctcaggatgaacgctagctacaggcttaacacatgcaagtcgaggggcagcggggatctagcttgctggatctgccggcgaccggcgcacgggtgcgtaacgcgtatccaacctgccgtgtactcggggatagccctctgaaaggaggattaatacccgatgtggttgcttggggacatcccttagcaattaaagatttatcggtacaccgatggggatgcgtatgattaggtagtaggcggggtaacggcccacctagccgacgatcattaggggttctgagaggaaggtcccccacataggaactgagacacggtcctaactcctacgggaggcagcagtgaggagtattggtcaatgggcgagagcctgaaccagccaagtagcgtgaaggaagactgccctatgggttgtaaacttcttttatgagggaataaagttcgtcacgtgtggcgttttgtatgtacctcatgaa

SEQ ID NO: 581 - DNA, 490 bp, Unknown
  Ascusbbf_1642353, encodes 16S rRNA
agagtttgatcatggctcaggatgaacgctagcagcaggcttaatacatgcaagtcgaggggtaacatgggtagcaatacctgatgacgaccggcaaacgggtgaggaacacgtacgcaactttccctaaactggtgaatagccctccgaaaggaggattaatacaccgtaacttaatgaagtggcatcactttattaatatagctccggcggtttaggatgggcgtgcgcatgattagatagttggcggggtaacggcccaccaagtctacgatcattaactggtgtgagagcacgaccagtcacacgggcactgagacacgggcccgactcctacgggaggcagcagtaaggaatattggtcaatggacgaaagtctgaaccagccatgccgcgtgaaggatgaatgccctctgggttgtaaacttcttttatctgggacgaaaaaaggtcattcttgaccacttgacggtaccagaggaataagcac

SEQ ID NO: 582 - DNA, 490 bp, Unknown
  Ascusbbf_43, encodes 16S rRNA
agagtttgatcatggctcagattgaacgctggcggcaggcctaatacatgcaagtcgaacggtaacatggaagtagcaatacttttgatgacgagtggcggacgggtgagtaatgtttgggaatctacctatcagagggggatagcaactggaaacggttgataaaaccgcgtaagctctgaggaggaaagtaatgggatcgcaagaccattagctgatagatgagcccaaatgggattagctagtaggcggggtaagagcccacctaggcgacgatctctagctggttttagcggatgatcagccacattggaactgagacacggtccaaactcctacgggaggcagcagtagggaatattgcacaatggagggaactctgatgcagccatgccgcgtgtgtgaagaaggccttcgggttgtaaagcactttagttttcgagaaaggtgtgttatccaataggtagcatatcagatgttagaaaaagaa

SEQ ID NO: 583 - DNA, 490 bp, Unknown
  Ascusbbf_21817, encodes 16S rRNA
agagtttgatcctggctcaggacgaacgctggcggcgtgcctaacacatgcaagtcgagcgagaatctttcatttgatcccttcggggtgacgacggaagaggaaagcggcggacgggtgagtaacgcgtgagtaatctgccccatggtggggaataacacagtgaaaactgtgctaatgccccataatgtatacttgttgcatagcagggataccaaagatttattgccatgggatgagctcgcgtctgattagctagttggtggggtaatggcctaccaaggcgacgatcagtagccgaactgagaggttgatcggccacattgggactgagacacggcccagactcctacgggaggcagcagtgggggatattgcacaatgggggaaaccctgatgcagcaacgccgcgtgaaggaagaaggtcttcggattgtaaacttttgtctttggggaagaattctgacggtacccaaggaggaagccacgg

SEQ ID NO: 584 - DNA, 490 bp, Unknown
  Ascusbbf_26696, encodes 16S rRNA
agagtttgatcctggctcaggatgaacgctagcgggaggcctaacacatgcaagccgaggggtatttgtagcttgctacagagagaccggcgcacgggtgcgtaacgcgtatgcaacttgccctactgaaagggatagccttttgaaaagaagattaataccttataatagtgagactggcatcagtaacacttgaaagatttatcgcagtaggataggcatgcgtcagattagctagttggtgaggtaacggctcaccaaggcgatgatctgtagggggcctgagagggtgaacccccacactggtactgagacacggaccagactcctacgggaggcagcagtgaggaatattggacaatgggtgtaagcctgatccagccatcccgcgtgaaggatgacggccttatgggttgtaaacttcttttatatggggataaaccttatcacgtgtgataagctgaaggtaccatatgaataagcaccggct

SEQ ID NO: 585 - DNA, 490 bp, Unknown
  Ascusbbf_320522, encodes 16S rRNA
agagtttgatcctggctcaggatgaacgctagcgacaggcttaacacatgcaagtcgaggggcagcatgggggtagcaatacccctgatggcgaccggcgcactggtgagtaacacgtatgcaacctgccccgggcagggggataatccggagaaatctggtctaataccccgtacgcctccttcccgcatggtagggaggtgaaaggagcgatccggcacgggatgggcatgcggcgcattagctagtcggcggggtgacggcccaccgaggcgacgatgcgtaggggttctgagaggaaggtcccccacactggtactgagacacggaccagactcctacgggaggcagcagtgaggaatattggtcaatggacggaggtctgaaccagccaagtcgcgtgagggatgacggccctacgggttgtaaacctcttttgcgggggagtaaagtgagccacgtgtggctcattgcgagtaccccgagaaaa

SEQ ID NO: 586 - DNA, 490 bp, Unknown
  Ascusbbf_98308, encodes 16S rRNA
agagtttgatcatggctcagattgaacgctggcggcatgccttacacatgcaagtcgaacggcagcataggagcttgctcctgatggcgagtggcgaacgggtgagtaatatatcggaacgtgccctagagtgggggataactagtcgaaagattagctaataccgcatacgatctacggatgaaagtgggggatcgcaagacctcatgctcatggagcggccgatatctgattagctagttggtggggtaaaagctcaccaaggcaacgatcagtagctggtctgagaggacgatcagccacattgggactgagacacggcccaaactcctacgggaggcagcagtggggaattttggacaatgggggaaaccctgatccagcaatgccgcgtgagtgaagaaggccttcgggttgtaaagctcttttgtcagggaagaaacggtatcgaataatacacgatactaatgacggtacctgaagaataagc

SEQ ID NO: 587 - DNA, 490 bp, Unknown
  Ascusbbf_151693, encodes 16S rRNA
agagtttgatcatggctcaggacgaacgctggcggcgcgcctaacacatgcaagtcgaacggagctgttttctctgaagttttcggatggaagagagttcagcttagtggcgaacgggtgagtaacacgtgagcaacctgcctttcagtgggggacaacatttggaaacgaatgctaataccgcataagaccacagtgtcgcatggcacaggggtcaaaggatttatccgctgaaagatgggctcgcgtccgattagctagatggtgaggtaacggcccaccatggcgacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgtcccaggggacgataatgacggtaccctgggaggaagcaccg

SEQ ID NO: 588 - DNA, 490 bp, Unknown
  Ascusbbf_53646, encodes 16S rRNA
agagtttgatcatggctcaggacgaacgctggcggcgtgcttaacacatgcaagtcgaacggtaaggcccttcggggtacacgagtggcgaacgggtgagtaacacgtgagtaacctgccctggactctgggataagcattcgaaagggtgtctaatactggatatgacctgtgaccgcatggttgtgggtgtaaaggtttttctggtctgggatgggctcgcggcctatcagcttgttggtggggtgatggcctaccaaggcgtcgacgggtagccggcctgagagggcgaccggccacactgggactgagatacggcccagactcctacgggaggcagcagtggggaatattgcgcaatgggcggaagcctgacgcagcaacgccgcgtgcgggatgacggccttcgggttgtaaaccgctttcatccatgacgaagcttttgtgacggtagtgggagaagaagcaccggccaactacgtgccagcag

SEQ ID NO: 589 - DNA, 490 bp, Unknown
  Ascusbbf_193081, encodes 16S rRNA
agagtttgatcatggctcaggatgaacgctagcgggaggcctaacacatgcaagccgagcggtatagtttcttcggaaactagagagcggcgtacgggtgcgtaacacgtgtgcaacctgcctttatctgggagatagccctccgaaagggggattaatattccataatatattgattggcatcgattgatattgaaagctccggcggatagagatgggcacgcgcaagattagatagttggtgaggtaacggctcaccaagtctacgatctttagggggcctgagagggtgatcccccacactggtactgagacacggaccagactcctacgggaggcagcagtgaggaatattggacaatgggtgcaagcctgatccagccatcccgcgtgaaggattaaggtcctatggattgtaaacttcttttatacagggataaacctctcctcgtgaggagagctgaaggtactgtatgaataagcaccggct

SEQ ID NO: 590 - DNA, 490 bp, Unknown
  Ascusbbf_64561, encodes 16S rRNA
agagtttgatcctggctcagattgaacgctggcggcaggcttaacacatgcaagtcgaacggtaacggggagggagtttactttctctgctgacgagtggcggacgggtgagtaaagcttgggaatctggcgaatggagggggatagccacgggaaactgtgggtaataccgcgtaatgtctaaggactaaaggggtgggactgagaggccacctgccatttgatgagcccaagtgggattaggtagttggtgaggtaagggctcaccaagctgacgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattaattgattgacgataatcacag

SEQ ID NO: 591 - DNA, 490 bp, Unknown
  Ascusbbf_121941, encodes 16S rRNA
agagtttgatcctggctcaggatgaacgctagctacaggcttaacacatgcaagtcgcggggcagcatgccttgtcctcggacgaggtgatggcgaccggcgcacgggtgagtaacgcgtatccaaccttcccgcgagcggggtatagcccggcgaaagtcggattaatcccccatacctcccatgacgtcctcggagtgggagcaaaggccttggccgcttgcggatggggatgcgtccgattaggaagtaggcggggtaacggcccacctatccttcgatcggtaggggttctgagaggaaggtcccccacactggtactgagacacggaccagactcctacgggaggcagcagtgaggaatattggtcaatgggcgcaggcctgaaccagccaagtagcgtgcaggacgacggccctacgggttgtaaactgcttttatacgggaataaagtccgccactcgtggcggtttgcatgtaccgttatga

SEQ ID NO: 592 - DNA, 490 bp, Unknown
  Ascusbbf_356351, encodes 16S rRNA
agagtttgatcctggctcaggatgaacgctggcggcgcgcttaacacatgcaagtcggacgcgaaacgccccctcgggggcggagtagagtggcgaacgggtgagtaacacgtgggcgacctgcccccctccccgggatagccgggcgaaggcccgggtaataccggatgcccccgcggggccgcatggcccggcggggaaagcctcgtgcggagggggatgggcccgcgtcctattagctagttggcggggcaacggcccaccaaggcgacgataggtagccgggctgagaggccgatcggccacattgggactgagacacggcccagactcctacgggaggcagcagtggggaatattgcgcaatgggcgaaagcctgacgcagcgacgccgcgtgcgggatggaggccctcgggtcgtaaaccgctttcggcagggacgattgtgacggtacctgcataagaagccccggctaaatacgtgccagca

SEQ ID NO: 593 - DNA, 490 bp, Unknown
  Ascusbbf_2266, encodes 16S rRNA
agagtttgatcctggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaag

SEQ ID NO: 594 - DNA, 490 bp, Unknown
  Ascusbbf_6163, encodes 16S rRNA
agagtttgatcctggctcagaacgaacgctggcggcaggcttaacacatgcaagttgagcgggattttcaggtagcttgctatttgaaatgagagcagcgcactggtgagtaacacgtgggaacataccttttggtgggggacaacagttggaaacgactgctaataccgcatacgccctgagggggaaaggagagatttgccgaaagattggcccgcggaagattaggtagtaggtggggtaatggcctacctagccgacgatctatagctggtctgagaggacgatcagccacattggaactgagacacggtccagactcctacgggaggcagcagtgaggaatattgggcaatggagggaactctgacccagccatgccgcgtgagtgaagaaggttttcggattgtaaagctctttcagatgggaagatgatgacggtaccatcagaagaagcaccggctaacttcgtgccagcagccgcggtaat

SEQ ID NO: 595 - DNA, 490 bp, Unknown
  Ascusbbf_12373, encodes 16S rRNA
agagtttgatcctggctcaggatgaacgctagctacaggcttaacacatgcaagtcgaggggcagcatgaagtcagcttgctgactttgatggcgaccggcgcacgggtgcgtaacgcgtatccaaccttcccgcgagtcaggcacagcccggcgaaagtcggattaatacctgatggactcctttgacggcatcagagaaggagtaaagaattttttcgcttgcggatggggatgcgtaggattagcttgcaggcggggtaacggcccacctgggcgacgatccttaggggttctgagaggaaggtcccccacactggtactgagacacggaccagactcctacgggaggcagcagtgaggaatattggtcaatgggcgagagcctgaaccagccaagtagcgtgcaggacgacggccctacgggttgtaaactgcttttatgcggggataaacgaggggacgcgttccccttttgcaggtaccgcatg

SEQ ID NO: 596 - DNA, 487 bp, Unknown
  Ascusbbf_218893, encodes 16S rRNA
agagtttgatcatggctcaggatgaacgctggcggcgtgcctaacacatgcaagtcgagcgaacccttcggggtgagcggcggacgggtgagtaacgcgtgggtaacctgccctatacacacggataacgtaccgaaaggtacgctaatacgagataaaatatttttatcgcatggtaaaaatatcaaagcttttgcggtataggatggacccgcgtctgattagctagttggtaaggtaatggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaat

SEQ ID NO: 597 - DNA, 490 bp, Unknown
  Ascusbbf_12424, encodes 16S rRNA
agagtttgatcctggctcaggatgaacgctagctacaggcttaacacatgcaagtcgaggggcatcatgaagtttgcttgcaagctttgatggcgaccggcgcacgggtgcgtaacgcgtatccaatctaccagttactcgggtatagccttgcgaaagtaagattaatccccgatgagtatagttactgcatggtgattatataaaagatttatcggtagctgatgaggatgcgtaggattagttagtcggcggggtaacggcccaccgaggctacgatccttaggggttctgagaggaaggtcccccacactggtactgagacacggaccagactcctacgggaggcagcagtgaggaatattggtcaatggccgagaggctgaaccagccaagtagcgtgcaggacgactgccttacaggttgtaaactgcttttatgcaagagtaaagtgagctacgtgtagtttattgcaagtattgcatgaata

SEQ ID NO: 598 - DNA, 490 bp, Unknown
  Ascusbbf_29656, encodes 16S rRNA
agagtttgatcctggctcagaatgaacgctggcggcatggattaggcatgcaagtcggacggggtgcagcgatgcacccagtggcgaaagggtgcgcaacgcgtggggaacctgcccccggatccgggacaagcgctggaaacggcgtctgatacgggatgcggaggggggccgcatggccccccctccaaagattcatcgtccggggagggccccgcgtcccattagctagttggcggggtgacggcccaccaaggctgcgacgggtaggtggtctgagaggatggtcacccacactgggactgagacactgcccagactcctacgggaggctgcagtcgagaatcttccgcaatgggcgaaagcctgacggagcgatgccgcgtgggggacggaggccttcgggtcgtgaacccctgtcacccgggacgaatcaactgacggtaccgggagaggaagccacggctaactacgtgccagcagccgcggt

SEQ ID NO: 599 - DNA, 470 bp, Unknown
  Ascusbbf_9712, encodes 16S rRNA
agagtttgatcatggctcagaacgaacgctggcggcatgcttaacacatgcaagtcgaacgatctcttcggagatagtggcggacgggtgagtaacgcgtgggaacctgccccgaggtacggaataactcatggaaacgtgagctaataccgtatgtgacctgagggtgaaagatttatcgccttgggaggggcccgcgtcggattaggtagttggtggggtaatggcctaccaagcctgcgatccgtagctggtctgagaggatgatcagccacactggaacttagacacggtccagactcctacgggaggcagcagtggggaatattggacaatgggggcaaccctgatccagcaatgccgcgtgcgtgatgaaggccttagggttgtaaagcgctttcggcggggaagatgatgacggtacccgcagaagaagccccggctaactccgtgccagcagccgcggtaat

SEQ ID NO: 600 - DNA, 490 bp, Unknown
  Ascusbbf_1580627, encodes 16S rRNA
agagtttgatcatggctcaggacgaacgctggcggcgtgcttaacacatgcaagtcgaacggagttaagcgctggtttgatgctagcttgctagtggatttccttgcttaacttagtggcggacgggtgagtaacgcgtgagtaacctgcctctcagtgggaaataacgccctgaaaagagcgctaataccgcataacacatattgaccgcatgatcagtatgtcaaagatttatcgctgagagatggactcgcgtccgattagctagttggtgaggtaacggcccaccaaggcgacgatcggtagccggactgagaggttgaacggccacattgggactgagacacggcccagactcctacgggaggcagcagtgggggatattgcgcaatgggggaaaccctgacgcagcaacgccgcgtggaggatgacggttttcggattgtaaactccttgtataagggacgaactaagacggtaccttatgaat

SEQ ID NO: 601 - DNA, 490 bp, Unknown
  Ascusbbf_26134, encodes 16S rRNA
agagtttgatcatggctcaggatgaacgctagcgagaggcctaacacatgcaagtcgaggggtaacaggggagcttgctcccgctgacgaccggcgcacgggtgagtaacgcgtatgcaacctgcccgccacagggggatagccttccgaaagggagattaataccgcataagaccacgcctgggcatccaggaggggtaaaatattcataggtggcggctgggcatgcgtgacattagctagttggcggggcaacggcccaccaaggcgacgatgtctaggggaactgagaggtcgatcccccacactggtactgagacacggaccagactcctacgggaggcagcagtgaggaatattggtcaatggagggaactctgaaccagccatctcgcgtgaaggactacggccctacgggtcttaaacttcttttatagggggataaagtcgcatacgagtatgtgattgcaggtaccctatgaataagcat

SEQ ID NO: 602 - DNA, 490 bp, Unknown
  Ascusbbf_29926, encodes 16S rRNA
agagtttgatcatggctcagaacgaacgctggcggcgcgtcttaagcatgcaagtcgaacggcaagattggtgcttgcaccgatcctagagtggcggactggtgagtaacacgtgggtgacgtacccttttgttggggatagccggtagaaataccggataataccgaataatcttggcattttagaggatgttaaggaaaggagcttcggcttcgcagatggaacggcccgcgcactattagctagttggtgaggtaacggcccaccaaggcaacgatagttatccggcctaagagggtgaacggacacattgggactgagatacggcccagactcctacgggaggcagcagctaagaatattccgcaatggaggaaactctgacggagcgacgccgcgtggatgatgaaggtcggaagattgtaaaatccttttatttgtgtggaataattcagataggaaatgatctggagatgactgtagcaaatg

SEQ ID NO: 603 - DNA, 490 bp, Unknown
  Ascusbbf_1783152, encodes 16S rRNA
agagtttgatcatggctcagaatgaacgctggcggcatggattaggcatgcaagtcgaacgaacttaattacttgcttgcaagtaaagaggttagtggcggactggtgagtaacacgtaagaaatctgcctattagtggggaataacagtgagaaatcattgctaataccgcatatgccataagaatcgcatgattctagtgggaaaggagcaattcgctaatagatgagcttgcgtctgattagctagttggtggggtaaaggcctaccaaggcgacgatcagtagccggactgagaggttgaacggccacattgggactgagatacggcccagactcctacgggaggcagcagtcgggaatattgcgcaatggaggaaactctgacgcagtgacgccgcgtataggaagaaggttttcggattgtaaactattgtctactgggaagatacaagactgtaccagtaaagaaagctccggctaactacgt

SEQ ID NO: 604 - DNA, 490 bp, Unknown
  Ascusbbf_47579, encodes 16S rRNA
agagtttgatcatggctcaggatgaacgctggcggcgtgcataacacattcaagtcgaacggacgtattgacttcggttgatacgttagtggcggacgggtgagtaacgcgtgagcaacctgcccctgtgtgcgggataacgtccggaaacggacgctaataccgcatgatccaacggaaccgcatggttctgttggcaaagatttattgcacggggatgggctcgcgtccgattagatagttggcggtgcaacggaccaccaagtcgacgatcggtagccggactgagaggttgaacggccacattggaactgagaaacggtccagactcctacgggaggcagcagtggggaatattgggcaatgggcgaaagcctgacccagcgacgccgcgtgaaggaagacggtcctcggattgtaaacttcttttatgtaggacgaagaaagtgacggtactacatgaataagccacggctaactacgtgccagc

SEQ ID NO: 605 - DNA, 490 bp, Unknown
  Ascusbbf_42956, encodes 16S rRNA
agagtttgatcatggctcaggacgaacgctggcggcgtgcttcacacatgcaagtcgaacggaaaggcaccttcgggtgtactcgagtggcgaacgggtgagtaacacgtgagtaatctgcctttagctttgggataagcctcggaaacggggtctaatactggatatgactcttcctcgcatggggttgggtggaaagtttttcggctaaagatgggctcgcggtctatcagcttgttggtgaggtaatggctcaccaaggctttgacggatagccggcctgagagggcgaccggccacactgggactgagacacggcccagactcctacgggaggcagcagtggggaatattgcgcaatgggcgaaagcctgacgcagcgacgccgcgtgagggatgacggccttcgggttgtaaacctctttcagcagggacgaagtgcgaatgacggtacctgcagaagaagcgccggctaactacgtgccagcag

SEQ ID NO: 606 - DNA, 490 bp, Unknown
  Ascusbbf_17023, encodes 16S rRNA
agagtttgatcatggctcaggatgaacgctggcggcgtgcctaatacatgcaagtcgaacgggagtgcttgcactccagtggcgaacgggtgagtaacacgtaggtaatctggccttaagacgaggatagcttctagaaatggaagataaaactggataggacattataaagcacatgcttaaatgtttaaaagagcaatctacttaagggggagcctgcggtgcattagctagatggcggggtaacggcccaccatggcgatgatgcatagccggtctgagaggacgaacggccacattgggactgagaacggcccaaactcctacgggaggcagcagtagggaattttcggcaatgggcggaagcctgaccgagcaacgccgcgtgattgaagaagtatttcggtatgtaaaaatcttttatttgggacgaaaaaacaaattgacggtaccaaatgaataagccccggctaactacgtgccagcagcc

SEQ ID NO: 607 - DNA, 490 bp, Unknown
  Ascusbbf_24804, encodes 16S rRNA
agagtttgatcatggctcagaataaacgctggcggcgtgcctaacacatgcaagtcgaacggatgaagggagcaatccccgattcagtggcggacgggttagtaacgcgtgaggaacctgcctttcagagggggatagcagttggaaacgactgataataccgcataagaccacagcgccgcatgacgcaggggtcaaaggagcaatccgctgaaagatggactcgcgtccgattagatagttggtgaggtaacggcccaccaagtcgacgatcggtagccgggctgagaggctggacggcaacattgggactgagacacggcccagactcctacgggaggcagcagtgagggatattgcacaatggacgaaagtctgatgcagcaacgccgcgtgagggacgacggttttcggattgtaaacctctgtccttggtgaagataatgacggtagccaaggaggaagcaacggctaattacgtgccagcagc

SEQ ID NO: 608 - DNA, 490 bp, Unknown
  Ascusbbf_47093, encodes 16S rRNA
agagtttgatcctggctcagaatgaacgctggcggcgtgcctaacacatgcaagtcgagcgagaaagctccttcgggagttagtaaagcggcggacgggtgagtaacgcgtgagaatctgccctttagtggagaataccttcgagaaatcgaagttaatactgcatacgttccttcgggaagaaagatggcctctttgctgtcgctaaaggatgagcttgcgtactattagcttgttggtggggtaatggcctaccaaggcgatgatggttagccggcctgagagggtgtacggccacactggaacttagacacggtccagactcctacgggaggcagcagtgaggaatattgcgcaatgggcgaaagcctgacgcagcgacgccgcgtggaggatgaaggttttcggatcgtaaactcctgttaagtgggaagaaagtcctagagttaatacctctaggctatgacagtaccgctagagaaagcaccgg

SEQ ID NO: 609 - DNA, 490 bp, Unknown
  Ascusbbf_374719, encodes 16S rRNA
agagtttgatcatggctcaggatgaacgctagcggcaggcttaacacatgcaagtcgaggggcagcgcggtgtagcaatacactggcggcgaccggcggaagggtgcgtaacgcgtgagcgacatgcccgtgacagggggataacagatggaaacgtctcctaataccccataggatcgcgtgctacatggcacaggattgaaaggtgagaaccggtcacggattggctcgcgtcccatcaggtagacggcggggcagcggcccgccgtgccgacgacgggtaggggctctgagaggagtgacccccacaatggaactgagacacggtccatactcctacgggaggcagcagtgaggaatattggtcaatgggcggaagcctgaaccagccatgccgcgtgcgggaggacggccctacgggttgtaaaccgcttttgagtgcgagcaataaggttcacgcgtggaccgatgagagtagcattcgaataag

SEQ ID NO: 610 - DNA, 490 bp, Unknown
  Ascusbbf_116634, encodes 16S rRNA
agagtttgatcctggctcaggacgaacgctggcggcgtgcctaacacatgcaagtcgaacggacttagctgagtgcttgcactcggcgacagttagtggcggacgggtgagtaacgcgtgaataacctgcccaacagagggggataacgtttggaaacgaacgctaataccgcataacattgtggcatcgcatggtgcaacaatcaaaggagcaatccgctgatggatggattcgcgtccgattagctagttggtgagataacagctcaccaaggcgacgatcggtagccggactgagaggttgaacggccacattgggactgagacacggcccagactcctacgggaggcagcagtgggggatattgcacaatgggggaaaccctgatgcagcaacgccgcgtgagggaagaaggttttcggattgtaaacctctgtcctaggtgaagataatgacggtagcctaggaggaagctccggctaactacgt

SEQ ID NO: 611 - DNA, 490 bp, Unknown
  Ascusbbf_109100, encodes 16S rRNA
agagtttgatcatggctcaggatgaacgctggcggcgtgcctaacacatgcaagtcgaacggaccttatctgaacagagacttcggttgaagagatcataaggttagtggcggacgggtgagtaacgcgtggagaacctgccctgtactgggggataacagtgagaaatcactgctaataccgcataagcgcacggtaccgcatggtacagtgtgaaaaactccggtggtacaggatggctccgcgttggattagccagttggcggggtaacggcccaccaaagcgacgatccatagccggcctgagagggtgaacggccacattgggactgagacacggcccagactcctacgggaggcagcagtggggaatattgcacaatggggggaaccctgatgcagcgacgccgcgtgaaggaagaagtatctcggtatgtaaacttctatcagcagggaagagattgacggtacctgaccaagaagccccggc

SEQ ID NO: 612 - DNA, 490 bp, Unknown
  Ascusbbf_118865, encodes 16S rRNA
agagtttgatcatggctcagaatgaacgttggcggcatggattaggcatgcaagtcgcacgaaaagtggagtagcttgctacgaaactgaaagtggcgaaagggagagtaacgcgtggttacataccttcaggaccaggatagcgtcgggaaactggcggtaatactggatgatatctacggatcaaatggtgtgattccgcctggagattggactgcgtactattagcttgttggcggggtaatggcccaccaaggctgcgatggttaccgggtgtgagagcatggcccggctcactgggactgagacactgcccagacatctacggatggctgcagtcgagaatcttcggcaatgggcgaaagcctgaccgagcgatgccgcgtgcgggatgaaggccctcgggttgtaaaccgctgtcagttggaaggaaatattatagggttatctctatagtttgaccgatcttcagaggaaggacgggctaagt

SEQ ID NO: 613 - DNA, 490 bp, Unknown
  Ascusbbf_105010, encodes 16S rRNA
agagtttgatcctggctcaggacgaacgctggcggcgtgcctaacacatgcaagtcgaacgaagctcttttcaatgcgattcgtcaagttgaaaggatgacttagtggcgaacgggtgagtaacgcgtgagcaacctgccccggagtgggggacaacagttggaaacgactgctaataccgcatgacatgttcggatggcatcatctgaacatcaaagatttattgctctgggatgggctcgcgtctgattagatagttggcggggtaacggcccaccaagtcgacgatcagtagccggactgagaggttgaacggccacattgggactgagatacggcccagactcctacgggaggcagcagtggggaatattgggcaatgggggaaaccctgacccagcaacgccgcgtgaaggaagaaggccttcgggttgtaaacttcttttgttgaggacgaagaaagtgacggtactcgacgaataagctacgg

SEQ ID NO: 614 - DNA, 490 bp, Unknown
  Ascusbbf_86337, encodes 16S rRNA
agagtttgatcatggctcaggatgaacgctggcggcgtgcctaatacatgcaagtcgaacgaggtagcaatacctagtggcgaacgggtgagtaacacgtaggtaacctgcccttaagcttgggatacccagaggaaactttggctaataccggataacaactgagatcgcatgatcttagcttgaaaggccctttcgggtcacttaaggatggacctgcggcgcattagctagttggtgagataacagcccaccaaggcgaggatgcgtagccgaactgagaggttgatcggccacattggaactgagacacggtccaaactcctacgggaggcagcagtaaggagttttcggcaatgggggaaaccctgaccgagcaacgccgcgtgagcgatgacggccctatgggttgtaaagctctgttgtaagccaagaatggtagtgctaggaaatgagcattacttgacggtagcttaccagaaagccacgg

SEQ ID NO: 615 - DNA, 490 bp, Unknown
  Ascusbbf_131018, encodes 16S rRNA
agagtttgatcatggctcaggatgaacgctggcggcgtgcttaacacatgcaagtcgaacggagttgttacgctgatgaagcttcggcagaatcttgtagcaacttagtggcggacgggtgagtaacgcgtgggtaacctgccttataccgggggatagcatcgggaaactgatgataataccgcataagcgcacgagagggcatccttttgtgtgaaaaactccggtggtataagatggacccgcgtctgattagttagttggcggggtaacggcccaccaagacgacgatcagtagccggcctgagagggtgaacggccacattgggactgagacacggcccaaactcctacgggaggcagcagtggggaatattgcacaatgggcgaaagcctgatgcagcgacgccgcgtgagtgaagaagtatttcggtatgtaaagctctatcagtagggaagaagacaatgacggtacctaactaagaagccc

SEQ ID NO: 616 - DNA, 490 bp, Unknown
  Ascusbbf_197966, encodes 16S rRNA
agagtttgatcatggctcaggatgaacgctggcggcacgcttaacacatgcaagtcgagcggaggcggagacttcggtttccaactcagcggcggacgggtgaggaacgcgtgggtaatctgccccataccgggggataactcagagaaatctgagctaaaaccgcataagcccacggagtcgcatggctctgagggaaaaactccggtggtatgggatgagcccgcgtccgattagccagttggcgaggtaaaagctcaccaaagcgacgatcggtagccggtctgagaggatggacggccacattgggactgagacacggcccagactcctacgggaggcagcagtggggaatattgcacaatgggggaaaccctgatgcagcgatgccgcgtgaaggaagacggttttcggattgtaaacttctatcagcgaggaagagaacggacagtactcgaacaagcagccccggctaactacgtgccagcag

SEQ ID NO: 617 - DNA, 490 bp, Unknown
  Ascusbbf_1861042, encodes 16S rRNA
agagtttgatcctggctcaggatgaacgctggcggcgtgcctaacacatgcaagtcgagcgagaagcctctttgaagatacttcggttgattctgtgaggcggaaagcggcggacgggtgagtaacgcgtaggcaacctgccccatgcagagggatagcctcgggaaaccgggattaaaacctcataatacccgacctggacatccaggatgggtcaaagatttatcggcaagggatgggcctgcgtctgattagttagttggtgaggtaacggctcaccaaggcgacgatcagtagccgacctgagagggtgatcggccacattggaactgagacacggtccaaactcctacgggaggcagcagtggggaatattgcacaatgggggaaaccctgatgcagcaacgccgcgtgaaggatgaaggcccttgggtcgtaaacttctgttctaagggaaggtagtgacggtaccttaggagcaagtcccggc

SEQ ID NO: 618 - DNA, 490 bp, Unknown
  Ascusbbf_730611, encodes 16S rRNA
agagtttgatcctggctcaggacgaacgcttgcggcgtgcctaagaaatgcaagtcgagcgaagtccagggtgcttgcacccgaagacttagcggcgaacggtcgcgtaacacgtaagcaacctgccctaaagacggggatagcccaccgaaaggtggattaataccggatgtgaacacttattcgcatgtataagtgtttaaagcagcaatgcgctttaggatgggcttgcggcctatcagttagttggtgtggtaacggctcaccaagacgacgacgggtagccggtctgagaggatgaccggccggatcgggactgagatacggcccggactcctacggggggcagcaattaggaatcttgcgcaatgggcgaaagcctgacgcagcgacgccgcgtgactgatgaagtccttcgggatgtaaaagtcttttctcggtgaagaaggatgtgactgtagccgaggaataagctccggctaactacgtg

SEQ ID NO: 619 - DNA, 490 bp, Unknown
  Ascusbbf_363552, encodes 16S rRNA
agagtttgatcctggctcaggacgaacgctggcggcgtgcctaacacatgcaagtcgaacgggacttaatggaatgagacttcggtcaaaggaagttaagtttagtggcggacgggtgagtaacgcgtgagcaacctgcctttcagagggggacaacagttggaaacgactgctaataccgcataacgtatacttagggcatccttggtataccaaagatttatcgctgaaagatgggctcgcgtctgattagatagttggcggggtaacggcccaccaagtcgacgatcagtagccggactgagaggttgaacggccacattgggactgagatacggcccagactcctacgggaggcagcagtggggaatattggtcaatgggggcaaccctgaaccagcaacgccgcgtgaaggaagaaggctttcgggttgtaaacttcttttgccggggacgaaacaaatgacggtacccggcgaataagccacgg

SEQ ID NO: 620 - DNA, 490 bp, Unknown
  Ascusbbf_712024, encodes 16S rRNA
agagtttgatcatggctcaggacgaacgctggcggcgtgcttaacacatgcaagtcgagcggagacacaggacggaaagcttcggccggaagacctgtgttttagcggcggacgggtgagtaacgcgtgagcaacctgtccttcacagggggataagataccgaaaggtgttctaataccgcataagaccacagcatcacatgaagcaggggtcaaaggaggaatccggtgaagggtgggctcgcgtccgattagatagttggtgaggtaacggcccaccaagtcaacgatcggtagccgacctgagagggtgatcggccacattgggactgagacacggcccagactcctacgggaggcagcagtgggaatattgggcaatgggggaaaccctgacccagcaacgccgcgtggaggaagaaggtcttcggatcgtaaactcctgtccttcaagacgaggaagagacggtaatggaggaggaagccccgg

SEQ ID NO: 621 - DNA, 490 bp, Unknown
  Ascusbbf_302475, encodes 16S rRNA
agagtttgatcatggctcaggatgaacgctggcggcgtgcttaacacatgcaagtcgaacgaagcatcctcatccgtggaagggagtagcttgctacgaacggacacacccgaggatgacttagtggcggacgggtgagtaacgcgtgggtaacctgccccatagagggggacaacagttggaaacgactgctaataccgcatagtaatgtagatccgcatgcttctacattgaaagcttttgcgctatgggatggacccgcgtctgattagctagttggtgaggtaacggcccaccaaggcaacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcaggaaagataatgacggtacct

SEQ ID NO: 622 - DNA, 490 bp, Unknown
  Ascusbbf_1839671, encodes 16S rRNA
agagtttgatcatggctcaggatgaacgctggcggcgtgcctaacacattcaagtcgaacggagaagaaggcttcggccttcggatcagtggcggacgggtgagtaacgcgtgagtaatctgcctttgattggggaataacacagggaaacttgtgctaataccgcataacacagcgacaccgcatgatgatgctgtcaaagatttatcgatcaaagatgagctcgcgtccgattagatagttggtgaggtaaaggcttaccaagtctgcgatcggtagccggactgagaggttgaacggccacattggaactgagatacggtccagactcctacgggaggcagcagtggggaatattgggcaatgggcgaaagcctgacccagcgacgccgcgtgagggaagaaggtcttcggattgtaaacctcttttatagggaacgaaggaagtgacggtaccctaagaaaaagccacggctaactacgtgccagc

SEQ ID NO: 623 - DNA, 490 bp, Unknown
  Ascusbbf_18211, encodes 16S rRNA
agagtttgatcatggctcaggacgaacgctggcggcgtgcttaacacatgcaagtcgagcggaaaggccccttcgggggtactcgagcggcgaacgggtgagtaacacgtgagcaacctgcccctgactctgggataagcccgggaaactgggtctaataccggatatgaccactccaggcatctggtggtggtggaaagtttttcggttggggatgggctcgcggcctatcagcttgttggtggggtgatggcctaccaaggcgacgacgggtaaccggcctgagagggcgaccggtcacactgggactgagacacggcccagactcctacgggaggcagcagtgggaatattgcgcaatgggcggaagcctgacgcagcgacgccgcgtgggggatgacggccttcgggttgtaaacccctttcagcagggacgaagctaacgtgacggtacctgcagaagaagcgccggctaactacgtgccagcag

SEQ ID NO: 624 - DNA, 490 bp, Unknown
  Ascusbbf_187008, encodes 16S rRNA
agagtttgatcctggctcaggacgaacgctggcggcgtgcctaatacatgcaagtcgaacgcactgacagagaaacttgtttctctcgacgtgagtggcgcacgggtgagtaacacgtgggaaacctacccttcagcgggggataaccgtcggaaacgatggctaataccgcataggtcttttaaccgcctggttgaaagaggaaagacggcttcggctgtcactgaaggatggtcccgcggtgcattagctagttggtaaggtaacggcttaccaaggcgatgatgcatagccgacctgagagggtgatcggccacattgggactgagacacggcccaaactcctacgggaggcagcagtagggaatcttccgcaatggacgcaagtctgacggagcaacgccgcgtgtgtgaagaaggtcttcggatcgtaaagcactgttattagagaagaacaaccggtagagtaactgttaccggcttgacggta

SEQ ID NO: 625 - DNA, 490 bp, Unknown
  Ascusbbf_76022, encodes 16S rRNA
agagtttgatcatggctcaggatgaacgctggcggcgtgcctaacacatgcaagtcgagcgagaaacctctttgaagatacttcggttgattctgtgaggcggaaagcggcggacgggtgagtaacgcgtaggcaacctgcccctggcagagggatagcctcgggaaaccgggattaaaacctcataatgcgagagaaagacatctttcattcgccaaagatttatcggctggggatgggcctgcgtctgattagttagttggtggggtaacggcctaccaaggcgacgatcagtagccgacctgagagggtgatcggccacattggaactgagacacggtccaaactcctacgggaggcagcagtggggagtattgcacaatgggggaaaccctgatgcagcaacgccgcgtgaaggatgaaggcctttgggtcgtaaacttctgttctaagggaagatcgtgacggtaccttaggagcaagtcccggc

SEQ ID NO: 626 - DNA, 490 bp, Unknown
  Ascusbbf_130093, encodes 16S rRNA
agagtttgatcctggctcaggacgaacgctggcggcatgcctaacacatgcaagtcgaacggtaaggccctcttcggagggtacacgagtggcgaacgggtgagtaacacgtgggtaacctgcccttcactgggggataaccgagggaaacctcggctaataccgcatgatgtgcgcattcataagtttgcgtaccaaaactccggtggtgaaggatgggcccgcgtcggattagcttgttggtggggtaaaggcctaccaaggcgacgatccgtagctggtctgagaggacgatcagccacactgggactgagacacggcccagactcctacgggaggcagcagtggggaatcttgcgcaatgggcgaaagcctgacgcagcaatgccgcgtgagggaagacggtcttaggattgtaaacctctttcagcagggacgaaaacagacggtacctgcagaagaagccccggctaactacgtgccagcagcc

SEQ ID NO: 627 - DNA, 490 bp, Unknown
  Ascusbbf_29439, encodes 16S rRNA
agagtttgatcatggctcaggatgaacgctggcggcgtgcctaacacatgcaagtcgagcggagataagcgccgaaggaggtttcggccgaattcatgcttatcttagcggcggatgggtgaggaacgcgtggagaacctgcccttcacagggggataacagctggaaacgactgttaataccgcatatgctcacagcaccgcatggtgcagggaggaaagccgagacggtgaaggatggctccgcgtcggattagccagttggcggggtaacggcccaccaaagcgatgatccgtagccggcctgagagggcgaccggccacattgggactgagacacggcccaaactcctacgggaggcagcagtgggggatattgcacaatgggggaaaccctgatgcagcgacgccgcgtgaaggaggaagtgcttcggcatgtaaacttctatcagcagggaagaagatgacggtacctgcacaagaagccccgg

SEQ ID NO: 628 - DNA, 490 bp, Unknown
  Ascusbbf_71721, encodes 16S rRNA
agagtttgatcctggctcaggatgaacgctagcgggaggcttaacacatgcaagccgaggggtatagttctttcgggaactagagaccggcgcacgggtgcgtaacgcgtatgcaacttgccctactgaaaaggatagcccttcgaaaggaggattaatactttataacagatttaatggcatcattagattttgaaagatttatcgcagtaggataggcatgcgtaagattagttagttggtgaggtaacggctcaccaagacgatgatctttagggggcctgagagggtgaacccccacactggtactgagacacggaccagactcctacgggaggcagcagtgaggaatattggacaatgggtggaagcctgatccagccatcccgcgtgtaggatgacggccttatgggttgtaaactacttttatctggggataaacctacttacgtgtaagtagctgaaggtaccagaagaataagcaccggct

SEQ ID NO: 629 - DNA, 490 bp, Unknown
  Ascusbbf_8735, encodes 16S rRNA
agagtttgatcatggctcaggacgaacgctggcggcgtgcttaacacatgcaagtcgaacgaagcttgattaatgatctcttcggagtgaattatgatatgactgagtggcggacgggtgagtaacgcgtgagtaacctgcccttcggagggggatagtgtttggaaacgaacagtaataccgcataatgtgcgaagaaggcatcttttttgtaccaaagatttatcgccgaaggatggactcgcgtctgattagatagttggtgaggtaacggctcaccaagtcgacgatcagtagccggactgagaggttgaacggccacattgggactgagacacggcccagactcctacgggaggcagcagtggggaatattgcacaatgggggaaaccctgatgcagcaacgccgcgtggaggaagacggttttcggattgtaaactcctgttcttagggaagaagacagtgacggtacctaaggagcaagccac

SEQ ID NO: 630 - DNA, 490 bp, Unknown
  Ascusbbf_6705, encodes 16S rRNA
agagtttgatcatggctcaggacgaacgctggcggcgtgcctaacacatgcaagtcgaacggagttacgggagcttgctcctgtaacttagtggcggacgggtgagtaacgcgtgagcaacctgccttacagagggggatagccattggaaacgatggataataccgcataacgtacagtcatggcatcttgattgtaccaaaggagcaatccgctgtaagatgggctcgcgtccgattagatagatggtgaggtaacggcccaccatgtcgacgatcggtagccggactgagaggttgaacggccacattgggactgagacacggcccagactcctacgggaggcagcagtgagggatattgcacaatgggcgaaagcctgatgcagcaacgccgcgtgagggatgacggttttcggattgtaaacctctgtcttcggtgatgataatgacattagccgaggaggaagccacggctaactacgtgccag

SEQ ID NO: 631 - DNA, 490 bp, Unknown
  Ascusbbf_19307, encodes 16S rRNA
agagtttgatcatggctcaggatgaacgctggcggcgcgcctaacacatgcaagtcgaacgaagctctttagcggatcccttcggggtgaagcttttgagacttagtggcggacgggtgagtaacgcgtggggaacctgccccgtacagggggataacagttagaaatgactgctaataccgcataagcgcacactgtcgcatggcagagtgtgaaaagccgagacggtacgggagggccccgcgtctgattagctagttggtggggtaacggcctaccaaggcgacgatcagtagccgaactgagaggttgatcggccacattgggactgagacacggcccagactcctacgggaggcagcagtgggggattttgcacaatggggggaaccctgatgcagcgacgccgcgtgagtgaagaagtatttcgatacgtaaagctctatcagcagggaagaaaatgacggtacctgactaagaagccccggct

SEQ ID NO: 632 - DNA, 490 bp, Unknown
  Ascusbbf_737775, encodes 16S rRNA
agagtttgatcctggctcaggatgaacgctggcggcgtgcataacacattcaagtcgaacggtgaagcgccttcgggtgcggatcagtggcggacgggtgagtaacgcgtgagcaacctgccgtatagtgggggataacacagggaaacttgtgctaataccgcataacacatgggaatcgcatgttttctatgtcaaagatttattgctgtacgatgggctcgcgtatgattagacagttggcagggcaacggcctaccaaatctacgatcattagccgaactgagaggttgaacggccacattggaactgagaaacggtccagactcctacgggaggcagcagtggggaatattgggcaatgggcgaaagcctgacccagcgacgccgcgtgagggaagaaggtcttcggattgtaaacctctttcagcagggaagaatcgatgacggtacctgcagaagaagtcacggctaactacgtgccagcagc

SEQ ID NO: 633 - DNA, 490 bp, Unknown
  Ascusbbf_560, encodes 16S rRNA
agagtttgatcctggctcaggacgaacgctggcggcgtgcttcatacatgcaagtcgaacgagaatctctagcttgctagagaggaaagtggcggacgggtgagtaaaatgtagagaatctgcccttgagagggggacaacagttggaaacggctgctaataccccatatgagcgtacctgagatggtattcttgaaaactccggtgctcaaggatgagtctgcatctgattagctagttggcggggtaatggcccaccaaggcgacgatcagtagctggtttgagaggatgatcagccacaatgggactgagacacggcccatactcctacgggaggcagcagtagggaattttgcgcaatgggggaaaccctgacgcagcaacgccgcgtgaacgagacgcccttcggggtgtaaagttttgtcagtggggacgaacaaatgacggtacccacagaggaagcaccggctaactccgtgccagcagccg

SEQ ID NO: 634 - DNA, 490 bp, Unknown
  Ascusbbf_6707, encodes 16S rRNA
agagtttgatcatggctcaggatgaacgctagctacaggcttaacacatgcaagtcgaggggcagcatgaaggtagcttgctacctttgatggcgaccggcgcacgggtgagtaacgcgtatccaacctgcccgctactcgggtatagcccagtgaaaactggattaatccccgatggcatcttacgctgacatcaaagtaagattaaaggttacggtagcggatggggatgcgtccgattagctatgttggcggggtaacggcccaccaaggcgacgatcggtaggggttctgagaggaaggtcccccacattggaactgagacacggtccaaactcctacgggaggcagcagtgaggaatattggtcaatggacgagagtctgaaccagccaagtagcgtgcaggatgacggccctatgggttgtaaactgcttttatcagggaataaagtgcggcacgcgtgccgttttgtatgtacctgacgaata

SEQ ID NO: 635 - DNA, 490 bp, Unknown
  Ascusbbf_1535, encodes 16S rRNA
agagtttgatcatggctcaggacgaacgctggcggcgtgcctaatacatgcaagtcgagcgaacagataaggagcttgctcctttgacgttagcggcggacgggtgagtaacacgtgggcaacctgccctatagttggggataactccgggaaaccggggctaataccgaataatccattccatctcctgatggaatgttgaaagatggttctgctatcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtacct

SEQ ID NO: 636 - DNA, 490 bp, Unknown
  Ascusbbf_75483, encodes 16S rRNA
agagtttgatcatggctcagattgaacgctggcggcatgctttacacatgcaagtcgaacggcagcacggaagagcttgctctttttggtggcgagtggcgaacgggtgagtaacatatcggaacgtaccgagtagtgggggataaccagtcgaaagattggctaataccgcatattctctgaggaggaaagccggggaccatttggcctggtgctatttgagcggccgatatctgattagctggttggtggggtaaaggcctaccaaggcgacgatcagtagcgggtctgagaggatgatccgccacactgggactgagacacggcccagactcctacgggaggcagcagtggggaattttggacaatgggggaaaccctgatccagccatgccgcgtgtatgaagaaggccttcgggttgtaaagtacttttgtcagggaagaaaagcacggtgttaatagcattgtgtgatgacggtacctgaagaa

SEQ ID NO: 637 - DNA, 490 bp, Unknown
  Ascusbbf_116631, encodes 16S rRNA
agagtttgatcctggctcaggacgaacgctggcggcgtgcttaacacatgcaagtcgaacggtaaggcccttcggggtacacgagtggcgaacgggtgagtaacacgtgagtaatgtgcccttgactctgggataaccgccggaaacggtggctaatactggatatgacctggccctgcatggggttgggtggaaagcttttgcggtcttggatcaactcgcggcctatcagcttgttggtgaggtagtggctcaccaaggcttcgacgggtagccggcctgagagggcgaccggccacactgggactgagatacggcccagactcctacgggaggcagcagtggggaatattgcacaatgggcggaagcctgatgcagcaacgccgcgtgcgggatgacggccttcgggttgtaaaccgctttcacccatgacgaagcgaaagtgacggtagtgggagaagaagcaccggccaactacgtgccagcagc

SEQ ID NO: 638 - DNA, 490 bp, Unknown
  Ascusbbf_284826, encodes 16S rRNA
agagtttgatcatggctcaggacgaacgctggcggcgtgcttaacacatgcaagtcgagcgagaaagctccttcgggagtgagtacagcggcgaacgggtgagtaacacgtgggcaacctgccccaaggagcgggacaacttgaggaaactcgggctaataccgcatgattcgcctcggcataagccgaggtggtaaatggtagcttcggcctccgccttgggatgggcccgcggcgcattagcttgttggtggggtaacggctcaccaaggcgacgatgcgtagctggtctgagaggacgatcagccacactgggactgagacacggcccagactcctacgggaggcagcagtggggaatcttgcgcaatgggcggaagcctgacgcagcaacgccgcgtgtgggaagacggctttcgggttgtaaaccactttcaggggggacgaagcttccggggttaatagcctacggggtgacggtacccccaga

SEQ ID NO: 639 - DNA, 490 bp, Unknown
  Ascusbbf_881304, encodes 16S rRNA
agagtttgatcctggctcagattgaacgctagcggcatgcttaacacatgcaagtcgaacggtaacaggtctagcttgctagatgctgacgagtggcggacgggtgagtaatgcgcaggaatctgccttatagtgggggataacttggggaaactcgagctaataccgcatatgccttacgtggtaaagcaggggactttcgggccttgtgctataagatgagcctgcgtcggattagcttattggtggggtaaaggcctaccaaggcgacgatccgtagctggtctgagaggatgatcagccacactgggactgagacacggcccagactcctacgggaggcagcagtggggaatattggacaatgggcgcaagcctgatccagcaatgccgcgtgtgtgaagaaggcctgcgggttgtaaagcactttcagtggggaggaaggattcagcgctaataccgttgaatattgacgttacctacagaagaa

SEQ ID NO: 640 - DNA, 490 bp, Unknown
  Ascusbbf_217782, encodes 16S rRNA
agagtttgatcctggctcagattgaacgctggcggcatgcctaacacatgcaagtcgaacggcagcatgacctagcttgctaggttgatggcgagtggcgcacgggtgagtaacgcgtgggaatatgccttaaagagggggacaacttggggaaactcaagctaataccgcataatctcttcggagaaaagctggggactttcgagcctggcgctttaagaatagcctgcgtctgattagctagttggtagggtaagagcctaccaaggcgacgatcggtagctggtctgagaggatggtcagccacactgggactgagacacggcccagactcctacgggaggcagcagtggggaatattggacaatgggggcaaccctgatccagcaatgccgcgtgtgtgaagaaggcctgagggttgtaaagcactttcagtggggaggaggattgacaggttaagagctagttaattggacgttacccacagaag

SEQ ID NO: 641 - DNA, 490 bp, Unknown
  Ascusbbf_254709, encodes 16S rRNA
agagtttgatcatggctcaggatcaacgctggcggcgtgcctaatgcatgcaagtcgaacggggtcgccttcgggcggctcacgtggcggacgggtgaggaacacgtgggcgatctgccccgaggtgggggatagccaccagaaatggtgggtaagaccgcatgagctccctggtttacggatcagggaggaaaacgcttcggcgtgccttgggaggagcctgcggcggattagctagttggtggggtaacggcttaccaaggcgatgatccgtagctggtctgagaggatgaccagccacaggggaactgagacacggtccccactcctacgggaggcagcagcaaggaattttccgcaatgggcgaaagcctgacggagcaacgccgcgtgggggatgacgcttttcggagtgtaaaccccttttctcagggaagaacacaatgacggtacctgaggaataaggaccggctaactacgtgccagcagc

SEQ ID NO: 642 - DNA, 490 bp, Unknown
  Ascusbbf_715963, encodes 16S rRNA
agagtttgatcatggctcaggacgaacgctggctgcgtgcttaacacatgcaagtcgaacgctgaagccctggtgcttgcaccggggtggatgagtggcgaacgggtgagtaacacgtgagtaacctgcccccgacttcgggataagcccgggaaactgggtctaataccggatatgaccatgactcgcatgagtgatggtggaaagttttttcggttggggatgggctcgcggcctatcagtttgttggtgaggtaatggctcaccaagacgacgacgggtagccggcctgagagggcgaccggccacactgggactgagacacggcccagactcctacgggaggcagcagtggggaatattgcacaatgggggaaaccctgatgcagcgacgcagcgtgcgggatgacggccttcgggttgtaaaccgctttcagcagggaagaagcccttcggggtgacggtacctgcagaagaagtaccggctaac

SEQ ID NO: 643 - DNA, 490 bp, Unknown
  Ascusbbf_257886, encodes 16S rRNA
agagtttgatcctggctcaggacgaacgctggcggcgtgcttaacacatgcaagtcgaacgatgaagcaccagcttgctggtgtggaagagtggcgaacgggtgagtaccacgtgagtaacctgccccgaactctgggataagcgctggaaacggtgtctaatactggatatgcatcatggccgcatggtctgtgatgggaaagactttgtcggttcgggatggactcgcggcctatcagcttgatggtggggtaatggcctaccatggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagcgaaagtgacggtacctgcagaaaaagcaccggctaactacgtg

SEQ ID NO: 644 - DNA, 490 bp, Unknown
  Ascusbbf_335916, encodes 16S rRNA
agagtttgatcctggctcagattgaacgctggcggcatgctttacacatgcaagtcgagcggcagcgggggtgcttgcacctgccggcgagcggcgaacgggtgagtaatgcatcggaacgtacccatttgtgggggatagcccggcgaaagccggattaataccgcatacgccctgagggggaaagcgggggattcttcggaacctcgcgcaattggagcggccgatgtcggattagctagtaggtggggtaaaggctcacctaggcgacgatccgtagctggtctgagaggatgatcagccacactgggactgagacacggcccagactcctacgggaggcagcagtggggaattttggacaatgggcgaaagcctgatccagccatgccgcgtgagtgaagaaggccttcgggttgtaaagctctttcagttgggaagaaaaggcgctctctaatatagggcgctgctgacggtaccgacagaagaa

SEQ ID NO: 645 - DNA, 490 bp, Unknown
  Ascusbbf_649723, encodes 16S rRNA
agagtttgatcctggctcaggacgaacgctggcggcgggcttaacacatgcaagtcgaacgagaagctccccttcgggggagtggaaagtggcgcacaggtgagtaacacgtgggcaacctaccctcaggcggggaataactacgggaaaccgtggctaataccgcataactgtccggaccccgcatggggaccggatcaaaggcttcggccacctggggatgggcctgcgtcggattagcttgttggtgaggtaacggctcaccaaggcaacgatccgtagctggtctgagaggatgatcagccacactggcactgagacacgggccagactcctacgggaggcagcagtgaggaatcttgcgcaatggaggaaactctgacgcagccacgccgcgtgcaggaagacacccctcaggggcgtaaactgcttttatacgagaagaacaccctactcggtagggtctgacggtatcgtatgaataaggacc

SEQ ID NO: 646 - DNA, 490 bp, Unknown
  Ascusbbf_16471, encodes 16S rRNA
agagtttgatcctggctcaggatgaacgctggcggcgtgcttaacacatgcaagtcgaacgggaaacttttcattgaagcttcggcagatttggtctgtttctagtggcggacgggtgagtaacgcgtgggtaacctgccttatacagggggataacaaccagaaatggttgctaataccgcataagcgcacaggaccgcatggtccggtgtgaaaaactccggtggtataagatggacccgcgttggattagctagttggcagggtaacggcctaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggcta

SEQ ID NO: 647 - DNA, 490 bp, Unknown
  Ascusbbf_29601, encodes 16S rRNA
agagtttgatcatggctcaggatgaacgctagcggcaggcctaacacatgcaagtcgaggggtagaaatagcttgctattttgagaccggcggatgggtgcgtaacgcgtatgcaatctaccttgtacattgggatagcccggagaaatccggattaataccttatagttttattgattggcatcaattaataagtaaagatttatcggtacaagatgagcatgcgtcccattagttagttggtgtggtaacggcataccaagacgatgatgggtaggggtcctgagagggagatcccccacactggtactgagacacggaccagactcctacgggaggcagcagtgaggaatattggtcaatggacgcaagtctgaaccagccatgccgcgtgcaggaagaatgtcctatggattgtaaactgcttttatacgggaagaaacctatccacgagtggataattgacggtaccgtaagaataaggatcggc

SEQ ID NO: 648 - DNA, 490 bp, Unknown
  Ascusbbf_1508164, encodes 16S rRNA
agagtttgatcctggctcaggattaacgctggcggcgtgcctaacacatgcaagtcgaacgaaatacttttgtatttagtggcgaacgggtgagtaatgtacaggtaatgtaccttcgtactgcgaataacaagctgaaaagtttgctaatacggaatagcttcctacgagggcatccttaaaggaataaagatttatcgtgcggagatcagcctgtatcctattagttagttggtggggtaatggcctaccaagacgacgatgggtaactggtctgagaggatgagcagtcacattggaactgagaaacggtccaaactcctacgggaggcagcagtgaggaattttgcgcaatgggggaaaccctgacgcagcaacgccgcgtgagtgatgacggccttcgggttgtaaagctttgtcgtgtgtgacgagtagggacggtaacacacaaggaagcctcggctaactacgtgccagcagccgcggtaat

SEQ ID NO: 649 - DNA, 490 bp, Unknown
  Ascusbbf_84177, encodes 16S rRNA
agagtttgatcctggctcaggacgaacgctggcggcgtgcttaacacatgcaagtcgaacggtaaggcccttcggggtacacgagtggcgaacgggtgagtaacacgtgagtgacctgccctctacttcgggataacctccagaaatggtggctaataccggatattcatgcgtcccttcctgggggtgtgtggaaagctttggcggtagtggatggactcgcggcctatcagcttgttggtgaggtagtggctcaccaaggcttcgacgggtagccggcctgagagggtgaccggccacattgggactgagatacggcccagactcctacgggaggcagcagtggggaatattgcgcaatgggcggaagcctgacgcagcaacgccgcgtgcgggatgacggccttcgggttgtaaaccgctttcagtagggacgaagcttttgtgacggtacctacagaagaagcaccggccaactacgtgccagcag

SEQ ID NO: 650 - DNA, 490 bp, Unknown
  Ascusbbf_22018, encodes 16S rRNA
agagtttgatcctggctcaggacgaacgctggcggcatgcctaacacatgcaagtcgaacggaacaaaggacgctgtagcgatacaatggaatttgtttagtggcgaacgggtgagtaacacgtgagcaacctgcctttcacacagggataacagccggaaacggctgctaataccggataagaccacactgaggcatctcagaggggtcaaagcgtttagcggtgaaagatgggctcgcgtcccattagctagttggtgagataacagcccaccaaggcgacgatgggtagccgacttgagagagtgatcggccacattggaactgagacacggtccagactccttcgggaggcagcagtggggaatattgggcaatggaggaaactcttacccagcaatgccgcgtgaatgaagaaggccttcgggttgtaaagttcttttattgatgataaagaaagtgatattagtcaatgaataagccccggcta

SEQ ID NO: 651 - DNA, 490 bp, Unknown
  Ascusbbf_8883, encodes 16S rRNA
agagtttgatcctggctcagagtgaacgctggcggcaggcctaacacatgcaagtcgaacggcagcgggtaggaagcttgcttcctatgccggcgagtggcggacgggtgaggaacacatcggaatctactccgtcgtgggggataacgtagggaaacttacgctaataccgcatacgacctaagggtgaaagtgggggaccgcaaggcctcacgcgatggaatgagccgatgtccgattagctagttggcggggtaaaggcccaccaaggcgacgatcggtagctggtctgagaggatgatcagccacactgggactgagacacggcccagactcctacgggaggcagcagtggggaatattggacaatgggcgaaagcctgatccagccatgccgcgtgggtgaagaaggccttcgggttgtaaagcccttttgttggggaagaaatcctgctggctaatacccggcggggatgacggtacccaaaga

SEQ ID NO: 652 - DNA, 490 bp, Unknown
  Ascusbbf_54217, encodes 16S rRNA
agagtttgatcatggctcaggacgaacgctggcggcgtgcctaacacatgcaagtcgagcggagattatcgggatgaaagcttcggccggattcctggtaatttcagcggcggacgggtgagtaacgcgtgagcaatctgtctcagacagggggataacgcagcgaaagttgcactaataccgcatgagaccacaacgtcacatgacgaaggggtcaaaggagcaatccggtctgaggtgagctcgcgtcccattaggtagttggtgaggtaacggcccaccaagccgacgatgggtagccgacctgagagggtgatcggccacactggaactgagacacggtccagactcctacgggaggcagcagtgggaatattgggcaatgggcgaaagcctgacccagcaacgccgcgtgagtgaagaaggtcttcggattgtaaatctctgtcctaagagaagaggggaagacggtatcttaggaggaagcccc

SEQ ID NO: 653 - DNA, 490 bp, Unknown
  Ascusbbf_40432, encodes 16S rRNA
agagtttgatcctggctcaggatgaacgctggcggcgtgcctaacacatgcaagtcgaacggttaagccggccctcgggccgggaatacagtggcgaacgggtgagtaacacgtgaccaacctgccccccgcacggggacagccccgcgaaagcggggttgatacccggcgtcccgcctcccccgcatggggagggcggggaagctccggcggcgggggatggggtcgcggcccattaggctgacggcggggcaacggcccaccgtgccgacgatgggtagccgggttgagagaccgaccggccacattgggactgagatacggcccagactcctacgggaggcagcagtggggaatattgcgcaatgggggaaaccctgacgcagcaacgccgcgtgcgggacgacggccctcgggctgtaaaccgctttcagcggggaagacatcgacggtacccgcagaagaagccccggctaactacgtgccagca

SEQ ID NO: 654 - DNA, 470 bp, Unknown
  Ascusbbf_46003, encodes 16S rRNA
agagtttgatcctggctcagaacgaacgctggcggcaggcttaacacatgcaagtcgaacgcatccttcggggtgagtggcagacgggtgagtaacgcgtgggaatctaccctttcctacgggatagctccgggaaactggaattaataccgtatacgtccttagggagaaagatttatcggggaaggatgagcccgcgttggattagctagttggtgaggtaaaggctcaccaaggcgacgatccatagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcagtggggacgataatgacggtacccacagaagaagccccggctaacttcgtgccagcagccgcggtaat

SEQ ID NO: 655 - DNA, 490 bp, Unknown
  Ascusbbf_22239, encodes 16S rRNA
agagtttgatcctggctcaggatgaacgctagctacaggcttaacacatgcaagtcgaggggcagcataagagtagcttgctacttttgatggcgaccggcgcacgggtgcgtaacacgtatccaatctacccacggctcagggatagcctttcgaaagaaagattaatacctgatggtctcctttagggacatccctttaggagtaaagattcatcggccatggatgaggatgcgtccgattagcttgacggcggggtaacggcccaccgtggctacgatcggtaggggttctgagaggaaggtcccccacactggaactgagacacggtccagactcctacgggaggcagcagtgaggaatattggtcaatggtcggaagactgaaccagccaagtagcgtgagggatgactgccctatgggttgtaaacctcttttattggggaacaaattgggccacgtgtggtcctttgcgtgtaccctatgaat

SEQ ID NO: 656 - DNA, 490 bp, Unknown
  Ascusbbf_1373162, encodes 16S rRNA
agagtttgatcctggctcaggatgaacgctggcggcgtgcctaacacatgcaagtcgagcgagaaattcatgacgaattcttcggatgcctgattgaatggaaagcggcggacgggtgagtaacgcgtaggtaacctgccctgtacaaagggatagccattggaaacggtgattaataccttatgataccgcagcatcacatggtgaagcggtcaaagattttatcggtacaggatggacctgcgtctgattagttagttggtggggtaacggctcaccaaggcgacgctcagtagccgtcataagagggggatcggccacatgggaactgagacacggtccaaactcatacgggaggcagcagtggggaatattgcacaatgggcgcaagccttatgcagcaacgccgcgtgaacgaagaaggcctttgggtcgtaaagttctgttctgagggaagaagaaagtgacggtacctcaggagaaagccccg

SEQ ID NO: 657 - DNA, 490 bp, Unknown
  Ascusbbf_32848, encodes 16S rRNA
agagtttgatcatggctcagaatgaacgttggcggcgtggattaggcatgcaagtcgagcggcaaggttttttatcttcggattttagaccctagagcggcgaaagggataggaacgtatagatacatgcctcttagctcaggatagcgtctggaaacgggcgataatactgaatgaggtctccggaccaaaggtgtgattccgctaggagattggtctatatcctattagctagttggtaaggtaacggcttaccaaggcgatgatgggtacggggcgtgagagcgtgaccccgatcactgggactgagacactgcccagacgcctacgggcggctgcagtcgagaatcttcggcaatggacgaaagtctgaccgagcgacgccgcgtgtatgatgaaggtcttcggattgtaaagtactgtcgatagggcggaaatttacggtggcaatccatcgtatttgacctatcttttgaggaaggacgggcta

SEQ ID NO: 658 - DNA, 490 bp, Unknown
  Ascusbbf_51123, encodes 16S rRNA
agagtttgatcctggctcaggatgaacgctagctacaggcttaacacatgcaagtcgaggggcagcatgtcgtgtgcttgcacacgatgatggcgaccggcgcacgggtgagtaacgcgtatccaacctgcccatgaccccgggatagcccgctgaaaagcggattaacaccggatggggtcgaacgaggacatctgatttcgaccaaagcttcggcggtgatggatggggatgcgtctgattagcttgttggcggggtaacggcccaccaaggcgacgatcagtaggggttctgagaggaaggtcccccacattggaactgagacacggtccaaactcctacgggaggcagcagtgaggaatattggtcaatgggcggaagcctgaaccagccaagtagcgtggaggacgacggccctacgggttgtaaactccttttttgcggggataaagtgccctacgcgtagggtattgcaggtaccgcacgaat

SEQ ID NO: 659 - DNA, 490 bp, Unknown
  Ascusbbf_17325, encodes 16S rRNA
agagtttgatcctggctcaggacgaacgctggcggcgtgcctaacacatgcaagtcgaacggagttacgggagcttgctcctgtaacttagtggcggacgggtgagtaacgcgtgagcaacctgccttacagagggggatagccattggaaacgatggataataccgcataacgtattcgcatggcatcttgtgaataccaaaggagcaatccgctgtaagatgggctcgcgtccgattagatagttggcggggcaacggcccaccaagtcgacgatcggtagccggactgagaggttgaacggccacattgggactgagacacggcccagactcctacgggaggcagcagtgagggatattgcacaatgggcgcaagcctgatgcagcaacgccgcgtgagggatgacggttttcggattgtaaacctctgtcttcggtgatgataatgacattagccgaggaggaagccacggctaactacgtgccag

SEQ ID NO: 660 - DNA, 490 bp, Unknown
  Ascusbbf_23714, encodes 16S rRNA
agagtttgatcctggctcagaatgaacgttggcggcgtggattaggcatgcaagtcgagcgagatcataccttcgggtatgtgagagcggcggaagggataggaacatatagatacgcgcctcttagcccgggatagcgtctggaaacggacgataataccggatgacgtattcgtacgaaaggtgtaattccgctaggagatcggtctatatcctattagctagttggtagggtaacggcctaccaaggcgatgatgggtacggggcgtgagagcgcgaccccgatcactgggactgagacactgcccagacgcctacgggcggctgcagtcgagaatcttcggcaatggacgaaagtctgaccgagcgacgccgcgtgtatgatgaaggtcttcggattgtaaaatactgtcgatggggcggaagttgcagaggaacgcttctgtaattgacctatccgttgaggaaggacgggctaagttcgtgcca

SEQ ID NO: 661 - DNA, 490 bp, Unknown
  Ascusbbf_404428, encodes 16S rRNA
agagtttgatcctggctcaggatgaacgctagcgacaggcttaacacatgcaagtcgaggggcagcgtggcggcagcaatgccgccgacggcgaccggcgcactggtgagtaacacgtatgcaacctgccccccacagggggacaatccagagaaatttggtctaataccgcataagagcgtccccggcatcggggttgcttgaaagctaatttgcggtgggggatgggcatgcggcgcattagcttgttggcggggtgacggcccaccaaggcgacgatgcgtaggggttctgagaggaaggtcccccacactggtactgagacacggaccagactcctacgggaggcagcagtgaggaatattggtcaatggacggaagtctgaaccagccaagtcgcgtgagggaagaaggtccttcggattgtaaacctcttttgccggggagtaaccgggcggacttgtccgtccctgagagtacccggagaaaa

SEQ ID NO: 662 - DNA, 490 bp, Unknown
  Ascusbbf_60821, encodes 16S rRNA
agagtttgatcatggctcaggatgaacgctggcggcgtgcttaacacatgcaagtcgaacggggaagtatttttgaagttttcggatggatgaaatgctttctagtggcggacgggtgagtaacgcgtaaacaatctgccttagagagggggataacagatagaaatatttgctaataccgcataagaccacgagtgggcatccactaggggtaaaaggagaaatccgctttaagatgagtttgcgtactattagctagttggtgaggtaacggcccaccaaggcgacgatggttagccggcctgagagggtgaacggccacattggaactgagatacggtccagactcctacgggaggcagcagtgaggaatattgggcaatgggcgaaagcctgacccagcaacgccgcgtggaggaagaaggtcttcggattgtaaacttctgttatgggggaaaaagaaagtgatggtaccccatgagaaagctac

SEQ ID NO: 663 - DNA, 490 bp, Unknown
  Ascusbbf_32994, encodes 16S rRNA
agagtttgatcatggctcaggatgaacgctggcggcaggcttaatacatgcaagtcgaacggtaacgaccggtagcaatactggggcgacgagtggcgcacgggtgcgtaacgcgtatgcaacctaccctcaaccggggcataacgccgagaaattggcgctaatatcccatgtgtatatggagtggcatctcttcatatataaagatccgttggttaaggatgggcatgcgtaacattagctagttggcggggtaacggcccaccaaggcgacgatgtttaggggttctgagaggattcacccccacactggaactgagacacggtccagactcctacgggaggcagcagtagggaatattgggcaatggaggcaactctgacccagccatgccgcgtgaaggaagacggccctatgggttgtaaacttcttttgccgcagagtaaccgcggggacgtgtccctgcctgagagtatgcggcgaataagt

SEQ ID NO: 664 - DNA, 490 bp, Unknown
  Ascusbbf_142188, encodes 16S rRNA
agagtttgatcctggctcaggatgaacgctggcggcgtgcttaacacatgcaagtcgagcgagaagctcatgaccaattcttcggaggcgtgattgagtggaaagcggcggacgggtgagtaacgcgtaggcaacctgccccatacaaagggatagctactggaaacggtaattaatacctcataacacgagaggatcgcatgttcttctcgtcaaagatttatcggtatgggatgggcctgcgtctgattagctggttggtggggtaacggcccaccaaggcgacgatcagtagccgacctgagagggtaaacggccacattggaactgagacacggtccaaactcctacgggaggcagcagtggggaatattgcacaatggggggaaccctgatgcagcaacgccgcgtgagcgaagaaggcctttgggtcgtaaagctctgtcctgaaggaagaaggaagtgacggtacttcaggaggaagccccgg

SEQ ID NO: 665 - DNA, 490 bp, Unknown
  Ascusbbf_104234, encodes 16S rRNA
agagtttgatcctggctcaggatgaacgctggcggcaggcttaatacatgcaagtcgaacggtaaggcctgatgtagcaatacagagggtacacgagtggcgcacgggtgcgtaacgcgtatgtaatctgcctgcaaccgggacaaaacagttggaaacggctgctaatatcccatggtcaatttttcaggcatctgggagattgtaaagatttattggttgcagatgagcatgcgtattattaggtagttggtgaggtaaaggctcaccaagccgacgatgattaggggtcctgagagggttaacccccacactggaactgagacacggtccagactcctacgggaggcagcagtagggaatattgggcaatggaggaaactctgacccagccatgccgcgtgaaggaagacggccctatgggttgtaaacttcttttgttgcagagtaaaggcagccacgagtggttgtttgagagtatgcgacgaat

SEQ ID NO: 666 - DNA, 490 bp, Unknown
  Ascusbbf_287631, encodes 16S rRNA
agagtttgatcctggctcaggatgaacgctggcggcgtgcttaacacatgcaagtcgaacgggacttacgtagaaagcggcttcggccaatggaaatgtaagtttagtggcggacgggtgagtaacgcgtggacaacctgccccataccgggggataacacccagaaatgagtgctaataccgcataagcgcacggaaccgcatggttttgtgtgaaaaactccggtggtatgggatgggtccgcgttggattagctggttggcggggcaacggcccaccaaggcgacgatccatagccggcctgagagggtgaacggccacattgggactgagacacggcccagactcctacgggaggcagcagtggggaatattgcacaatggggggaaccctgatgcagcgacgccgcgtgaaggaagaagtatctcggtatgtaaacttctatcatcggggaagaagatgacggtacccgaggaagaagccccggc

SEQ ID NO: 667 - DNA, 490 bp, Unknown
  Ascusbbf_207303, encodes 16S rRNA
agagtttgatcatggctcaggatgaacgctagcgacaggcctaacacatgcaagtcgaggggtagcagattttagcttgctaaaatgctgacgaccggcgcacgggtgagtaacgcgtatgcaacctgcctactacaggggaataacccggagaaattcggactaataccgcataacacaggggtcccgcatgggaatatttgttaaagatttatcggtagtagatgggcatgcgtgccattagctagttggtgaggtaacggctcaccaaggcaacgatggctaggggaactgagaggtttatcccccacactggaactgagacacggaccagactcctacgggaggcagcagtgaggaatattggtcaatgggcgagagcctgaaccagccaagtcgcgtgaaggaagactgccttatgggttgtaaacttcttttatacaggaataaaaaataccacgtgtggtatattgcatgtactgtatgaata

SEQ ID NO: 668 - DNA, 490 bp, Unknown
  Ascusbbf_182273, encodes 16S rRNA
agagtttgatcatggctcaggacgaacgctggcggcgtgcttcatacatgcaagtcgaacgagaaattcacttcggtggatggacagtggcggacgggtgagtaatgtgtagagaatctgccctatggagggggacaacagagggaaacttctgctaataccccatatgcgcgtagctgagatgctattcgtgaaagatttatcgccataggatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgatcgagaagaccttcgggttgtaaagatctgtcagtagggacgaataatgactgtacctacagaggaagcaccggctaactccgtgccagcagccgcgg

SEQ ID NO: 669 - DNA, 490 bp, Unknown
  Ascusbbf_489839, encodes 16S rRNA
agagtttgatcctggctcaggatgaacgctggcggcgtgcttaacacatgcaagtcgaacgaagaggtacgagcggataggcttcggctttgaagcttgtacatatcttagtggcggacgggtgagtaacgcgtgggcaacctgccctttacaggggaataatcattggaaacgatgactaataccgcatgtcaccgcgagatggcatcatcttgcggaaaaaggagaaatccggtaaaggatgggcccgcgtctgattagcttgttggtggggtaacggcctaccaaggcgacgatcagtagccgacctgagagggtgatcggccacattgggactgagacacggcccaaactcctacgggaggcagcagtggggaatattgcacaatggggggaaccctgatgcagcaacgccgcgtgaaggaagaaggttttcggatcgtaaacttctatcaatagggacgaaaaagatgacggtacctaaataaga

SEQ ID NO: 670 - DNA, 490 bp, Unknown
  Ascusbbf_309235, encodes 16S rRNA
agagtttgatcatggctcaggataaacgctggcggcgcacataagacatgcaagtcgaacggaagtcgttatattcgaaatcgatatgaacagagaacttgttcgaagtgattagacattgactttataacaatggctttagtggcggactggtgagtaacgcgtgagcaacctgcctatcagaggggaataacagtgagaaatcattgctaataccgcatatgccataatcaccacatggtgatagtgggaaaggagcaatccactgatagatgggctcgcgtctgattagatagttggtggggtaacggcctaccaagtcgacgatcagtagccggactgagaggttgaacggccacattgggactgagatacggcccagactcctacgggaggcagcagtcgggaatattgcgcaatggaggaaactctgacgcagtgacgccgcgtataggacgaaggtcttcggattgtaaactattgtcgttag

SEQ ID NO: 671 - DNA, 490 bp, Unknown
  Ascusbbf_1658537, encodes 16S rRNA
agagtttgatcctggctcaggacgaacgctggcggcgtgcctaacacatgcaagtcgaacgagaatttaattaatgaaccttcgggggaattaattgaaggacagtggcggacgggcgagtaacgcgtgagtaacctgcccataagagagggatagcctatggaaacgtggagtaatacctcatattgtattttaatcgcatggttgaaatatgaaagatttatcgcttatggatggactcgcgtcagattagatagttggtgaggtaacggctcaccaagtcgacgatctgtagccgaactgagaggttgatcggccgcattgggactgagacacggcccagactcctacgggaggcagcagtggggaatattgcgcaatgggggaaaccctgacgcagcaacgccgcgtgcaggaagaaggtcttcggattgtaaactgttgtcgcaagggaagaagaaagtgacggtaccttgtgagaaagtcacgg

SEQ ID NO: 672 - DNA, 490 bp, Unknown
  Ascusbbf_1066181, encodes 16S rRNA
agagtttgatcctggctcaggacgaacgctggcggcgtgcttaacacatgcaagtcgagcggaaaggccccttcgggggtactcgagcggcgaacgggtgagtaacacgtgagcaacctgcccctgactctgggataagcccgggaaaccaggtctaataccggatacgacctcctcgctcctgcgatgggggtggaaagattcatcggttggggatgggctcgcggcctatcagcttgttggtggggtaacggcctaccaaggcgacgacgggtaaccggcctgagagggcgaccggtcacactgggactgagacacggcccagactcctacgggaggcagcagtgggaatattgcgcaatgggcggaagcctgacgcagcgacgccgcgtgggggatgacggccttcgggttgtaaacccctttcagcagggacgaagctaacgtgacggtacctgcagaagaagcgccggctaactacgtgccagca

SEQ ID NO: 673 - DNA, 490 bp, Unknown
  Ascusbbf_562296, encodes 16S rRNA
agagtttgatcctggctcagattgaacgctggcggcaggcttaacacatgcaagtcgaacggtagcgggaagaaagcttgctttctttgccgacgagtggcggacgggtgagtaatgcttggggatctggcttatggagggggataacgacgggaaactgtcgctaataccgcgtaatatcttcggattaaagggtgggactttcgggccacccgccataagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgatgaggaaggtatcagatttaatagatttggtaattgacgttattcacaga

SEQ ID NO: 674 - DNA, 472 bp, Unknown
  Ascusbbf_670426, encodes 16S rRNA
agagtttgatcctggctcagaacgaacgctggcggcaggcctaacacatgcaagtcgagcgcgtctcttcggaggcgagcggcgcacgggtgagtaacgcgtgggaacctaccctggggtaggggataaccgctggaaacggcggctaataccctatacgtccttcgggagaaagatttatcgccccgggatgggcccgcgtcggattagctagttggtggggtaacggctcaccaaggcgacgatccgtagctggtctgagaggatgatcagccacactgggactgagacacggcccagactcctacgggaggcagcagtggggaatattggacaatgggcgcaagcctgatccagccatgccgcgtgagtgaagaaggccttagggttgtaaagctctttcacccgcgaagatgatgacggtagcgggagaagaagccccggctaactccgtgccagcagccgcggtaat

SEQ ID NO: 675 - DNA, 490 bp, Unknown
  Ascusbbf_1765990, encodes 16S rRNA
agagtttgatcctggctcaggatgaacgctggcggcgtgcctaacacatgcaagtcgagcgagaaacttgtaaatgaaacttcggtagattttacaagcggacagcggcggacgggtgagtaacgcgtaggcaacctgcctcatacagagggatagcattgggaaactaatattaatacctcataacacgaagttgactcatgtcaacatcgtcaaagatttatcggtatgagatgggcctgcgtctgattagttagttggtgaggtaacggctcaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaacgatgaaggcccttgggtcgtaaagttctgtccttggggaagaaaaaaatgacggtacccaagaagaaagccccgg

SEQ ID NO: 676 - DNA, 490 bp, Unknown
  Ascusbbf_1468324, encodes 16S rRNA
agagtttgatcctggctcaggacgaacgctggcggcatgcctaacacatgcaagtcgaacggagaaaaggagcttgctccttttcttagtggcggacgggcgagtaacgcgtgagtaacctgcctttcagtggggaataacgactggaaacggtcgctaataccgcataatgtagcgaggtcgcctggccatgctaccaaggagcaattcgctgaaagatggactcgcgtccgattagctagttggtgaggtaatggctcaccaaggcgacgatcggtagccgaactgagaggttgatcggccgcattgggactgagacacggcccagactcctacgggaggcagcagtgggggatattgcacaatgggggaaaccctgatgcagcaatgccgcgtgagggaagaaggtcttcggattgtaaacctaagtagtcagggacgaataaatgacggtacctgaaaagtaagctccggctaactacgtgccagc

SEQ ID NO: 677 - DNA, 490 bp, Unknown
  Ascusbbf_1446030, encodes 16S rRNA
agagtttgatcctggctcaggatgaacgctggcggcgtgcctaacacatgcaagtcgaacgaagcaccttttcacgatcccttcggggtgacgagattgtgacttagtggcggacgggtgagtaacgcgtggggaacctgccctgtactgggggatagcgactggaaacggtcgataataccgcataagcgcacgacatcacatgatgatgtgtgaaaaactccggtggtacaggatggccccgcgtctgattagctagttggtgaggtaacggctcaccaaggcgaagatcagtagccgacctgggatggtgacgggccacatggggactgagacacgggccagactcctacggggggcagcagtggggaatattgcacaatgggcgaaagcctgatgcagcgacgccgcgtgagcgatgaagtatttcggtatgtaaagctctatcagcagggaagaaattgacggtacctgactaagaagctccggc

SEQ ID NO: 678 - DNA, 490 bp, Unknown
  Ascusbbf_1585325, encodes 16S rRNA
agagtttgatcctggctcaggatgaacgctagctacaggcttaacacatgcaagtcgaggggcagcatgaagtttgcttgcaaactttgatggcgaccggcgcacgggtgagtaacgcgtatccaaccttccctatactagaggatagcccggcgaaagtcggattaatactctatgttcttcgtagaagacatctgaaatgaagcaaaggtttaccggtataggatggggatgcgtctgattaggttgttggcgaggtaacggctcaccaaggcgatgatgcgtagccgacctgagagggtaatcggccacattgggactgagacacggcccagactcctacgggaggcagcagtagggaatcttccacaatggacgcaagtctgatggagcaacgccgcgtgagtgaagaagggtttcggctcgtaaagctctgttgttaaagaagaacgtgggtgagagtaactgttcacccagtgacggtatttaa

SEQ ID NO: 679 - DNA, 490 bp, Unknown
  Ascusbbf_105, encodes 16S rRNA
agagtttgatcatggctcaggacgaacgctggcggcgtgcttaacacatgcaagtcgaacgaagcttgacgaatgaattcttcggaatgatttctgaaatgactgagtggcggacgggtgagtaacgcgtgagtaacctgcctcttggagggggatagtgtttggaaacgaacagtaataccgcataatgtgcattgatggcatcttcgatgtaccaaagatttatcgccaagagatggactcgcgtctgattagatagttggtgaggtaacggctcaccaagtcgacgatcagtagccggactgagaggttgaacggccacattgggactgagacacggcccagactcctacgggaggcagcagtggggaatattgcacaatgggcgcaagcctgatgcagcaacgccgcgtggaggaagacggttttcggattgtaaactcctgttcttagggaagaagaaagtgacggtacctaaggagcaagccac

SEQ ID NO: 680 - DNA, 490 bp, Unknown
  Ascusbbf_7590, encodes 16S rRNA
agagtttgatcatggctcaggatgaacgctagctacaggcttaacacatgcaagtcgaggggcagcattaagttagcttgctaacttagatggcgaccggcgcacgggtgagtaacgcgtatccaaccttccccctgctcagggatagcccgctgaaaggcggattaacacctgatagcttcactagatggcatctgacggtgaataaagataacggcaagggatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatgggcggaagcctgaaccagccaagtagcgtgcaggaagacggccctatgggttgtaaactgcttttgtacgggaataaagtcattcacgtgtggatgtttgcatgtaccgtaagaataa

SEQ ID NO: 681 - DNA, 490 bp, Unknown
  Ascusbbf_3187, encodes 16S rRNA
agagtttgatcatggctcaggatgaacgctagcggcaggcttaacacatgcaagtcgaggggcagcgcggagtagcaatactctggcggcgaccggcggaagggtgcgtaacgcgtgagcaacttgcccgtcactgtgggataggcactggaaacggtgtgtaataccacgtaacacatatactcgcatgggtagatgttgaaaggtttaccggtgacggatgggctcgcgtgccattagctagtcggcggggtaacggcccaccgaggcgacgatggctaggggttctgagaggaaggtcccccacactggaactgagacacggtccagactcctacgggaggcagcagtgaggaatattggtcaatgggcggaagcctgaaccagccatgccgcgtgcaggaataaggccctatgggtcgtaaactgcttttgttgtggagcaataagggccacgcgtggtccgatgagagtacacagcgaataagca

SEQ ID NO: 682 - DNA, 490 bp, Unknown
  Ascusbbf_1192, encodes 16S rRNA
agagtttgatcatggctcaggacgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtgggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgcca

SEQ ID NO: 683 - DNA, 490 bp, Unknown
  Ascusbbf_1801, encodes 16S rRNA
agagtttgatcctggctcaggataaacgctggcggcgcacataagacatgcaagtcgaacgaacttaacctttagtttactaatggagcggttagtggcggactggtgagtaacacgtaagcaacctgcctatcagaggggaacaacagttagaaatgactgctaataccgcatatgccttgaatatcacatgatataaaagggaaaggagcaatccgctgatagatgggcttgcgtctgattagatagttggtggggtaacggcctaccaagtcgacgatcagtagccggactgagaggttgaacggccacattgggactgagatacggcccagactcctacgggaggcagcagtcgggaatattgcgcaatggaggaaactctgacgcagtgacgccgcgtgcaggaagaaggttttcggattgtaaactgctttagacagggaagaacaaggacagtacctgtagaataagctccggctaactacgt

SEQ ID NO: 684 - DNA, 490 bp, Unknown
  Ascusbbf_2642, encodes 16S rRNA
agagtttgatcctggctcaggacgaacgctggcggcatgcttaacacatgcaagtcgaacggactgattccttcgggatgaaagttagtggcgaacgggtgagtaatgtatgagcaacctgcctctgtcaacgggataacagttggaaacgactgctaatacggtataagaccacggcaccgcatggtgctgcggtaaaagatttttcggacagagatgggctcatatcccattagctagttggtgagataatagcccaccaaggcgacgatgggtagccgagctgagaggctgatcggccacattgggactgaaacacggcccagactcctacgggaggcagcagtggggaatattgggcaatggaggaaactctgacccagcaatgccgcgtgagcgatgaaggtaattttattgtaaagctcttttctcaggaacgaataaagatgacggtacctgaggaataagccccggctaactacgtgccagc

SEQ ID NO: 685 - DNA, 490 bp, Unknown
  Ascusbbf_5122, encodes 16S rRNA
agagtttgatcctggctcaggacgaacgctggcggcgtgcctaatacatgcaagtagaacgctgaagactttagcttgctaaagttggaagagttgcgaacgggtgagtaacgcgtaggtaacctgcctactagcgggggataactattggaaacgatagctaataccgcataacagcatttaacacatgttagatgcttgaaaggagcaattgcttcactagtagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaact

SEQ ID NO: 686 - DNA, 488 bp, Unknown
  Ascusbbf_2607, encodes 16S rRNA
agagtttgatcatggctcagaacgaacgctggcggcatggattaggcatgcaagtcgaacgaagcagcaatgcttagtggcggaagggtgaggaacgcgtgagcaacctgcccccaagttgggaataacagttggaaacgactgctaataccgaatgtggcttttggaccgcatggtttgatggctaaagatttattgcttggggatgggctcgcgtcccattagctagttggtgaggtaacggctcaccaaggcgatgatgggtagctggtctgagaggatggtcagccacactgggactgagacactgcccagactcctacgggaggctgcagtcgagaatcttgggcaatgcgcgaaagcgtgacccagcaatgccgcgtgcgggatgaaggtcttcggattgtaaaccgctgtcacccgggacgaaagttgactgtaccgggggaggaagccacggctaactacgtgccagcagccgcggtaat

SEQ ID NO: 687 - DNA, 490 bp, Unknown
  Ascusbbf_4628, encodes 16S rRNA
agagtttgatcatggctcaggatgaacgctagctacaggcttaacacatgcaagtcgaggggcagcatgttggttgcttgcaaccgatgatggcgaccggcgcacgggtgcgtaacgcgtatccaatctgccctgtgctcggggatagccttgcgaaagtaagattaacacccgatggtctccctggcccgcatggtccttggagtaaagtttcacggcacgggatgtggatgcgtccgattaggtagtaggcggggcaacggcccacctagccgacgatcggtaggggttctgagaggaaggtcccccacactggaactgagacacggtccagactcctacgggaggcagcagtgaggaatattggtcaatggtcggaggactgaaccagccaagtagcgtgagggaaggcggccctacgggttgtaaacctcttttgttcgggaataacagggtccacttgtggtcctctgcatgtaccgttcgaata

SEQ ID NO: 688 - DNA, 490 bp, Unknown
  Ascusbbf_991, encodes 16S rRNA
agagtttgatcatggctcaggatgaacgctggcggcgtgcttaacacatgcaagtcgaacgaagctcttacgttgattctttcgggatgaagtgtaagatgacttagtggcggacgggtgagtaacgcgtgaggaacctgccttgcagtggggaataacagatggaaacgtctgctaataccgcataatacgaagggaccgcatgatttcttcgtcaaagatttatcgctgtgagatggcctcgcgtctgattagctggttggtgaggtaacggctcaccaaggcgacgatcagtagccggactgagaggttgatcggccacattgggactgagacacggcccagactcctacgggaggcagcagtggggaatattgggcaatgggcgcaagcctgacccagcaacgccgcgtgaaggaagaaggctttcgggttgtaaacttcttttatcagggacgataatgacggtacctgatgaataagctccggc

SEQ ID NO: 689 - DNA, 490 bp, Unknown
  Ascusbbf_3848, encodes 16S rRNA
agagtttgatcatggctcagaacgaacgctggcggcaggcttaacacatgcaagttgagcgggattgattagtagcttgctattaatcatgagagcagcgcactggtgagtaacacgtgggaacataccttttggtgggggacaacagttggaaacgactgctaataccgcataagccctgagggggaaaggagcaatttgccgaaagattggcccgcggaagattaggtagtaggtggggcaacggcctacctagccgacgatctatagctggtctgagaggacgatcagccacattggaactgagacacggtccagactcctacgggaggcagcagtgaggaatattgggcaatggaggaaactctgacccagccatgccgcgtgagtgaagaaggttttcggattgtaaagctctttcggacgggaagataatgacggtaccgtctaaagaagcaccggctaacttcgtgccagcagccgcggtaat

SEQ ID NO: 690 - DNA, 488 bp, Unknown
  Ascusbbf_3662, encodes 16S rRNA
agagtttgatcatggctcaggacgaacgctggcggcgtgcttaacacatgcaagtcgagcgggaaacttcggtttccagcggcggacgggtgagtaacacgtgggcaacctgcctcacaatgagggatagccttccgaaaggaagattaatacctcataacacaagagaaacgcatgtttctcttgccaaagaatttcgttgtgagatgggcccgcggcgcattagcttgttggtgaggtaacggctcaccaaggcttcgatgcgtagccgacctgagagggtgatcggccacattggaactgagacacggtccagactcctacgggaggcagcagtggggaatattgcacaatggaggaaactctgatgcagcaacgccgcgtgagtgatgaaggtcttcggattgtaaagctctgtcttctgggacgataatgacggtaccagaggaggaagccacggctaactacgtgccagcagccgcggtaat

SEQ ID NO: 691 - DNA, 472 bp, Unknown
  Ascusbbf_4296, encodes 16S rRNA
agagtttgatcatggctcagagcgaacgctggcggcatgcttaacacatgcaagtcgcacggatctttcgggattagtggcggacgggtgagtaacgcgtagggatctatccatgggtgggggacaactccgggaaactggagctaataccgcatgatacctgagggtcaaaggcgcaagtcgcctgtggaggaacctgcgttcgattagctagttggtggggtaaaggcctaccaaggcgatgatcgatagctggtttgagaggatgatcagccacactgggactgagacacggcccagactcctacgggaggcagcagtggggaatattggacaatgggcgaaagcctgatccagcaatgccgcgtgtgtgaagaaggtcttcggattgtaaagcactttcgacggggacgatgatgacggtacccgtagaagaagccccggctaacttcgtgccagcagccgcggtaat

SEQ ID NO: 692 - DNA, 490 bp, Unknown
  Ascusbbf_6375, encodes 16S rRNA
agagtttgatcctggctcaggacgaacgctggcggcgtgcctaacacatgcaagtcgagcgagaatttctgaaatgaattcttcggaaggaattttgggaaggaaagcggcggacgggtgagtaacgcgtgagtaacctgcctatcagagggggacaacatttcgaaaggaatgctaataccgcatgaaattgtattatcgcatgatagaacaatcaaagatttatcgctgatagatggactcgcgtctgattagatagttggtggggtaaaggcctaccaagtcgacgatcagtagccgaactgagaggttgatcggccacattgggactgagacacggcccagactcctacgggaggcagcagtggggaatattgcgcaatgggggcaaccctgacgcagcaacgccgcgtgaaggatgaaggttttcggattgtaaacttctttaagtgtggaagaagatgacggtacacacagaataagccacggc

SEQ ID NO: 693 - DNA, 490 bp, Unknown
  Ascusbbf_12586, encodes 16S rRNA
agagtttgatcatggctcaggatgaacgctggcggcgtgcctaacacatgcaagtcgagcgagaagctcatgatcgaaacttcggttgattgattgagtggaaagcggcggacgggtgagtaacgcgtaggcaacctgccccttgcagagggatagcctcgggaaaccgggattaaaacctcataatgcgtttcgaagacatctttgaaacgccaaagatttatcggcaagggatgggcctgcgtctgattagttagttggtggggtaacggcctaccaaggcagcgatcagtagccgacctgagagggtgatcggccacattggaactgagacacggtccaaactcctacgggaggcagcagtggggaatattgcacaatgggggaaaccctgatgcagcaacgccgcgtgaaggatgaaggcccttgggtcgtaaacttctgttctaagggaagataatgacggtaccttaggagcaagtcccggcta

SEQ ID NO: 694 - DNA, 490 bp, Unknown
  Ascusbbf_8092, encodes 16S rRNA
agagtttgatcatggctcaggatgaacgctggcggcgtgcctaacacatgcaagtcgaacgaagcacattccttcggggatgtgactgagtggcggacgggtgagtaacgcgtgggtaacctgccctttacagggggacaacagttagaaatgactgctaataccgcataagcgcacagggaggcatcttcccgtgtgaaaaacttaggtggtaaaggatgggcccgcgtctgattagctagttggcagggtaaaggcctaccaaggcgacgatcagtagccggtctgagaggatgaacggccacattggaactgagacacggtccaaactcctacgggaggcagcagtgagggatattgcacaatggggggaaccctgatgcagcaacgccgcgtgggtgaagaagtatttcgatatgtaaagccctatcagcagggaagataatgacggtacctgactaagaagctccggctaaatacgtgccagcag

SEQ ID NO: 695 - DNA, 490 bp, Unknown
  Ascusbbf_21947, encodes 16S rRNA
agagtttgatcctggctcaggatgaacgctagctacaggcttaacacatgcaagtcgaggggcagcatgaacttagcttgctaagtttgatggcgaccggcgcacgggtgagtaacgcgtatccaacctgccccatagtcagggacagcccggcgaaagtcggattaatacctgatgttctcccttgagggcctctgacggggagcaaagattcatcgctatgggatggggatgcgtaggattaggcagtcggcggggtaacggcccaccgagccgacgatccttaggggttctgagaggaaggtcccccacactggtactgagacacggaccagactcctacgggaggcagcagtgaggaatattggtcaatgggcggtagcctgaaccagccaagtagcgtgcaggaagacggccctacgggttgtaaactgcttttgccgggggataacgggcgtcacgtgtggcgccgtgcaggtacccggcgaat

SEQ ID NO: 696 - DNA, 490 bp, Unknown
  Ascusbbf_18750, encodes 16S rRNA
agagtttgatcctggctcaggatgaacgctagctacaggcttaacacatgcaagtcgaggggcagcatggaggtagcttgctatctccgatggcgaccggcgcacgggtgagtaacgcgtatccaaccttccctgaggtaggggacagcccggtgaaaaccggattaataccctatgttgtcacgaaaaggcatctgggcgtgacgaaagattgatcgcctcaggatggggatgcgtctgattaggcagtaggcggggcaacggcccacctagccaccgatcagtaggggttctgagaggaaggtcccccacattggaactgagacacggtccaaactcctacgggaggcagcagtgaggaatattggtcaatgggcggaagcctgaaccagccaagtagcgtgagggatgacggccctacgggttgtaaacctcttttatgcggggataaccgcccccacgcgtgggggtctgcaggtaccgcatgaat

SEQ ID NO: 697 - DNA, 490 bp, Unknown
  Ascusbbf_61382, encodes 16S rRNA
agagtttgatcctggctcaggatgaacgctagcggcaggcttaacacatgcaagtcgaggggcagcgcgggtagcaatacctggcggcgaccggcggaagggtgcgtaacacgtgagcaacttgcccgtcacagggggataagcgctggaaacggtgtctaatatcccataacatgtcgtatcgcatggtacgacattgaaaactccggtggtgacggatgggctcgcggggcattaggtagacggcggggtaacggcccaccgtgccgacgatgtctaggggttctgagaggaagatcccccacactgggactgagacacggcccagactcctacgggaggcagcagtgaggaatattggacaatgggggcaaccctgatccagccatgccgcgtgcgggactaaggccctatgggtcgtaaaccgcttttgttggggagcaataaggtgtacgcgtacaccgatgagagtacctggcgaataagcatc

SEQ ID NO: 698 - DNA, 489 bp, Unknown
  Ascusbbf_9708, encodes 16S rRNA
agagtttgatcctggctcagaacgaacgctggcggcaggcttaacacatgcaagttgaacgggaattgatggtagcttgctatcattgaggagagtagcgcactggtgagtaacacgtgggaacgtacatttcagtgggggataacagagggaaacttctgctaataccgcatacgccctgagggggaaaggagaaatttgctgagatatcggcccgcggaagattaggtagttggtggggtaaaggcctaccaagcctacgatctatagctggtctgagaggacgatcagccacattggaactgagacacggtccagactcctacgggaggcagcagtgaggaatattgggcaatggagggaactctgacccagccatgccgcgtgagtgagaaggttttaggattgtaaagctctttcgggtgagaagatgatgacggtatcaccagaagaagccccggcaaacttcgtgccagcagccgcggtaat

SEQ ID NO: 699 - DNA, 490 bp, Unknown
  Ascusbbf_14158, encodes 16S rRNA
agagtttgatcatggctcaggatgaacgctggcggcgtgcctaacacatgcaagtcgaacgggaactccaagatgaagcttcggcagatttttggaaattctagtggcggacgggtgagtaacgcgtgggtaacctgcccttaagaggggaataacattgagaaatcagtgctaatacaccatatgcttacggtgtcgcatgacacagtgaggaaaggaatttcgcttaaggatggacccgcgtttgattagccagttggcagggtaacggcctaccaaagcgacgatcaatagccggcctgagagggtgaacggccacattggaactgagacacggtccaaactcctacgggaggcagcagtggggagtattgcacaatgggcgcaagcctgatgcagcaacgccgcgtgagtgaagaagtatttcggtatgtaaagctctatcgatggggaataaaatgaaggtacccaagtaagaagccccggctaa

SEQ ID NO: 700 - DNA, 490 bp, Unknown
  Ascusbbf_22209, encodes 16S rRNA
agagtttgatcctggctcaggatgaacgctagctacaggcttaacacatgcaagtcgaggggcagcattgaggttgcttgcaacttcagatggcgaccggcgaatgggtgagtaacgcgtatccaacctgccgtgtgctctgggatagcccttagaaatgaggattaatacgagatagtctcctttgatcgcctgagattaggagtaaagattcatcggcacacgatggggatgcgttccattagatagttggcggggtaacggcccaccaagtctatgatggataggggttctgagaggaaggtcccccacactggtactgagacacggaccagactcctacgggaggcagcagtgaggaatattggtcaatgggcgggagcctgaaccagccaagtagcgtgaaggaagacggccctacgggttgtaaacttcttttgtcggggaataaccgccactacgtgtagtggtctgcatgtacccggtgaat

SEQ ID NO: 701 - DNA, 490 bp, Unknown
  Ascusbbf_712027, encodes 16S rRNA
agagtttgatcctggctcagaacgaacgctggcggcgtgcttaacacatgcaagtcgaacgcgaaatcggcttcggtcgagagtagagtggcgcacgggtgagtaacgcgtagataacctgtcttcatattcgggataacacgccgaaaggggtactaataccggatacgcttgtatttcataggcaaggcaaggaaaggtggcctctacatgtaagctactgtatgaagaggggtctgcgtaccattagctagtaggtggggtaatggcctacctaggcgacgatggttagcgggtctgggaggatgatccgccacactggcactggaatacgggccagactcctacgggaggcagcagtgaggaatattgcgcaatgggggcaaccctgacgcagcgacgccgcgtgagtgaggaaggtcttcggatcgtaaagctctgtcaagagggaagaagtgcataatggtcaatacccgttatgtttgacggt

SEQ ID NO: 702 - DNA, 490 bp, Unknown
  Ascusbbf_1342259, encodes 16S rRNA
agagtttgatcctggctcagaacgaacgctggcggcgcgttttaagcatgcaagtcgagcggcaaggacttcggtccccagagcggcggacgggtgagtaacacgtggataatctgccctgcagtccggaataccccatggaaacatgggctaatgccggatgcgagatggaggcgatggccttcatgggaaagctcccacgggagcgctgcaggatgagtccgcggcccattagctggatggcggggtaaaggcccaccatggcgccgatgggtagccggcctgtgagggtggacggccaaatgggagctgggacacggtccagactctaacgggaggcagcagctaagaagcttccaaaatggacggaagtctgagggagcgacgccgcgtggacgatgaaggccgtaaggtgggaaagtccttttatggagggagaataaccgcttcagggaatgggagcgggatgacgtgaatccatgaataagcc

SEQ ID NO: 703 - DNA, 490 bp, Unknown
  Ascusbbf_74852, encodes 16S rRNA
agagtttgatcatggctcaggatgaacgctggcggcgtgcctaatacatgcaagtcgaacgaacttccgttaattgattatgacgtgcttgcactgaatgagattttaacacgaagtgagtggcggacgggtgagtaacacgtgggtaacctgcccagaagcaggggataacacctggaaacagatgctaataccgtataacagagaaaaccgcctggttttcttttaaaagatggctctgctatcacttctggatggacccgcggcgcattagctagttggtgaggtaacggctcaccaaggcgatgatgcgtagccgacctgagagggtaatcggccacattgggactgagacacggcccagactcctacgggaggcagcagtagggaatcttccacaatggacgcaagtctgatggagcaacgccgcgtgagtgaagaagggtttcggctcgtaaagctctgttgttaaagaagaacgtgggtgaga

SEQ ID NO: 704 - DNA, 490 bp, Unknown
  Ascusbbf_1698580, encodes 16S rRNA
agagtttgatcatggctcaggatgaacgccggcggtgtgcctaatacatgcaagtcgaacgcgttggcccaactgattggacgtgcttgcacggacttgacgttggtttaccagcgagtggcggacgggtgagtaacacgtaggtaacctgccccaaagcgggggataacatttggaaacagatgctaataccgcataacaatttgaatcgcatgattcaaatttaaaagatggcttcggctatcactttgggatggacctgcggcgcattagcttgttggtagggtaacggcctaccaaggctgtgatgcgtagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttagagaagaacgtgcgtgagag

SEQ ID NO: 705 - DNA, 215 bp, Unknown
  Ascusbbf_6721, encodes 16S rRNA
agagtttgatcctggctcaggatgaacgctagctacaggcttaacacatgcaagtcgaggggaaaccctgatgcagccatgccgcgtgtgtgaagaaggccttcgggttgtaaagcacttttgcattcgaggaagacagcacgtaaataaacgtgttatttgacgttagagtgtgaataagcaccggcaaactccgtgccagcagccgcggtaat

SEQ ID NO: 706 - DNA, 208 bp, Unknown
  Ascusbbf_37998, encodes 16S rRNA
agagtttgatcctggctcaggacgaacgctggcggcgtgcttaacaatgggcgaaagcctgacggagcaacgccgcgtgagtgaagaaggtcttcggatcgtaaagctctgttgtcggggacgaatgttgaggcctagaacataggtttcaaatgacggtacctgacgaggaagccacggctaactacgtgccagcagccgcggtaat

SEQ ID NO: 707 - DNA, 490 bp, Unknown
  Ascusbbf_103977, encodes 16S rRNA
agagtttgatcctggctcaggatgaacgctagctacaggcttaacacatgcaagtcgaggggcagcgggggcgtagcaatacgcctgccggcgaccggcgcacgggtgagtaacgcgtatccaacctcccccccagtaggggatagcccggcgaaagtcggattaataccctatgtcgtccaggacgggcatcttttccggacgaaagattgatcgctgggggatggggatgcgtctgattaggcagtcggcggggtaacggcccaccgagccttcgatcagtaggggttctgagaggaaggtcccccacattggtactgagacacggaccaaactcctacgggaggcagcagtgaggaatattggtcaatgggcgcgagcctgaaccagccaagtagcgtgcaggatgacggccctacgggttgtaaactgcttttgccgggggataaagttcgccacgcgtggcgttttgcatgtacccggagaataa

SEQ ID NO: 708 - DNA, 490 bp, Unknown
  Ascusbbf_116614, encodes 16S rRNA
agagtttgatcctggctcaggatgaacgctagctacaggcttaacacatgcaagtcgcggggcagcgtggggatggcttgccatctctgacggcgaccggcgcacgggtgagtaacgcgtatccaacctgccccttaccacgggatagccctccgaaagggggattaataccgtatgtggccacgagacggcatccgaccgtggctaaaggctcagcggtaagggatggggatgcgtctgattaggtagtcggcggggtaacggcccaccgagccatcgatcagtaggggttctgagaggaaggtcccccacattggaactgagacacggtccaaactcctacgggaggcagcagtgaggaatattggtcaatgggcgcgagcctgaaccagccaagtagcgtgagggatgacggccctacgggttgtaaacctcttttatgcggggataaagtgagccacgtgtggctttttgcaggtaccgcatgaat

SEQ ID NO: 709 - DNA, 490 bp, Unknown
  Ascusbbf_91322, encodes 16S rRNA
agagtttgatcctggctcagaacgaacgctggcggcgcgttttaagcatgcaagtcgagcggcaagggccttcgggcccctagagcggcggacgggtgagtaacacgtggacaatctgccccccggcccgggatagcccagggaaacctggattaataccggatgagacgggacctgcgatggcgggatccgggaaaggcgctacggcgccgccgggggatgagtctgcgtcccattagctagacggcggggtaacggcccaccgtggcgacgatgggtagccggcctgagagggtggacggccacattggaactgagacacggtccagactcctacgggaggcagcagctaagaatcttccgcaatgggcgaaagcctgacggagcgacgccgcgtgaacgaagaaggccgtgaggttgtaaagttcttttcgggagggggaacaaccgtggcagggaatggccgcgggatgacgtgaatcccggaata

SEQ ID NO: 710 - DNA, 490 bp, Unknown
  Ascusbbf_188938, encodes 16S rRNA
agagtttgatcctggctcaggacgaacgctggcggcgtgcctaatacatgcaagtcgagcggactttcaagaagcttgctttttgaaagttagcggcggacgggtgagtaacacgtgggcaacctgcctgcaagacggggataactccgggaaaccggggctaataccggataatatcttccttcgcatgaaggaaggttgaaaggcggcgcaagctgccgcttgcagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggatcgtaaagctctgttgtcagggaagaacaagtaccgttcgaacagggcggtaccttgacggtac

SEQ ID NO: 711 - DNA, 490 bp, Unknown
  Ascusbbf_124387, encodes 16S rRNA
agagtttgatcctggctcaggatgaacgctggcggcgtgcctaacacatgcaagtcgaacggagagccaatgacggagttttcggacaacggatttggtttcttagtggcggacgggtgagtaacgcgtgagcaacctgccttggagtggggaataacagctggaaacagttgctaataccgcatgatgcagcgaggggacatcctcttgctgccaaagatttatcgctctgagatggactcgcgtctgattagctggttggcggggtaacggcccaccaaggcgacgatcagtagccggactgagaggttgaccggccacattgggactgagatacggcccagactcctacgggaggcagcagtggggaatattgggcaatgggcgaaagcctgacccagcaacgccgcgtgaaggaagaaggccctcgggttgtaaacttcttttatcagggacgaaacaaatgacggtacctgatgaataagccacg

SEQ ID NO: 712 - DNA, 490 bp, Unknown
  Ascusbbf_1597649, encodes 16S rRNA
agagtttgatcatggctcagaatgaacgttggcggcgtggattaggcatgcaagtcgcgcgataattttccttcggggagaggacagcggcgaaagggagagtaacgcgtggttacataccctcgggaccgggatagtagcgggaaactgctagtaataccggataatatctttggatcaaaggtgtgattccgcccgaggattggaccgcgttctattagcttgttggcggggtaatggcccaccaaggcgacgatggataccgggtgtgagagcatggcccggctcaccgggactgagacactgcccagacacctacgggtggctgcagtcgagagtcttcggcaatgggggcaaccctgaccgagcgacgccgcgtgcgggatgaaggccttcgggttgtaaaccgctgtcagttgggaggaagtatcagggggttatccccttggtttgaccgatcttcagaggaaggacgagctaagttcgtgcc

SEQ ID NO: 713 - DNA, 490 bp, Unknown
  Ascusbbf_419534, encodes 16S rRNA
agagtttgatcctggctcaggatgaacgctggcggcgtgcctaacacatgcaagtcgagcgggaatctgttgattgagacttcggtggattgatgcagaggatagcggcggacgggtgagtaacgcgtaggtaacctgccccttacacagggatagcctcgggaaactgggattaatacctgataatgcgatggagtcacatggctttatcgccaaagatttatcggtgagggatggacctgcgtctgattagctagttggtgaggtaacggcccaccaaggcaacgatcagtagccgacctgagagggtaatcggccacattggaactgagacacggtccaaactcctacgggaggcagcagtggggaatattgcacaatgggcgcaagcctgatgcagcaacgccgcgtgagcgaagaaggtcttcggatcgtaaagctctgtccttaggaacgaagaagtgacggtacctgaggaggaagccccggc

SEQ ID NO: 714 - DNA, 490 bp, Unknown
  Ascusbbf_134263, encodes 16S rRNA
agagtttgatcatggctcagaacgaacgctggcggcgcgtcttaagcatgcaagtcgagcgggattatggtgcttgcaccatatgagagcggcggactggtgagtaacgcgtaggtgacgaaccccccggacggggacagcctctagaaatagagggtaataccggatgaagcgtgcagtgttagaggctgcacgtgaaagcagctccggctgcgccgggggatcggcctgcgtactattagcttgttggcggggtaacggcccaccaaggcgacgatagttatccggcctgagagggtgagcggacacattgggactgagatacggcccagactcctacgggaggcagcagctaagaatattccgcaatggggggaaccccgacggagcgacgccgcgtggacgatgaaggccgtgaggttgtaaagtccttttaggcatgaagaataagtgcgggagggaatgcccgcatggtgacggtagtgcctga

SEQ ID NO: 715 - DNA, 490 bp, Unknown
  Ascusbbf_119712, encodes 16S rRNA
agagtttgatcatggctcaggatgaacgctggcggcgtgcctaatacatgcaagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacc

SEQ ID NO: 716 - DNA, 490 bp, Unknown
  Ascusbbf_195449, encodes 16S rRNA
agagtttgatcctggctcagattgaacgctggcggcaggcttaacacatgcaagtcgagcggggagatgtagcttgctacatatcctagcggcggacgggtgagtaatgcttaggaatctgcctattagtgggggacaacgttccgaaaggaacgctaataccgcatacgccctacgggggaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttttggttgtaaagcactttaagcgaggaggaggctcctttagttaatacctaaagtgagtggacgttactcgcagaataagca

SEQ ID NO: 717 - DNA, 490 bp, Unknown
  Ascusbbf_54963, encodes 16S rRNA
agagtttgatcctggctcagagtgaacgctggcggcgtgcctaatacatgcaagtcgaacggacgactgggagcttgctcctggaagttagtggcgcacgggtgagtaatgtatagctaatctgccctatgctggaggacaacagttagaaatgactgctaatactccatactccttcttaacataagttaagttgggaaagtttttcggcataggatgaggctatatcgtatcagctagttggtgaggtaatggctcaccaaggctatgacgcgtaactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttgttagggaagaaccatgacggtacctaacgaataagcaccggctaactccgtgccagcagc

SEQ ID NO: 718 - DNA, 490 bp, Unknown
  Ascusbbf_141536, encodes 16S rRNA
agagtttgatcatggctcaggacgaacgctggcggcgtgcctaacacatgcaagtcgaacggagttcttacagatgaagcttcggccgatgaagtttgaacttagtggcggacgggtgagtaacgcgtgagcaacctgccttacagagggggacaacagttggaaacgactgctaataccgcataacgtatttggggggcatcctctggataccaaagatttatcgctgtaagatgggctcgcgtatgattagatagttggtgaggtaacggctcaccaagtcgacgatcattagccggactgagaggttgaacggccacattgggactgagatacggcccagactcctacgggaggcagcagtggggaatattgcgcaatgggggcaaccctgacgcagcaacgccgcgtgaaggatgaaggttttcggattgtaaacttcttttgtcgaggacgatagtgacggtactcgacgaataagccacggcta

SEQ ID NO: 719 - DNA, 490 bp, Unknown
  Ascusbbf_58853, encodes 16S rRNA
agagtttgatcctggctcagattgaacgctggcggcatgctttacacatgcaagtcggacggcagcgggggtgcttgcacctgccggcgagtggcgaacgggtgagtaatgcattggaacgtaccgagtagtgggggataaccagtcgaaagattggctaataccgcatacgacctgagggtgaaagcgggggatcttcggacctcgcgctatttgagcggccaatgtctgattaggtagttggtggggtaaaggcctaccaagccgacgatcagtagcgggtctgagaggatgatccgccacactgggactgagacacggcccagactcctacgggaggcagcagtggggaattttggacaatgggcgaaagcctgatccagccatgccgcgtgtctgaagaaggccttcgggttgtaaaggacttttgtcagggaagaaaagcaggatgttaataccattttgtgatgacggtacctgaagaataagc

SEQ ID NO: 720 - DNA, 490 bp, Unknown
  Ascusbbf_285801, encodes 16S rRNA
agagtttgatcctggctcaggatgaacgctagcgataggcctaacacatgcaagtcgaggggcagcatagagtagcaatactttgatggcgaccggcgcacgggtgagtaacacgtatgcaacctacctacatcaggggaataacccggagaaattcggactaataccgcataatacagggatgccgcatggtaatatttgttaaagatttatcggatgtagatgggcatgcgttccattagctagttggtaaggtaacggcttaccaaggcaacgatggataggggaactgagaggtttgtcccccacactggaactgagacacggaccagactcctacgggaggcagcagtgaggaatattggtcaatggacgagagtctgaaccagccaaatcgcgtgaaggaagactgccctacgggttgtaaacttcttttgtacaggaataaaagacattacgtgtagtgtattgcatgtactgtacgaataag

SEQ ID NO: 721 - DNA, 490 bp, Unknown
  Ascusbbf_68846, encodes 16S rRNA
agagtttgatcatggctcaggatgaacgctagctacaggcttaacacatgcaagtcgaggggcagcatgattctagcttgctggaattgatggcgaccggcgcacgggtgagtaacgcgtatccaaccttccccttagtagggcatagcccgtagaaatgcggattaataccctatgttgttcgaagcgggcatctaattcgaaccaaaggttctccgctaagggatggggatgcgtctgattaggaagtaggcggggcaacggcccacctatccatcgatcagtaggggttctgagaggaaggtcccccacactggtactgagacacggaccagactcctacgggaggcagcagtgaggaatattggtcaatgggcggaagcctgaaccagccaagtagcgtgcaggacgacggccctacgggttgtaaactgcttttacggggggataaacggcgggacttgtcctgccctgcaggtaccccgtgaat

SEQ ID NO: 722 - DNA, 490 bp, Unknown
  Ascusbbf_173328, encodes 16S rRNA
agagtttgatcatggctcaggatgaacgctggcggcgtgcttaacacatgcaagtcgaacggggttatgcagagcagagatttcggtcaaagcactgcataacctagtggcggacgggtgagtaacgcgtgggtaacctgccatatacagggggataacacttagaaataggtgctaaaaccgcataagcgcacagcatcgcatgatgcagtgtgaaaaactccggtggtatatgatggacccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaatcaatgacggtacctgactaagaagcccc

SEQ ID NO: 723 - DNA, 470 bp, Unknown
  Ascusbbf_84664, encodes 16S rRNA
agagtttgatcctggctcagaacgaacgctggcggcaggcctaacacatgcaagtcgaacgcccacttcggtgggagtggcagacgggtgagtaacacgtgggaacctacctgatggtacggaataacacagggaaacttgtgctaataccgtatgtgcccttcgggggaaagatttatcgccatcagatgggcccgcgtcggattagctagttggtggggtaatggcctaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagctgggaagataatgacggtaccagcagaagaagccccggctaacttcgtgccagcagccgcggtaat

SEQ ID NO: 724 - DNA, 490 bp, Unknown
  Ascusbbf_76622, encodes 16S rRNA
agagtttgatcatggctcagaacgaacgctggcggtatgcttaacacatgcaagtcgtacgagaaagttcttcggaatgagtaaagtggcgtacgggtgagtaatgtatgggaatctacccagtaatgaggaataagcactggaaacggtgtctaataccacatactaccgatttatcgggaaagatttaaccttcgggttaagttgttattggatgagcccatatctgattagctagttggtggggtaaaggcctaccaaggcgatgatcagtagctgatctgagagggtgatcagccacattgggactgcgacacggcccaaactcctacgggaggcagcagtgaggaatattggacaatgggcgaaagcctgatccagcaataccgcgtgaatgatgaaggccttcgggttgtaaaattcttttagtggggaggataatgacgttacccacagaaaaagcaccggctaacttcgtgccagcagccgc

SEQ ID NO: 725 - DNA, 470 bp, Unknown
  Ascusbbf_37970, encodes 16S rRNA
agagtttgatcatggctcagaacgaacgctggcggcaggcctaacacatgcaagtcgaacgccgtagcaatacggagtggcagacgggtgagtaacacgtgggaacatgccctttggttcggaataactcagggaaacttgagctaataccggataagcccgagaggggaaagatttatcgccgaaggattggcccgcgtccgattagctagttggtgaggtaatggctcaccaaggcgacgatcggtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcgccagggacgataatgacggtacctggataagaagccccggctaacttcgtgccagcagccgcggtaat

SEQ ID NO: 726 - DNA, 470 bp, Unknown
  Ascusbbf_81114, encodes 16S rRNA
agagtttgatcatggctcagaacgaacgctggcggcaggcctaacacatgcaagtcgaacgcactcttcggagtgagtggcagacgggtgagtaacacgtgggaatctacccggtggtacggaataactcagggaaacttgtgctaataccgtataagccctcagggggaaagatttatcgccatcggatgagcccgcgtcggattagctagttggcggggtaatggcccaccaaggcgacgatccgtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcagcggggaagataatgacggtacccgcagaagaagccccggctaacttcgtgccagcagccgcggtaat

SEQ ID NO: 727 - DNA, 490 bp, Unknown
  Ascusbbf_106872, encodes 16S rRNA
agagtttgatcctggctcaggatgaacgctagcggcaggcttaacacatgcaagtcgaggggtataagtagcttgctacttagagaccggcaaacgggtgcggaacacgtacgcaatctgcccttatctcagggatagcccatagaaatgtggattaatacctgatagtattatttggtggcatcaccaggtaattaaagatttattggatagggatgagcgtgcgtaagattaggtagttggtagggtaacggcctaccaagcccacgatctttagctgatgtgagagcatgatcagccacacgggcactgagacacgggcccgactcctacgggaggcagcagtgaggaatattggtcaatggacggaagtctgaaccagccatgccgcgtgaaggatgaaggcgttctgcgttgtaaacttcttttatctaagaagaaatcacatttttctaaatgtgttgacggtattagatgaataagcaccggc

SEQ ID NO: 728 - DNA, 490 bp, Unknown
  Ascusbbf_318862, encodes 16S rRNA
agagtttgatcctggctcaggatgaacgctggcggcgtgcttaacacatgcaagtcgaacggacctgtgacaccgaagcggatttagcttgctattgaagcttcaccgttgcaggttagtggcggacgggtgagtaacgcgtgggcaacctgcctttatccgggggataacagttagaaatgactgctaataccgcataagcgcacgaatgggcatccatttgtgtgaaaaactccggtggatagagatgggcccgcgttagattagccagttggcggggtaacggcccaccaaagcgacgatctatagccggcctgagagggcgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaaaggacggtacctgcac

SEQ ID NO: 729 - DNA, 490 bp, Unknown
  Ascusbbf_58053, encodes 16S rRNA
agagtttgatcatggctcaggatgaacgctggcggcgtgcttaacacatgcaagtcgaacgaggtccatggagcttgctccggaagacctagtggcgaacgggtgcgtaacacgtgagaaacctgccccgatctctgggataacagttggaaacgactgctaataccggatgccgtcacaccgcttcatggcggagtgccgaaagatttatcggattgggagggtctcgcggcctatcagctagttggagaggtaacggctcaccaaggcatcgacgggtagctggtctgagaggatgatcagccacactgggactgagacacggcccagactcctacgggaggcagcagtggggaatcttgcacaatgggcgaaagcctgatgcagcaacgccgcgtgcgggatgaaggccctagggttgtaaaccgctttcagtagggaagaaaatgacggtacctacagaagaaggtgcggccaactacgtgccagc

SEQ ID NO: 730 - DNA, 469 bp, Unknown
  Ascusbbf_401888, encodes 16S rRNA
agagtttgatcatggctcagaacgaacgctggcggcaggcttaacacatgcaagtcgaacggtctcttcggaggcagtggcagacgggtgagtaacgcgtgggaatctacctagttctacggaacaacagagggaaacttctgctaataccgtatacgccctacgggggaaagatttatcggaattagatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgaaagcctgatccagccatgccgcgtgagtgatgaaggccttagggttgtaaagctctttcagtagggaagataatgacggtacctacagaagaagccccggctaacttcgtgccagcagccgcggtat

SEQ ID NO: 731 - DNA, 490 bp, Unknown
  Ascusbbf_136860, encodes 16S rRNA
agagtttgatcctggctcaggacgaacgctggcggcgtgcttaacacatgcaagtcgagcgaagcccttgccttcgggtgaggtgacttagcggcgaacgggtgagtaacacgtgggcaacctgcccttagctctgggataagcgatggaaacgtcgtctaatactggatatgacatatggacgcatgttctgtgtgtggaaagatttatcggctaaggatgggcccgcggcctatcagcttgttggtggggtaatggcctaccaaggcggcgacgggtaaccggcctgagagggcgaccggtcacactgggactgagatacggcccagactcctacgggaggcagcagtggggaatattgcacaatgggcgaaagcctgatgcagcgacgccgcgtgagggatgacggccttcgggttgtaaacctctttcagcagggacgaagcgaaagtgacggtacctgcagaagaagcgccggccaactacgtgc

SEQ ID NO: 732 - DNA, 490 bp, Unknown
  Ascusbbf_252845, encodes 16S rRNA
agagtttgatcctggctcaggacgaacgctggcggcacgcttaacacatgcaagtcgaacggtgaaatggtgcttgcaccatggatcagtggcggacgggtgagtaacacgtgagcaatctgccttcgggtgggggataccagttggaaacgactgttaataccgcataacatagcgaaaccgcatgattttgctatcaaagatttattgcctgaagatgagctcgcgtctgattagctagttggtgaggtaacggcccaccaaggcgacgatcagtagccggactgagaggttgaacggccacattgggactgagacacggcccagactcctacgggaggcagcagtggggaatattgcacaatgggcgcaagcctgatgcagcgatgccgcgtgagggaagaaggttttcggattgtaaacctctgttgacagggacgataatgacggtacctgttcagaaagctccggctaactacgtgccagcagc

SEQ ID NO: 733 - DNA, 490 bp, Unknown
  Ascusbbf_114580, encodes 16S rRNA
agagtttgatcctggctcaggatgaacgctggcggcgtgcttaacacatgcaagtcgaacgaagcaggtttgaaggagacttcggtcaatggatgatctgacttagtggcggacgggtgagtaacgcgtgggcaacctgcctcatggagggggacaacagttggaaacgactgctaataccgcataagaccaagcatcgcatgatgcaatggtaaaagatttatcgccatgagatggacccgcgttagattagctagttggtgaggtaacggctcaccaaggcgacgatctatagccgacctgagagggtgatcggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggcta

SEQ ID NO: 734 - DNA, 486 bp, Unknown
  Ascusbbf_72554, encodes 16S rRNA
agagtttgatcctggctcagggctaacgctggcggcgcgcctaacacatgcaagtcgaacgaaccttcgggttagtggcagacgggtgagtaatgcgtggataatgtgcctttttgctggggataccgtttcgaaaggaacgttaataccgaatgtgctgggttggtggcatcatcgacccagtaaactgttagggtgaaaagagcagtccgcgttctatcagcttgttggtggggtaatggcctaccaaggctacgacggataactggtctgagaggatgatcagtcacactggaactgagacacggtccagactcctacgggaggcagcagtgaggaatcttgcacaatgggcgaaagcctgatgcagcgacgccgcgtgagggacgacggccttcgggttgtaaacctctgtcagtggggaagaagtatgacggtacccactgaggaagcttcggctaactacgtgccagcagccgcggtaat

SEQ ID NO: 735 - DNA, 490 bp, Unknown
  Ascusbbf_358397, encodes 16S rRNA
agagtttgatcatggctcaggatcaacgctggcggcgtgcctaatgcatgcaagtcgaacgggcttttcttcggaggagtcacgtggcggacgggtgaggaacacgtgggcgacctaccctggggcgggggatagccgcgagaaatcgtggataattccgcatgtgctcccatcggggtgactgatgggaggaaaggtgtgcgcaagcacgccaccctaggcggggcctgcggccgattagctagttgggggggtaacggcttcccaaggcgatgatcggtagctggtctgagaggacggccagccacacggggactgagacacggccccgactcctacgggaggcagcagcaaggaatcttccgcaatgggcgaaagcctgacggagcaacgccgcgtgcgggatgacgcctttcggggtgtaaaccgcttttctgggggaagaagacggactttggtccgtttgacggtaccgcaggaagaaggaccg

SEQ ID NO: 736 - DNA, 490 bp, Unknown
  Ascusbbf_292034, encodes 16S rRNA
agagtttgatcatggctcaggatgaacgctggcggcgtgcctaacacatgcaagtcgaacggttaagccggcttcggccgggtatacagtggcgaacgggtgagtaacacgtgaccaacccgccccccgcaccgggacagccccgcgaaagcgcggttaataccggatacgccccccgctccgcatggcgcgggggggaaagcccaggcggcgggggatggggtcgcggcccatcaggtagtaggtcgggtagaggccgacctagccgacgacgggtagccgggttgagagaccgaccggccacattgggactgagatacggcccagactcctacgggaggcagcagtggggaatattgcgcaatgggggcaaccctgacgcagcaacgccgcgtgcgggacgaaggcgtccgcgtcgtaaaccgctttcagcagggaagacatcgacggtacctgcagaagaagccccggctaactacgtgccagcagc

SEQ ID NO: 737 - DNA, 468 bp, Unknown
  Ascusbbf_143991, encodes 16S rRNA
agagtttgatcctggctcagaacgaacgctggcggcaggcttaatacatgcaagtcgaggggcccgcaagggcaccggcgcacgggtgcgtaacgcgtgggaacatgcccttaggtgcggaacaacgtctggaaacggacgctaataccgcataatatcttcggatcaaagatttatcgcctaaggattggcccgcgttagattaggtagttggtagggtaatggcctaccaagccgacgatctatagctggtctgagaggatgatcagccacactgggactgagacacggcccagactcctacgggaggcagcagtaaggaatattggacaatgggcgaaagcctgatccagccatgccgcgtgagtgacgaaggccttagggttgtaaagctctttcaggtgcgaagataatgacagtaacaccagaagaagccccggctaaattcgtgccagcagccgcggtaat

SEQ ID NO: 738 - DNA, 468 bp, Unknown
  Ascusbbf_67298, encodes 16S rRNA
agagtttgatcctggctcagaacgaacgctggcggcaggcctaaaacatgcaagtcgaacgaaccttcgggttagtggcgcacgggtgcgtaacacgtgggaatgtgcccctgggtacggaataactcaccgaaaggtgtgctaataccgtataatgactccggtccaaagatttatcgcccagggatcagcccgcgtctgattaggtagttggtgaggtaagagctcaccaagccgacgatcagtagctggtttgagaggatgatcagccacactggaactgagacacggtccagactcctacgggaggcagcagttaggaatattgcgcaatgggggaaaccctgacgcagccatgccgcgtgagtgacgacggccttagggttgtaaagctctttcagatgcgaagataatgacggtaacatcagaagaagccccggctaaattcgtgccagcagccgcggtaat

SEQ ID NO: 739 - DNA, 490 bp, Unknown
  Ascusbbf_284423, encodes 16S rRNA
agagtttgatcctggctcaggatgaacgctagcgacaggcttaacacatgcaagtcgaggggcatcatgtaggttgcttgcgacctatgatggcgaccggcgcacgggtgagtaacgcgtatgcaaccttcccgcggcagggggatagcccggcgaaagtcggattaataccccatgagacaggggccccgcatggggatatttgttaaaggtttgttccggccgcggatgggcatgcgtaggattaggtagtcggcggggtgacggcccaccgagccatcgatccttaggggttctgagaggaaggtcccccacactggtactgagacacggaccagactcctacgggaggcagcagtgaggaatattggtcaatgggcggaagcctgaaccagccaagtcgcgtgagggatggaggccctacgggttgtaaacctcttttgccgggggataattggccgcacgcgtgcggcgttgcaggtacccggcg

SEQ ID NO: 740 - DNA, 490 bp, Unknown
  Ascusbbf_1878286, encodes 16S rRNA
agagtttgatcctggctcaggatgaacgctggcggcatgcctaagacatgcaagtcgaacgagacgaccttaagaaagctgcgtgcttgcacaaggctggaagaagatcatcgtctagtggcagacgggtgagtaacacgtgggtaacctaccttcaagttggggataacagttggaaacgactgctaataccgaataaggtattcgtactgaaaggagcctttaaagcttcgcttaaagatgggcctgcggcgtattaactagttggtgaggtaatggctcaccaaggtaacgatgcgtagccgaactgagaggttgaacggccacactgggactgagacacggcccagactcctacgggagacagcagttaggaatattcgtcaatgggggaaaccctgaacgagcaatgccgcgtgagtgatgaaggccctatgggttgtaaaactctgttgtatgggaagaacggccatattaggaaatgaatatg

SEQ ID NO: 741 - DNA, 490 bp, Unknown
  Ascusbbf_309401, encodes 16S rRNA
agagtttgatcctggctcaggacgaacgctggcggcgtgcttaacacatgcaagtcgaacggggtctattagcttgctaagacgacctagtggcaaacgggtgagtaacgcgtgggcaacctgccggaaagatggggacaacatcccgaaaggggtgctaataccgaatgttgtatatgaggcgcatgccttgtatattaaaggattctatccgctttccgatgggcccgcgtccgattagctagttgggggggtagaggcccaccaaggcgacgatcggtagccggcctgagagggtgaacggccacattgggactgagacacggcccagactcctacgggaggcagcagtggggaatcttccgcaatgggcgaaagcctgacggagcaacgccgcgtgggtgaagaaggtcttcggaccgtaaagccctgttgccggggaagagtggtctaagggaacttagacagggacggtacccggcgaggaagc

SEQ ID NO: 742 - DNA, 490 bp, Unknown
  Ascusbbf_240766, encodes 16S rRNA
agagtttgatcctggctcaggatgaacgctggcggcgtgcctaatacatgcaagtcgagcgagaaatgagcaaatgaaacttcggtagattttgctcatggacagcggcggacgggtgagtaacgcgtaggcaacctgcctcacacagagggatagccattggaaacgatgaataatacctcatgaaaccggaataacacatgttgatccggtcaaagatttatcggtgtgagatgggcctgcgtctgattaactagttggtgaggtaacggctcaccaaggtgacgatcagtagccgacctgagagggtgatcggccacattggaactgagacacggtccaaacttctacggaaggcagcagtagggaatcttgcacaatgggcgaaagcctgatgcagcaacgccgcgtgaaggatgaaggccttcgggttgtaaacttctgttcccggggacgaagaaagtgacggtacccgggcagcaagccccgg

SEQ ID NO: 743 - DNA, 468 bp, Unknown
  Ascusbbf_112256, encodes 16S rRNA
agagtttgatcatggctcagaacgaacgctggcggcaggcttaacacatgcaagtcgaacgccccgcaaggggagtggcagacgggtgagtaacgcgtgggaatctaccctgaactgcgggatagctccgggaaactggaattaataccgcatgtgccctgaggggcaaagattcatcggttcaggatgagcccgcgtccgattagctagttggtggggtaaaggcctaccaaggcgacgatcggtagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggggacgataatgacggtacccggagaagaagccccggctaacttcgtgccagcagccgcggtaat

SEQ ID NO: 744 - DNA, 470 bp, Unknown
  Ascusbbf_144979, encodes 16S rRNA
agagtttgatcctggctcagaacgaacgctggcggcatgcttaacacatgcaagtcgaacgcagtagcaatactgagtggcggacgggtgagtaacacgtgggaacttgccaaatggtgggggataactgtgggaaactgcagctaataccgcataagccctgagggggaaagatttattgccatttgataggcccgcgtcggattaggtagttggtagggtaaaggcctaccaagccgatgatccgtagctggtttgagaagatgaccagccacactgggactgagacacggcccagactcctacgggaggcagcagtggggaatattggacaatgggggaaaccctgatccagcgatgccgcgtgaatgaagaaggccttagggttgtaaagttctttcacctgtgacgatgatgacggtaacaggagaagaagccccggctaactccgtgccagcagccgcggtaat

SEQ ID NO: 745 - DNA, 490 bp, Unknown
  Ascusbbf_373934, encodes 16S rRNA
agagtttgatcctggctcaggatgaacgctggcggcgtgcttaacacatgcaagtcgaacgaacggaggagtgcttgcactccaaagttagtggcggacgggtgagtaacgcgtgggtaacctgcctcatgcagggggataacatctggaaacggatgctaataccgcataaactatggatgaccgcatggtcattatagcaaagatttatcggcatgagatggacccgcgttggattagctagttggtgagataacagcccaccaaggcgacgatccatagccggcctgagagggtgaacggccacattgggactgagacacggcccaaactcctacgggaggcagcagtggggaatattgcacaatgggcgaaagcctgatgcagcaacgccgcgtgaaggatgaaggtcttcggattgtaaacttctatcagcagggaagaataaatgacggtacctgactaagaagctccggctaactacgtgcca

SEQ ID NO: 746 - DNA, 490 bp, Unknown
  Ascusbbf_1638364, encodes 16S rRNA
agagtttgatcctggctcaggatgaacgctagcgacaggcttaacacatgcaagtcgaggggcagcgggggcgatggcaacattgcccgccggcgaccggcgcactggtgagtaacacgtatgcaacctgccccgcacagggggataacccagagaaatttggcctaataccccgtaacacccccgtgggcatccttggtggttgaaagaggcgactcggtgcgggatgggcatgcggcgcattagatagttggcggggcgacggcccaccaagtcgacgatgcgtaggggttctgagaggaaggtcccccacactggtactgagacacggaccagactcctacaggaggcagcagtgaggaatattggtcaatggacggaggtctgaaccagccaagtcgcgtgggggaagaaggtcctacggattgtaaaccccttttgccggggagtaaagggcgccacgcgtggcgcgttgagagtacccggagaa

SEQ ID NO: 747 - DNA, 490 bp, Unknown
  Ascusbbf_792053, encodes 16S rRNA
agagtttgatcatggctcagattgaacgctggcggcatgctttacacatgcaagtcggacggcagcgaagtagtgcttgcactactgtcggcgagtggcgaacgggtgagtaatgcattggaacgtaccgggtagtgggggataactagtcgaaagattagctaataccgcatacgacctgagggtgaaagcgggggatcttcggacctcgtgctatttgagcggccaatgtctgattagctagttggtggggtaaaggcccaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgttagggaagaaaaggcgattgctaatatcgattgctgctgacggtacctaaagaat

SEQ ID NO: 748 - DNA, 490 bp, Unknown
  Ascusbbf_1559547, encodes 16S rRNA
agagtttgatcatggctcaagatgaacgctagcggcaggcctaacacatgcaagtcgagcgggattcggtggcttgccaccgatgagagcggcgcacgggtgcgtaacgcgtatgcaacctaccttttgctacgggatagcccagggaaacttggattaacaccgtatagtatggttttctggcatcgggaaaccattaaaggctacggcaaaagatgggcatgcgtcctattagctagatggtgtggtaacggcataccatggcaacgataggtaggggccctgagagggggatcccccacactggtactgagacacggaccagactcctacgggaggcagcagtgaggaatattggacaatgggcggaagcctgatccagccatgccgcgtgcaggaagactgccctatgggttgtaaactgcttttatacgggaagaaacaccccctcgtgagggggcttgacggtaccgtaggaataaggatcggc

SEQ ID NO: 749 - DNA, 490 bp, Unknown
  Ascusbbf_1869505, encodes 16S rRNA
agagtttgatcatggctcagattgaacgctggcggcaggcttaacacatgcaagtcgaacggtaacagaaggaagcttgctttcttgctgacgagtggcggacgggtgagtaatgcttgggaatctggcttatggagggggataactactggaaacggtagctaataccgcgtaatgtctacggactaaaggatgggactttcgagccattcgccataagatgagcccaagtgggattaggtagttggtgaggtaaaggcttaccaagccgtcgatctctagctggtctgagaggatgaccagccacaccgggactgagacacggcccggactcctacgggaggcagcagtggggaatattgcacaatgggggaaaccctgatgcagccatgccgcgtgaatgaagaaggccttcgggttgtaaagttctttcggtgacgaggaaggcgggtattttaatagaatacctgattgacgttaatcacagaag

SEQ ID NO: 750 - DNA, 470 bp, Unknown
  Ascusbbf_1604153, encodes 16S rRNA
agagtttgatcatggctcagaacgaacgctggcggcaggcttaacacatgcaagtcgaacggttccttcggggacagtggcagacgggtgagtaacacgcgggaatctacctggttctacgggataacagttggaaacgactgctaataccggatacgcccttttggggaaagatttatcggaatcagatgagcccgcgtaagattagctagttggtgaggtaatggctcaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcaccggtgaagataatgacggtaaccggagaagaagccccggctaacttcgtgccagcagccgcggtaat

SEQ ID NO: 751 - DNA, 490 bp, Unknown
  Ascusbbf_651188, encodes 16S rRNA
agagtttgatcctggctcaggatgaacgctagcggcaggcctaacacatgcaagtcgaggggtagagtacttcggtgcttgagaccggcgcacgggtgcgtaacgcgtatgcaatctaccttatactttgggatagcccggagaaatccggattaataccttatggttatttatagtggcatcgttaaaaatataaagattaattggtataagatgagcatgcgtcccattagttagttggtgtggtaacggcacaccaagacgatgatgggtaggggtcctgagagggagatcccccacactggtactgagacacggaccagactcctacgggaggcagcagtgaggaatattggtcaatggaggcaactctgaaccagccatgccgcgtgcaggaagaatgtcctatggattgtaaactgcttttgtacgggaagaaaaagagctacgcgtagtttattgacggtaccgtaagaataaggatcggcta

SEQ ID NO: 752 - DNA, 490 bp, Unknown
  Ascusbbf_582940, encodes 16S rRNA
agagtttgatcctggctcaggatgaacgctggcggcgtgcttaacacatgcaagtcgaacggagcacccctgacggagttttcggacaacgaaagggaatgcttagtggcggacgggtgagtaacgcgtgagtaacctgccttggagtggggaataacagccggaaacggctgctaataccgcatgatgtatctggatcgcatggttctggataccaaagatttatcgctctgagatggactcacgtctgattagctagttggtgaggtaacggctcaccaaggcgacgatcagtagccggactgagaggttggccggccacattgggactgagacacggcccagactcctacgggaggcagcagtggggaatattgggcaatgggcgaaagcctgacccagcaacgccgcgtgaaggaagaaggccctcgggttgtaaacttcttttgtcagggacgaagcaagtgacggtacctgacgaataagccac

SEQ ID NO: 753 - DNA, 490 bp, Unknown
  Ascusbbf_518770, encodes 16S rRNA
agagtttgatcatggctcaggacgaacgctggcggcgtgcctaatacatgcaagtcgaacgaacggattgaggagcttgctcttcaagaagttagtggcggacgggtgagtaacacgtgggtaacctgcccttcagcgggggataacatccggaaacgggtgctaataccgcatagtttctttttccgcctggaagaagaaggaaagatggcctttgtgctatcactgagggatggacccgcggcgtattagttagttggtggggtaatggcctaccaagacgatgatacgtagccgacctgagagggtgatcggccacattgggactgagacacggcccaaactcctacgggaggcagcagtagggaatcttccgcaatggacgaaagtctgacggagcaacgccgcgtgagtgaagaaggttttcggatcgtaaaactctgttgtcggagaagaacaagtaggagagtaactgttcctaccttgacgg

SEQ ID NO: 754 - DNA, 490 bp, Unknown
  Ascusbbf_199465, encodes 16S rRNA
agagtttgatcatggctcagattgaacgctggcggcaggcctaacacatgcaagtcgggcggtaacagggagaagcttgcttctctgctgacgagcggcggacgggtgagtaatgtatggggatctgcctgatggcgggggataactactggaaacggtagctaataccgcataatgtctacggaccaaagcgggggacctccgggcctcgcgccatcagatgaacccatatgggattagcttgtaggtgaggtaacggctcacctaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccttcgggttgtaaagtactttcagtcgggaggaaggtggtaaggttaataaccttatcaattgacgttaccgacagaag

SEQ ID NO: 755 - DNA, 490 bp, Unknown
  Ascusbbf_766302, encodes 16S rRNA
agagtttgatcctggctcaggatgaacgctggcggcgtgcctaacacatgcaagtcgaacgtgaggttaccatctagcaatagaaggtaactgaaagtggcgaacgggtgagtaacacgtagataacctaccctgaagtgggggataaccacgggaaactgtggctaataccgcatacgcttgaccgtctgggaatatggtcaaggaaagcttaatgtgctttgggaggggtctgcggtcgattagttagatggtggggtaacggcctaccatggcgatgatcgatagctggtctgagaggatgatcagccacacgggaactgagatacggtcccgactcctacggggggcagcagtgaggaatattgcacaatgggggcaaccctgatgcagcaacgccgcgtggaggaagaaggcccttgggtcgtaaactccttttctatgggacgagagaggacggtaccataggaataagtcacggctaactacg

SEQ ID NO: 756 - DNA, 186 bp, Unknown
  Ascusbbf_147952, encodes 16S rRNA
agagtttgatcatggctcagaacgaacgctggcggcaggcttattgggcaatggaggcaactctgacccagccatgccgcgtgagtgaagaaggttttcggattgtaaagctctttcagacgggaagatgatgacggtaccgtcagaagaagcaccggctaacttcgtgccagcagccgcggtaat

SEQ ID NO: 757 - DNA, 490 bp, Unknown
  Ascusbbf_198654, encodes 16S rRNA
agagtttgatcctggctcaggatgaacgctggcggcgtgcctaacacatgcaagtcgagcgagaaacctgcaattgacgcttcggttgattttgcaggcggaaagcggcggacgggtgagtaacgcgtaggcaacctgcccttcacacagggatagcctcgggaaaccgggattaaaacctgatgacaccgggacatcacatgttgatccggtcaaagatttatcggtgaaggatgggcctgcgtctgattagttagttggtgaggtaacggctcaccaaggcgacgatcagtagccgacctgagagggtgatcggccacattggaactgagacacggtccaaactcctacgggaggcagcagtggggaatattgcacaatgggggaaaccctgatgcagcaacgccgcgtgagcgaagaaggcggattcgtcgtaaagctctgtccttggggaagaagaactgacggtacccttggaggaagccccggc

SEQ ID NO: 758 - DNA, 490 bp, Unknown
  Ascusbbf_431277, encodes 16S rRNA
agagtttgatcatggctcaggatgaacgctagcgggaggcctaacacatgcaagccgagcggtagaagtccttcgggactttgagagcggcgtacgggtgcgtaacacgtgtgcaacctgcctttatcttggggatagcctttcgaaaggaagattaatacccactaatatattgattggcatcaattgatattgaaaactccggtggataaagatgggcacgcgcaagattagatagttggtgaggtaacggctcaccaagtcaatgatctttagggggcctgagagggtgatcccccacactggtactgagacacggaccagactcctacgggaggcagcagtgaggaatattggacaatgggtgaaagcctgatccagccatcccgcgtgaaggatgacggtcctatggattgtaaacttcttttgtacagggataaaccttcccacgtgtggggagctgaaggtactgtacgaataagcaccggct

SEQ ID NO: 759 - DNA, 469 bp, Unknown
  Ascusbbf_294364, encodes 16S rRNA
agagtttgatcctggctcagaacgaacgctggcggcaggcttaacacatgcaagtcgaacgatcccttcggggatagtggcagacgggtgagtaacacgtgggaatctacctggttcttcgggataacagttggaaacgactgctaataccggatacgcccttttggggagagatttatcggaatcggatgagcccgcgtaagattagctagatggtggggtaatggcccaccatggcgacgatctttagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcagtagggaagataatgacggtacctacacaagaagccccggctaacttcgtgccagcagccgcgtaat

SEQ ID NO: 760 - DNA, 490 bp, Unknown
  Ascusbbf_213653, encodes 16S rRNA
agagtttgatcatggctcaggacgaacgctggcggtgtgcttaacacatgcaagtggtgcgacgaaccagagcttgctctggggcaaagccgcgaacgggtgagtaacacgtgggtaatctaccccgatgaccgggacaacccgaggaaactcgggctaataccggatgtggtgtactggcataagccggtccactaaaggtagcttcggcttccgcattgggaggggcccgcggcccattagcttgttggtggggtcaaggcctaccaaggcaacgatgggtagctggtctgagaggacgatcagccacactgggactgagacacggcccagactcctacgggaggcagcagtggggaatcttgcgcaatgcgcgaaagcgtgacgcagcaacaccgcgtgagggaagacggccttagggttgtaaacctctttcagatgggacgaaggtgatgcggtgaatagccgatgtcattgacggtaccgtcag

SEQ ID NO: 761 - DNA, 490 bp, Unknown
  Ascusbbf_935384, encodes 16S rRNA
agagtttgatcatggctcaggatgaacgctggcggcgtgcctaacacatgcaagtcgaacggagattagttggaacggagcacttgtgctcagggaagattaattttagtggcggacgggtgagtaacacgtgagcaacctgccttggtcagggggataacaacgggaaaccgttgctaataccgcatgatatatctttacggcatcgtacgggatatcaaaggagcaatccggactgagatgggctcgcgtccgattagttagttggtggggtaatggcctaccaagactgcgatcggtagccggactgagaggttgaccggccacattgggactgagacacggcccagactcctacgggaggcagcagtggggaatattgggcaatgggggcaaccctgacccagcgacgccgcgtgaaggacgaaggtcttcgggttgcaaacttctttgatcgaggacgataatgacggtactcgaggaacaagcc

SEQ ID NO: 762 - DNA, 490 bp, Unknown
  Ascusbbf_195552, encodes 16S rRNA
agagtttgatcctggctcaggacgaacgctggcggtatgcttaacacatgcaagtcgaacgagacgagatggaaggaaccttcgggtgacggaaatcttagaaagtggcgaacgggtgagtaacgcgtgggtaacctgccctatggaaaggaatagcctcgggaaactgggagtaatgccttataatatagtgaagtcgcatggctttgctattaaacgctccggtgccataggatggacccgcgtcccattagctagttggtgagataacagctcaccaaggcgacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaagctctgttattggggaagaaaaaagacggtacccaaggagaaagtcccggc

SEQ ID NO: 763 - DNA, 352 bp, Unknown
  Ascusbbf_1815364, encodes 16S rRNA
agagtttgatcatggctcaggacgaacgctggcggcgtgcttcatacatgcaagtcgaacgagaagctgacttcggtcagtggaaagtggcggacgggtgagtaatatgtaggaaatctgcctcagagagggggacaacagggggaaactcttgctaataccccatatgagcttggctgcaatgccaatcttgaaaactccggtgctctgagatgagcctgcatctgattagcttgttggcggtgtaatggaccaccaaggcgacgatcagtagctggtttgagaggatgatcagccacaatgggactgagacacggcccatactcctacgggagccagcagccgcggtaat

SEQ ID NO: 764 - DNA, 490 bp, Unknown
  Ascusbbf_1745154, encodes 16S rRNA
agagtttgatcctggctcagaacgaacgctggcggcgtgcctaacacatgcaagtcgagcgcgaaaagggcaacctgagtagagcggcgcacgggtgcgtaacacgtgggtaatctgccctggagattcagataaccatccgaaagggtggctaatacggaataagcccacggtctcttcggaggctgagggaaaaggtgacctctatttataagttaccacttcaggatgagcccgcggcccatcagcttgttggcggggtaatggcccaccaaggctacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtcttcggatcgtaaagcactttcgaccgggaagaaaaagcgagtgctaatcagctcgtgttgacggtaccgg

SEQ ID NO: 765 - DNA, 490 bp, Unknown
  Ascusbbf_1780735, encodes 16S rRNA
agagtttgatcatggctcaggacgagcgctggcggcgtgcttaacacatgcaagtcgaacggagcgtttttgtttaatccttcgggaagcgacgaaaaggcttagtggcggacgggtgagtaacgcgtgagcaatctgccttggacagggggataacagttggaaacgactgctaataccgcataaagtaacggggaggcatctttctgttaccaaaggagaaatccggtacaagatgagctcgcgtccgattagatagttggcggggtaaaggcccaccaagtcgactatcggtagccggactgagaggttgaccggccacattgggactgagacacggcccagactcctacgggaggcagcagtggggaatattgggcaatgggcgaaagcctgacccagcaacgccgcgtgaaggacgaaggttttcggattgtaaacttctttgactgaggacgacacaaggacggtactcagaaaacaagccacg

SEQ ID NO: 766 - DNA, 490 bp, Unknown
  Ascusbbf_698572, encodes 16S rRNA
agagtttgatcctggctcaggatgaacgctagcgataggcttaacacatgcaagtcgaggggcagcagggctttcgggccgctggcgaccggcgcacgggtgcgtaacgcgtatgcaacttgccctacagagggggataacccgtcgaaagacggactaataccgcgtacacttgggaggaggcatctctttctaaggaaatgaaattcgctgtaggataggcatgcgtcccattagctagttggtgaggtaacggctcaccaaggcgacgatgggtaggggaactgagaggtttatcccccacactggtactgagacacggaccagactcctacgggaggcagcagtgaggaatattggtcaatggacgagagtctgaaccagccaagtcgcgtgaaggatgactgtcttatggattgtaaacttcttttgtatgggaataacatcacccacgtgtgggtgtctgcatgtaccatacgaataagcatcg

SEQ ID NO: 767 - DNA, 490 bp, Unknown
  Ascusbbf_345436, encodes 16S rRNA
agagtttgatcctggctcaggatgaacgctggcggcgtgcttaacacatgcaagtcgaacgctgaagcctggtgcttgcactgggtggatgagtggcgaacgggtgagtaacacgtgagtaacctgcccctgactctgggataagcctgggaaactgggtctaatactggatatgactgatcatcgcatggtggttggtggaaagagtttttggttggggatggactcgcggcctatcagcttgttggtgaggtagtggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagttaggaagaagcctttcggggtgacggtactagcagaagaagcgccggctaacta

SEQ ID NO: 768 - DNA, 490 bp, Unknown
  Ascusbbf_222168, encodes 16S rRNA
agagtttgatcctggctcagaacgaacgctggcggcgtggattaggcatgcaagtcgtacgagaaagcgtccttcggggcgtgagtacagtggcgaactggtgagtacaaggtgactaacctgcccttgagtgggggataacttcgggaaaccggagctaataccgcatagtctctttgccttgcgaggtaatgagtaaagcatttatgcgctcgaggatggggtcaccccccattagcttgttggtagggtaacggcctaccaaggctgcgatgggtagctggactgagaggttggccagccacactgggactgagatacggcccagactcctacggggggcagcagtctagaggcttcgacaatgcccgaaagggtgatcgagcgacgccgcgtgtgggatgacggtcttcggattgtaaaccacttttgtttgggaagaaggcttgtatcgtgaatatgagattgacggtaccaaacgaataagccc

SEQ ID NO: 769 - DNA, 490 bp, Unknown
  Ascusbbf_943921, encodes 16S rRNA
agagtttgatcctggctcaggacgaacgctggcggcgtgcctaacacatgcaagtcgaacggagttaagcccttcgggacttaacttagtggcgaacgggtgagtaacgcgtgagaaacctgcctttcagtgggggacaacagttggaaacgactgctaataccgcatgatacttcttgagggcatccttgagaagtcaaagctttatgtgctgaaagatggtctcgcgtctgattagctagttggtggggtaacggcccaccaaggcgacgatcagtagccggtctgagaggatgaacggccacattgggactgagatacggcccagactcctacgggaggcagcagtggggaatattgggcaatgggggaaaccctgacccagcaacgccgcgtgaaggaagaaggccttcgggttgtaaacttcttttaccagggacgaagaacgtgacggtacctggagaaaaagcaacggctaactacgtgccag

SEQ ID NO: 770 - DNA, 490 bp, Unknown
  Ascusbbf_690143, encodes 16S rRNA
agagtttgatcctggctcaggatgaacgctagctacaggcttaacacatgcaagtcgaggggcagcatggtcttagcttgctaaggccgatggcgaccggcgcacgggtgagtaacacgtatccaacctgccgtctactcttggacagccttctgaaaggaagattaatacaagatggcatcatgagtccgcatgttcacatgattaaaggtattccggtagacgatggggatgcgttccattagatagtaggcggggtaacggtccacctagtcttcgatggataggggttctgagaggaaggtcccccacattggaactgagacacggtccaaactcctacgggaggcagcagtgaggaatattggtcaatgggcgagagcctgaaccagccaagtagcgtgaaggatgactgccctatgggttgtaaacttcttttatacagggataaagtcgggaacgtgttcccgtttgtaggtactgtatgaat

SEQ ID NO: 771 - DNA, 490 bp, Unknown
  Ascusbbf_1879192, encodes 16S rRNA
agagtttgatcatggctcaggatgaacgctggcggcgtgcttaacacatgcaagtcgagcggagatataaaaaggaagcccttcggggtggaatttttacatcttagcggcggacgggtgcgtaacacgtgggtaacctgcccctatcactgggataacacactgaaaagtgtgctaataccagataatataagcttttggcatcattagcttatcaaagaatttcggatagggatgggcccgcgtctgattagctagttggtgaggtaacggctcaccaaggcaacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctatgggaagataatgacggtaccataggaggaagccccggct

SEQ ID NO: 772 - DNA, 490 bp, Unknown
  Ascusbbf_1848530, encodes 16S rRNA
agagtttgatcatggctcaggatcaacgctggcggcgtgcctaatgcatgcaagtcggacggggcgcctttcggggcgctcacgtggcggacgggtgaggaacgcgtggggaagctgccgtgcgcacgggggtagccatcggaaacggtgggtaattccggatacgctcgcgtcccgggtaggggatgtgaggaaagatcttcggatcggcgcacgaggcacctgcggccgattagctagacggtggggtaacggcctaccgtggcgatgatcggtagctggtctgagaggatgatcagccacacggggactgagacacggccccgactcctacgggaggcagcagcaaggaattttccgcaatgggcgcaagcctgacggagcaacgccgcgtgcgggaggacgcctttcggggtgtaaaccgctgttcgtggggacgaagcactgacggtacccacggaggaaggcccggctaactacgtgccagcag

SEQ ID NO: 773 - DNA, 490 bp, Unknown
  Ascusbbf_537366, encodes 16S rRNA
agagtttgatcctggctcagattgaacgctggcggcaggcctaatacatgcaagtcgaacggtaacataagaaaagcttgcttttcttgatgacgagtggcggacgggtgagtaagatttgggaagctacctgatagagggggacaacagttggaaacgactgctaataccgcatacagcctcagggtgaaagaagaaattcgctatcagatgtgcccaaacgggattagctagtaggtgaggtaaaggctcacctaggcgacgatctctagctggtctgagaggatgatcagccacattgggactgagacacggcccagactcctacgggaggcagcagtagggtatattgcacaatggacgcaagtctgatggagcaacgccgcgtgagtgaagaaggttttcggatcgtaaagctctgttgttggtgaagaaggatagaggtagtaactggcctttatttgacggtaatcaaccagaaagtcacggc

SEQ ID NO: 774 - DNA, 490 bp, Unknown
  Ascusbbf_1004053, encodes 16S rRNA
agagtttgatcctggctcaggacgaacgctggcggcgtgcctaacacatgcaagtcgagcgaagtttttaaagtgaatcccttcggggtgaaactttaattatcttagcggcggacgggtgagtaacgcgtgagaaacctgcctttcacaaaggaatagcctcgggaaactgggaataataccttatgatacttctacttcacatgaagaagaagttaaagcgtaaagcggtgaaagatggtctcgcgtcccattagctagttggtgaggtaatagctcaccaaggcgacgatgggtagccggcctgagagggtgaacggccacactggaactgagacacggtccagactcctacgggaggcagcagtggggaatattgcacaatggaggaaactctgatgcagcgacgccgcgtgaacgatgaaggctttcgggtcgtaaagttctgtccttggggacgataatgacggtacccaaggaggaagccccg

SEQ ID NO: 775 - DNA, 489 bp, Unknown
  Ascusbbf_368775, encodes 16S rRNA
agagtttgatcatggctcaggacgaacgctggcggcgtgcctaatacatgcaagtcgagcgggaaacttcggtttccagcggcgaacgggtgagtaacacgtgggcaacctgccctcaagcttgggataactccgggaaaccggggctaacaccaaataatcttttctctcgcatgagagaaaagtaaaagtttacacttgaggatgggcccgcggtgcattagcttgttggtgaggtaacggctcaccaaggcaacgatgcatagccgacctgagagggtgaccggccacactgggactgagacacggcccagactcctacgggaggcagcagtagggaattttccgcaatgggcgcaagcctgacggagcaacgccgcgtgagtgaagacggccttcgggttgtaaagctctgttcttggggaagaaacaaatgacggtacccaagcagaaagccccggctaactacgtgccagcagccgcggtaat

SEQ ID NO: 776 - DNA, 490 bp, Unknown
  Ascusbbf_633227, encodes 16S rRNA
agagtttgatcatggctcaggacgaacgctggcggcgtgcttaacacatgcaagtcgaacgatgaagccggggctttttgttttggtggattagtggcgaacgggtgagtaatacgtgagtaacctgcccttgtctttgggataagcctgggaaactgggtctaataccggatattctgcttttgccgcatggtgggggttggaaagattttttggatggggatgggctcacggcctatcagcttgttggtggggtgatggcctaccaaggcgtcgacgggtagccggcctgagagggtgaccggccacattgggactgagatacggcccagactcctacgggaggcagcagtggggaatattgcacaatggacgcaagtctgatgcagcgacgccgcgtgggggatgaaggctttcgggttgtaaactcctttcagtacagaagaagcatttttgtgacggtatgtgcagaagaagcgccggctaacta

SEQ ID NO: 777 - DNA, 490 bp, Unknown
  Ascusbbf_1510063, encodes 16S rRNA
agagtttgatcatggctcaggatgaacgctagcggcaggcctaacacatgcaagtcgaggggtagaggaagcttgcttccttgagaccggcgcacgggtgcgtaacgcgtatgcaatctgccttgtactgagggatagcccagagaaatttggattaatacctcatagcattatgaaatcgcatggttttataattaaagttccaacggtacaagttgagcatgcgtcccattagttagttggtaaggtaacggcttaccaagacgatgatgggtaggggtcctgagagggagatcccccacactggtactgagacacggaccagactcctacgggaggcagcagtgaggaatattggtcaatggacgcaagtctgaaccagccatgccgcgtgcaggatgaagcatctatggtgtgtaaactgcttttgtacgggaagaaacactcctacgtgtaggagcttgacggtaccgtaagaataaggatcggc

SEQ ID NO: 778 - DNA, 490 bp, Unknown
  Ascusbbf_609566, encodes 16S rRNA
agagtttgatcctggctcaggatgaacgctagcgacaggcctaacacatgcaagccgaggggtagcacaaagtagcaatacttgggtgacgaccggcgcacgggtgagtaacgcgtatgcaacctaccttctacaggggcataacccggagaaattcggactaataccccataatacagggactccgcctggagatatttgttaaagattaatcggtagaagatgggcatgcgttccattagccagttggtgaggtaacggctcaccaaagcaacgatggataggggaactgagaggtttatcccccacactggaactgagacacggaccagactcctacgggaggcagcagtgaggaatattggtcaatgggtgagagcctgaaccagccaagtcgcgtgaaggaagactgccttatgggttgtaaacttcttttataggagaataaaaaaggttatgtataacctattgcatgtatcctatgaataag

SEQ ID NO: 779 - DNA, 490 bp, Unknown
  Ascusbbf_877372, encodes 16S rRNA
agagtttgatcctggctcagagtgaacgctggcggcaggcctaacacatgcaagtcgagcggcagcgcggggcaacctggcggcgagcggcggacgggtgaggaacacatcggaatctacccagtcgtgggggataacgtagggaaacttacgctaataccgcatacgacctgagggtgaaagcaggggaccgcaaggccttgcgcgattggatgagccgatgtccgattagctggttggtgaggtaaaggctcaccaaggcgacgaccggtagctggtctgagaggatgatcagccacactggaactgagacacggtccagactcctacgggaggcagcagtggggaatattggacaatgggcgcaagcctgatccagccatgccgcgtgtgtgaagaaggccttcgggttgtaaagcacttttgttggggaagaaaagccgcgggttaataccctgtggttctgacggtacccaaagaataagcaccg

SEQ ID NO: 780 - DNA, 481 bp, Unknown
  Ascusbbf_527308, encodes 16S rRNA
agagtttgatcctggctcagaacgaacgctggcggcatgcctaacacatgcaagtcgaacgaaggcccctcttcggagggtgtccttagtggcggacgggtgagtaacgcgtgggaacctgcccagcagtacggaataactacgggaaactgtggctaataccgtatacgccctacgggggaaagtttttcgctgttggatgggcccgcgtcggattagcttgttggtggggtaatggcctaccaaggcgacgatccgtagctggtctgagaggatgatcagccacactgggactgagacacggcccagactcctacgggaggcagcagtggggaatattggacaatgggggaaaccctgatccagcaatgccgcgtgagtgaagaaggccttagggttgtaaaactctttcaccggggaagatgatgacggtacccggagaagaagccccggctaactccgtgccagcagccgcggtaat

SEQ ID NO: 781 - DNA, 490 bp, Unknown
  Ascusbbf_322538, encodes 16S rRNA
agagtttgatcctggctcaggatgaacgctggcggcgtgcttaacacatgcaagtcgaacggacttgtccaattggaagcggaagatgcttgcattcgaagcttccgcccgggcaagttagtggcggacgggtgagtaacgcgtggagaacctgcctttatctgggggataacagttagaaatgactgctaataccgcataagcgcacactggggcatcccagagtgtgaaaaactccggtggatagagatggctccgcgtcagattagccagttggcggggtaacggcccaccaaagcgacgatctgtagccggcctgagagggcgaccggccacattgggactgagacacggcccaaactcctacgggaggcagcagtggggaatattgcacaatgggggaaaccctgatgcagcgacgccgcgtgagtgatgacgtatttcggtatgtaaagctctatcagcagggaagaaaatgacggtacctgac

SEQ ID NO: 782 - DNA, 490 bp, Unknown
  Ascusbbf_772199, encodes 16S rRNA
agagtttgatcatggctcagaatgaacgctggtggcgtgcctaacacatgcaagtcgagcgagaacgctccttcgggagttagtaaagcggcggacgggtgagtaacgcgtaagaatctgccctttagtggagaataccttcgagaaatcgaagttaatactgcataagttccttcgggaagaaagatggcctctttgctgtcgctaagggatgagcttgcgtactattagcttgttggtggggtaaaggcctaccaaggcgatgatggttagccggcctgagagggtgtacggccacactggaacttagacacggtccagactcctacgggaggcagcagtgaggaatattgcgcaatgggcgaaagcctgacgcagcgacgccgcgtggaggatgaaggttttcggattgtaaactcctgttaagtgggaagaaaagcttggggttaatacccctaagtcatgacggtactacttgagaaagcaccgg

SEQ ID NO: 783 - DNA, 372 bp, Unknown
  Ascusbbf_469879, encodes 16S rRNA
agagtttgatcctggctcaggacgaacgctggcggcgtgcttcatacatgcaagtcgaacgagaatctctagcttgctagagaggaaagtggcggacgggtgagtaaaatgtagagaatctgcccttgagagggggacaacagttggaaacggctgctaataccccatatgagcgtacctgagatggtattcttgaaaactccggtgctcaaggatgagtctgcatctgattagctagttggcggggtaatggcccaccaaggcgacgatcagtagctggtttgagaggatgatcagccacaatggggacgaacaaatgacggtacccacagaggaagcaccggctaactccgtgccagcagccgcggtaat

SEQ ID NO: 784 - DNA, 490 bp, Unknown
  Ascusbbf_575647, encodes 16S rRNA
agagtttgatcatggctcaggatgaacgctagctacaggcttaacacatgcaagtcgaacggtaaggcttccttcgggaagcacacgagtggcgaacgggtgagtaacacgtgggtaacctgcccttgactgggggaaaaccggaggaaactccggctaataccgcataatgtgcactctcataagtgggtgtaccaaagctccggcggtcaaggatgggcccgcggcggattagcttgttggtggggtaacggcctaccaaggcaacgatccgtagctggtctgagaggacgatcagccacactgggactgagacacggcccagactcctacgggaggcagcagtggggaatcttgcgcaatgggcgaaagcctgacgcagcaatgccgcgtgagggaagacggccttagggttgtaaacctctttcagcagggacgaattcagacggtacctgcagaagaagccccggctaactacgtgccagcagcc

SEQ ID NO: 785 - DNA, 247 bp, Unknown
  Ascusbbf_622350, encodes 16S rRNA
agagtttgatcctggctcaggatgaacgctagctacaggcttaacacatgcaagtcgaggggcatcaggtatctagcttgctaggtatgctggcgaccggcgcacgggtgcgtaacacgtatccaacctgcccgcagctcagggacagcctttcgaaagaaagattaatacctgacggtctcttccggggacatccccggcagagtaaagattcatcggctaattccgtgccagcagccgcggtaat

SEQ ID NO: 786 - DNA, 490 bp, Unknown
  Ascusbbf_1410197, encodes 16S rRNA
agagtttgatcatggctcaggatgaacgctagcggcaggcctaatacatgcaagtcggacgggatttcggtgtagcttgctataccggatgagagtggcgcacgggtgcgtaacgcgtgagcaacctgcccatgtcagggggatagcccgttgaaagacggattaataccgcatgacacataagtaccgcatggttcttatgtcaaatatttataggacatggatgggctcgcgtggcattagctagttggtaaggtaacggcttaccaaggcaatgatgcctaggggctctgagaggagtgacccccacactggtactgagacacggaccagactcctacgggaggcagcagtagggaatattggtcaatgggcgggagcctgaaccagccatgccgcgtgcgggaagaaggccctatgggtcgtaaaccgcttttatacgggaacaaccgcagctacgtgtagctgtctgagtgtaccgtaggaataa

SEQ ID NO: 787 - DNA, 490 bp, Unknown
  Ascusbbf_1153008, encodes 16S rRNA
agagtttgatcatggctcaggacgaacgctggcggcgtgcctaacacatgcaagtcgagcggagccaatcgaacaatcccttcggggtgcgttggaggaagtttagcggcggacgggtgagtaacgcgtgagtaacctgcccataagagggggataacacagagaaatttgtgctaataccgcatatagatatttaattgcatgattaaatattgaaagatttatcgcttatggatggactcgcgtctgattagatagttggtgaggtaacggctcaccaagtcgacgatcagtagccgaactgagaggttgatcggccacattgggactgagacacggcccagactcctacgggaggcagcagtgggggatattgcgcaatgggggaaaccctgacgcagcaacgccgcgtgaaggaagaaggccttcgggttgtaaacttttgttgcaagggaagaaaaaaatgacggtaccttgtgaggaagccacg

SEQ ID NO: 788 - DNA, 490 bp, Unknown
  Ascusbbf_1515000, encodes 16S rRNA
agagtttgatcctggctcagaacgaacgctttcgacatgcttaacacatgcaagtcgtacggactgttttttttatagcaatataaaagaaatatgttagtggcaaacgggtgagtaatacatgagaacataccctgtaatcacggataatcattggaaacgatgtgtaatacgagataatgtggagacaccaaaggagaaatctgttatgggagtggctcgtggtagattagatagttggtagtgtaatggactaccaagtcaaagatctatagctggtctgagaggacggacagccacattgggactgagacacggcccagacttctacggaaggcagcagtggggaatattaggcaatgggagaaatcctgacctagcgatgtcgagtgaatgatgaaggactttggtctgtaaaattcttttgcaaaggaatattatgaaattactttgcgaataagcaccggctaacttcgtgccagcagccgcg

SEQ ID NO: 789 - DNA, 490 bp, Unknown
  Ascusbbf_1635685, encodes 16S rRNA
agagtgatcctggctcaggatgaacgctagctacaggcttaacacatgcaagtcgaggggaaacgacagagagtgcttgcacactttgggcgtcgaccggcgaatgggtgagtaacgcgtatccaacttgcccttgactgagggatagcccagtgaaaactgaattaatacctcatgttctcctcagacggcatcagacgaggagcaaagattaatcggtcaaggatggacccgcgtctgattagcttgttggtggggtaacggcctaccaaggcgacgatcagtagccgacctaagagggtgaccggccacattgggactgagacacggcccaaactcctacgggaggcagcagtggggaatattgcccaatgggggaaaccctgatgcagcgacgccgcgtgagtgaagaagtatttcggtatgtaaagctctatcagcagggaagaaaatgacggtacctgactaagaagccccggctaactacgtg

SEQ ID NO: 790 - DNA, 490 bp, Unknown
  Ascusbbf_1009, encodes 16S rRNA
agagtttgatcatggctcaggatgaacgctggcggcgtgcctaatacatgcaagtcgaacgggtgtagcaatacatcagtggcgaacgggtgagtaacacgttggtgacctgccccaaagatgggaatatcacctggaaacgggtggcaaaaccgaataagcttgactcagtcagagaaggtcaagtaaaagcgaaagctactttgggaggggcctgcggcccatcagttagttggtgagggtaacggcccaccaagacgaagacgggtaggggacctgagagggtggtcccccacaatggaactgaaacacggtccatacacctgcgggtggcagcagtagggaatattgcttaatgggcgaaagcctgaagcagcaacgccgcgtggacgaaggaggccttcgggtcgtaaagtccttttatgggggaaaaggaaggatggtaccccatgaataagtctcggctaactacgtgccagcagccgcggta

SEQ ID NO: 791 - DNA, 490 bp, Unknown
  Ascusbbf_1673, encodes 16S rRNA
agagtttgatcatggctcaggatgaacgctagctacaggcctaacacatgcaagtcgaggggcagcagatcgaaagcttgcttttgatgctggcgaccggcgaatgggtgagtcacgcgtgtccaacctgccttcagcccggggatagcccttggaaatgaggattaacacccgataggtgcgcattccgcatggcgtgcgcatgaaactggactggagatggggacgcgtcggattagcttgacggcggggcgacggcccaccgtggcgacgatccgcaggggttctgagaggaaggtcccccacactggcactgagacacgggccagactcctacgggaggcagcagtgaggaatattggtcaatggccgagaggctgaaccagccaagtagcgtgcaggacgacggccctacgggttgtaaactgcttttgcgggaggataaaggacactacgtgtagtgttttgcaggtatcccgtgaataaggac

SEQ ID NO: 792 - DNA, 490 bp, Unknown
  Ascusbbf_5577, encodes 16S rRNA
agagtttgatcatggctcaggatgaacgctagctacaggcttaacacatgcaagtcgaggggcagcatgggattagcttgctaatcctgatggcgaccggcgcacgggtgagtaacgcgtatccaaccttccccttactcagggatagcccgctgaaaggcggattaacacctgatggtttcattagatggcatctgacgatgaataaaggcttacggtaagggatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttgtacgggaataaagtgacctacgtgtaggtttttgcatgtaccgtaagaata

SEQ ID NO: 793 - DNA, 490 bp, Unknown
  Ascusbbf_4841, encodes 16S rRNA
agagtttgatcatggctcaggatgaacgctggcggcgtgcgtaacacatgcaagttgagcgacgacgtgcttgaagtggcaacatggaaagtacgagcggagcagcggacgggtgagtacaacatgagaagctgtcctgtggtgggggacaacgtctagaaatggacgctaataccccataggccgaaaggttaaagcagcaatgcgccactggaggtgctcgtgccctatcagctagttggtgaggtaacggctcaccaaggcgacgacgggtagccggcctgagagggtgtccggccacactgggactgagatacggcccagactcctacgggaggcagcagtggggaatattgggcaatgggagaaatcctgacccagcgacgccgcgtgaatgaagaaggccttcgggtcgtaaagttcttttatgcgggaagaaggaagtgacggtaccgcatgaataagccccggctaactacgtgccagcagc

SEQ ID NO: 794 - DNA, 490 bp, Unknown
  Ascusbbf_75373, encodes 16S rRNA
agagtttgatcatggctcaggacgaacgctggcggcgtgcctaatacatgcaagtagaacgctgaagtctggtgcttgcaccggatggatgagttgcgaacgggtgagtaacgcgtaggtaacctgcctggtagcgggggataactattggaaacgatagctaataccgcataacagtttttctcgcatgagaggagcttgaaaggagcaactgcttcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacaggtgtgagagtggaaagttcacactatgacggtagct

SEQ ID NO: 795 - DNA, 490 bp, Unknown
  Ascusbbf_65315, encodes 16S rRNA
agagtttgatcatggctcaggatgaacgctagcggcaggcttaacacatgcaagtcgaggggcagcgcgttgtagcaatacgatggcggcgaccggcggaagggtgcgtaacacgtgagcaacttgcccgcatctgggggaaaagcgatggaaacgccgtctaataccccataacaacagggaccgcatgatccccgtttgaaagaaattcggatgcggatgggctcgcgggacattagctagttggagtggtaacggcacaccaaggcgacgatgtctaggggttctgagaggaaggtcccccacattggaactgagacacggtccaaactcctacgggaggcagcagtgaggaatattggtcaatggacggaagtctgaaccagccatgccgcgtgaaggaataaggccctatgggtcgtaaacttcttttgtggcggagcaataaggcgtacgtgtacgccgatgagagtacgtcacgaataagcat

SEQ ID NO: 796 - DNA, 490 bp, Unknown
  Ascusbbf_130824, encodes 16S rRNA
agagtttgatcatggctcaggacgaacgctggcggcgtgcctaacacatgcaagtcgaacggagtacccgcaaatgaggcttcggccaaatgagcggaatgcttagtggcggacgggtgagtaacgcgtgagtaacctgccggggagagtggaataacacatcgaaaggtgtgctaataccgcatattgcatagcagtcacatggctgatatgtgaaagatttatcgctccctgatggactcgcgtctgattagctagttggtagggtagaggcctaccaaggcgacgatcagtagccggactgagaggttgaacggccacattgggactgagacacggcccagactcctacgggaggcagcagtggggaatattgcgcaatgggggcaaccctgacgcagcaacgccgcgtgaaggaagaaggtcttcggattgtaaacttttgtctttggtgaagatagtgacggtagccaaggaggaagccacggct

SEQ ID NO: 797 - DNA, 490 bp, Unknown
  Ascusbbf_231894, encodes 16S rRNA
agagtttgatcctggctcaggacgaacgctggcggcgtgcctaacacatgcaagtcgaacggagatattttgaatgaagacttcggttggatttcgatttatcttagtggcggacgggtgagtaacgcgtgagtaacctgcctttttgagggggataacatcgggaaatcgatgctaataccgcataaaattcaggattcgcatggattttgaatcaaaggagcaatccgcaaaaagatggactcgcgtccgattagccagttggtgaggtaacggctcaccaaagcaacgatcggtagccgggttgagagactgaacggccacattgggactgagacacggcccagactcctacgggaggcagcagtgggggatattgcacaatgggcgaaagcctgatgcagcaacgccgcgtgagggaagaaggttttcggattgtaaacctctgtccaaagggaagaaacaaatgacggtacctttggaggaagct

SEQ ID NO: 798 - DNA, 490 bp, Unknown
  Ascusbbf_138702, encodes 16S rRNA
agagtttgatcatggctcagattgaacgctagcgggatgctttacacatgcaagtcgaacggcagcgcggaacttcggttctggcggcgagtggcgaacgggtgagtaatgtatcggaacgtgcccagtagcgggggataactacgcgaaagcgtggctaataccgcatacgccctacgggggaaagagggggactcttcggagcctctcactattggagcggccgatatcagattagctagttggtggggtaatggcctaccaaggccgcgatctgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcagggaagaaaaggcgcaggctaataccctgtgctgctgacggtacctgcagaataa

SEQ ID NO: 799 - DNA, 490 bp, Unknown
  Ascusbbf_185815, encodes 16S rRNA
agagtttgatcctggctcaggacgaacgctggcggcatgcctaacacatgcaagtcgaacggagagttttcaccgtcgaagaggaagtgcttgcacggaattggagacaccgaaaaatcttagtggcggacgggtgagtaacgcgtgagcaacctggctttaagagggggacaacactgagaaatcagtgctaataccgcataagactcaagcatcgcatgatggaagagttaaaggagaaatccgcttaaagatgggctcgcgtcccattagttagttggcgaggtaacggctcaccaagacgacgatgggtagccggactgagaggttgaacggccacactgggactgagacacggcccagactcctacgggaggcagcagtggggaatattgggcaatgggcgaaagcctgacccagcaatgccgcgtgaatgaagaaggtcttaggattgtaaaattctgtcctatgggaagaaaaaaatgacggt

SEQ ID NO: 800 - DNA, 490 bp, Unknown
  Ascusbbf_191129, encodes 16S rRNA
agagtttgatcctggctcaggacgaacgctggcggcgtgcctaacacatgcaagtcgaacggagtaaggttcttcggaattttgcttagtggcgaacgggtgagtaacgcgtgagcaacctgcctctttgagggggataacaaccggaaacggttgctaataccgcataagaccacactgtcgcatggcagaggggtcaaaggagcaatccgcagagagaggggctcgcgtcccattaggtagacggcggggtaacggcccaccgtgccgacgatgggtagccgagctgagaggctgatcggccacactggaactgagacacggtccagactcctacgggaggcagcagtggggaatattgggcaatgggcgaaagcctgacccagcaacgccgcgtgagggaagaaggtcttcggattgtaaacctctgtccttggtgacgaaggaagtgacggtagccaaggaggaagccccggctaactacgtgcca

SEQ ID NO: 801 - DNA, 490 bp, Unknown
  Ascusbbf_74753, encodes 16S rRNA
agagtttgatcctggctcaggatgaacgctggcggcgtgcctaacacatgcaagtcgaacgattaaaccgccttcgggcggatataaagtggcgaacgggtgagtaacacgtgaccaacctaccccgcacatcgggacagccctccgaaagggggattaataccgaatactccgtatttttcgcatgattaatacgggaaagcttttgcggtgcgggatggggtcgcggcccatcaggtagtaggcggggcagcggcccgcctagccaacgacgggtagccgggttgagagaccgaccggccacattgggactgagatacggcccagactcctacgggaggcagcagtggggaatattgcgcaatgggggcaaccctgacgcagcaacgccgcgtgcgggatgaaggcattcgtgtcgtaaaccgctttcagcagggaagacatcgacggtacctgcagaagaagccccggctaactacgtgccagcagc

SEQ ID NO: 802 - DNA, 490 bp, Unknown
  Ascusbbf_511694, encodes 16S rRNA
agagtttgatcctggctcaggatgaacgctggcggcgtgcctaacacatgcaagtcgagcggggatgcgccaaagatgatgactcgtctgattcttagcgcatcttagcggcggatgggtgagtaacgcgtggacaacctgcccgcaacagggggataacagctggaaacggctgataataccgcatatgcacacggttccgcatgggactgggtggaaagatttatcggttgcggatgggtccgcgtcggattaactggttggtgaggtaacggcccaccaaggtgatgatccgtagccggcctgagagggcgaccggccacattgggactgagacacggcccaaactcctacgggaggcagcagtgggggatattgcacaatgggcgcaagcctgatgcagcgacgccgcgtgagcgaagaagtgcttcggtatgtaaagctctatcagcagggaagaagatgacggtacctgcagaagcagccccgg

SEQ ID NO: 803 - DNA, 490 bp, Unknown
  Ascusbbf_599273, encodes 16S rRNA
agagtttgatcctggctcaggacgaacgctggcggcgtgcttaacacatgcaagtcgagcggtaaggcctttcggggtacacgagcggcgaacgggtgagtaacacgtgagtaatctgcccttcactttgggataactaccggaaacggtggctaataccgaatatgacctccttctgcatggttgggggtggaaagttctggcggtgaaggatgtgctcgcggcctatcagcttgttggtgaggtaatggctcaccaaggcttcgacgggtagccggcctgagagggtgaccggccacactgggactgagacacggcccagactcctacgggaggcagcagtggggaatattggacaatgggcgaaagcctgatccagcaacgccgcgtgagggatgaatgccttcgggttgtaaacctctttcgcctgcgacgaagcgagagtgacggtagcaggtaaagaagcaccggccaactacgtgccagcagc

SEQ ID NO: 804 - DNA, 490 bp, Unknown
  Ascusbbf_374531, encodes 16S rRNA
agagtttgatcctggctcagaacgaacgctggcggcgtggattaggcatgcaagtcgtacgcgaaaccgggcttcggcctgggagtagagtggcgaactggtgagtacaaggtgactaacctgcccttgagtgggggataaccagccgaaaggttggctaataccgcatggtctctttggtctgcggaccaacgagtaaagcagtaatgcgctcgaggatggggtcaccccccattagcttgttggtagggtaatggcctaccaaagctgcgatgggtagctggactgagaggttgaccagccacactgggactgagatacggcccagactcctacggggggcagcagtctagaggcttcgacaatgcccgaaagggtgatcgagcgacgccgcgtgcgggatgacggtcttcggattgtaaaccgcttttacctgggaagaacgtgcgggtcgtgaacccgtgcttgacggtaccaggggaataagccc

SEQ ID NO: 805 - DNA, 490 bp, Unknown
  Ascusbbf_350853, encodes 16S rRNA
agagtttgatcctggctcaggacgaacgctggcggcgtgcctaacacatgcaagtcgagcgatgaaaatacaaatgatcccttcggggagaatgcgtgttggattagcggcggacgggtgagtaacacgtgagcaacctgcctatcacattgggatagcctcgggaaactgggattaataccgaatgaaacatagaattagcattaattcaatgtcaaagatttatcggtgatagatgggctcgcgtctgattagctagttggtgaggtaacggctcaccaaggcgacgatcagtagccggcctgagagggtgaacggccacattgggactgagacacggcccaaactcctacgggaggcagcagtggggaatattgcacaatggagggaactctgatgcagcgacgccgcgtgagcgaagaaggctttcgagtcgtaaagctctgtcctatgggaagataatgacggtaccataggaggaagccccggc

SEQ ID NO: 806 - DNA, 472 bp, Unknown
  Ascusbbf_73439, encodes 16S rRNA
agagtttgatcctggctcagaacgaacgctggcggcaggcttaacacatgcaagtcgaacgggcgtagcaatacgtcagtggcagacgggtgagtaacgcgtgggaatctacccagtggtttggaataactcagggaaacttgagctaataccggatacgcccttcgggggaaagatttatcgccattggaagagcccgcgtcggattagctagttggtggggtaatggcccaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgcctgggaagataatgacggtaccaggagaagaagccccggctaacttcgtgccagcagccgcggtaat

SEQ ID NO: 807 - DNA, 206 bp, Unknown
  Ascusbbf_82361, encodes 16S rRNA
agagtttgatcatggctcagaatgaacgctggcggcatggattaggcatgcaagtcgagaatcttccgcaatgggcgcaagcctgacggagcgatgccgcgtgagggacggaggccttcgggtcgtgaacctctgtcgcccgggacgatgatgacggtaccgggaaaggaagccacggctaaccacgtgccagcagccgcggtaat

SEQ ID NO: 808 - DNA, 490 bp, Unknown
  Ascusbbf_363834, encodes 16S rRNA
agagtttgatcctggctcaggatgaacgctagcggcaggcctaatacatgcaagtcgaacgggatctaattttaagcttgcttaagattagtgagagtggcgcacgggtgcgtaacgcgtgagcaacctacccatatcagggggatagcccggagaaatccggattaacaccgcatgacacagcaatttcgcatgataatgctgttaaatatttataggatatggatgggctcgcgtgacattagctagttggtaaggtaacggcttaccaaggctacgatgtctaggggctctgagaggagaatcccccacactggtactgagacacggaccagactcctacgggaggcagcagtaaggaatattggtcaatggagggaactctgaaccagccatgccgcgtgcaggatgactgccctatgggttgtaaactgcttttatccaggaataaacctttctacgtgtagggagctgaatgtactggaagaat

SEQ ID NO: 809 - DNA, 490 bp, Unknown
  Ascusbbf_188557, encodes 16S rRNA
agagtttgatcctggctcaggatgaacgctagctacaggcttaacacatgcaagtcgaggggcagcatggcggtggcttgccaccgctgatggcgaccggcgcacgggtgcgtaacgcgtatccaatctacccatggctcggggatagccttctgaaaggaagattaatacccgatggtcttttccgggggcatccccggtgaagtaaagttgttttacggcgatggatgaggatgcgaccgattaggtagttggtggggtaacggcccaccaagccatcgatcggtaggggttctgagaggaaggtcccccacactggaactgagacacggtccagactcctacgggaggcagcagtgaggaatattggtcaatgggcggaagcctgaaccagccaagtagcgtgcgggaagacggccctatgggttgtaaaccgcttttgttcgggaataatttgggggacgtgtcccccattgcatgtaccgttcga

SEQ ID NO: 810 - DNA, 470 bp, Unknown
  Ascusbbf_505249, encodes 16S rRNA
agagtttgatcctggctcagaacgaacgctggcggcaggcttaacacatgcaagtcgaacgcatccttcggggtgagtggcagacgggtgagtaacgcgtgggaacgtgcccttcagtttgggataacccagggaaacttgggctaataccggatacgtgcgagagcagaaagatttatcgctgaaggatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcgtccgggacgataatgacggtaccggaagaagaagccccggctaacttcgtgccagcagccgcggtaat

SEQ ID NO: 811 - DNA, 490 bp, Unknown
  Ascusbbf_731933, encodes 16S rRNA
agagtttgatcatggctcaggacgaacgctggcggcgtgcctaatacatgcaagtcgaacgcactctcgttagattgaagaagcttgcttctgattgataacatttgagtgagtggcggacgggtgagtaacacgtgggtaacctgccctaaagtgggggataacatttggaaacagatgctaataccgcataaaacctagcaccgcatggtgcaaggttgaaagatggtttcggctatcactttaggatggacccgcggtgcattagttagttggtgaggtaaaggctcaccaagaccgtgatgcatagccgacctgagagggtaatcggccacactgggactgagacacggcccagactcctacgggaggcagcagtagggaatcttccacaatggacgaaagtctgatggagcaacgccgcgtgagtgaagaaggttttcggatcgtaaaactctgttgttggagaagaacgtatttgatagtaact

SEQ ID NO: 812 - DNA, 490 bp, Unknown
  Ascusbbf_665112, encodes 16S rRNA
agagtttgatcctggctcaggatgaacgctagcgacaggcttaacacatgcaagtcgaggggcagcatggatgtagcaatacatttgatggcgaccggcgcactggtgagtaacacgtatgcaacctgccccgcgcagggggataacccgcggaaacgcggcctaataccccgtaattcccgttgtcgcatgacatcgggctgaaaggagcgatccggcgcgggatgggcatgcggcgcattaggcagttggcggggtaacggcccaccaagccgtcgatgcgtaggggttctgagaggaaggtcccccacactggtactgagacacggaccagactcctacgggaggcagcagtgaggaatattggtcaatgggcggatgcctgaaccagccaagtcgcgtgagggacgacggccctacgggttgtaaacctcttttgcgggggagtaaccggcggcgctcgcgccgccctgagagtaccccgcgaata

SEQ ID NO: 813 - DNA, 490 bp, Unknown
  Ascusbbf_1315779, encodes 16S rRNA
agagtttgatcatggctcaggacgaacgctggcggcgtgcttaacacatgcaagtcgagcgaagcctttcctttcggggagagtgacttagcggcgaacgggtgagtaacacgtgggcaacctgcccttagctctgggataagcgatggaaacgtcgtctaataccggatatgacatggggacgcatgttcttgtgtggaaagattttttggctaaggatgggcccgcggcctatcagcttgttggtggggtagtggcctaccaaggcggcgacgggtaaccggcctgagagggcgaccggtcacactgggactgagacacggcccagactcctacgggaggcagcagtggggaatattgcacgatgggcgaaagcctgatgcagcgacgccgcgtgagggatgacggccttcgggttgtaaacctctttcagcagggacgaagcgagagtgacggtacctgcagaagaagcgccggccaactacgtgcc

SEQ ID NO: 814 - DNA, 490 bp, Unknown
  Ascusbbf_1039910, encodes 16S rRNA
agagtttgatcctggctcaggacgaacgctggcggcgtgcctaacacatgcaagtcgaacggagttacttaggacggaggattcgtccaaagacctttgtaacttagtggcgaacgggtgagtaacgcgtgagcaatctgcctcggagtgggggacaacagttggaaacgactgctaataccgcataatgtgtcgggagggcatccttctgataccaaagctttatgtgctctgagatgagctcgcgtctgattagatagttggtggggtaacggcctaccaagtcgacgatcagtagccggactgagaggttgaacggccacattgggactgagatacggcccagactcctacgggaggcagcagtggggaatattgggcaatgggggaaaccctgacccagcaacgccgcgtgaaggaagaaggccctcgggttgtaaacttcttttaccagggacgaaggaagtgacggtacctggagaaaaagcca

SEQ ID NO: 815 - DNA, 265 bp, Unknown
  Ascusbbf_179683, encodes 16S rRNA
agagtttgatcctggctcaggatgaacgctagctacaggcttaacacatgcaagtcgaggggcatcaggattctagcttgctagaattgctggcgaccggcgcacgggtgagtaacgcgtatccaacctggcccttagtagaggatagcccggcgaaagtcggattaaactgcttttataggggaataaagtgaggcacttgtgcctttttgtatgtaccctatgaataaggaccggctaattccgtgccagcagccgcggtaat

SEQ ID NO: 816 - DNA, 490 bp, Unknown
  Ascusbbf_1624004, encodes 16S rRNA
agagtttgatcatggctcaggatgaacgctggcggcgtgcttaacacatgcaagtcgaacgatgaagcctagcttgctgggtggattagtggcgaacgggtgagtaacacgtgagtaacctgcccttgactctgggataagcctgggaaactgggtctaatactggatatgacctgtcaccgcatggtggtgggtggaaagttttttatggttggggatggactcgcggcctatcagtttgttggtgaggtagtggctcaccaaggcgacgacgggtagccggcctgagagggtgaccggccacactgggactgggacacggcccagactcctacgggaggcagcagtggggaatattgcacaatgggcgcaagcctgatgcagcgacgccgcgtgagggatgacggccttcgggttgtaaacctctttcagttaggaagaagccttttaggtgacggtactagcagaagaagcgccggctaactacgtg

SEQ ID NO: 817 - DNA, 490 bp, Unknown
  Ascusbbf_73725, encodes 16S rRNA
agagtttgatcatggctcaggatgaacgctggcggcgtgcctaacacatgcaagtcgaacggagtcgttttggaaatctcttcggagatggaattctcgacttagtggcggacgggtgagtaacgcgtgagcaatctgcctttaagagggggataacagtcggaaacggctgctaataccgcataaagcatcaaattcgcatgtttttgatgccaaaggagcaatccgcttttagatgagctcgcgtctgattagctggttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggccttcgggttgtaaagatctttaatcagggacgaaaaaaatgacggtacctgaagaataagctcc

SEQ ID NO: 818 - DNA, 490 bp, Unknown
  Ascusbbf_155492, encodes 16S rRNA
agagtttgatcatggctcaggacgaacgctggcggcgtgcctaatacatgcaagtcgtgcgggccttgttgaaagcttgcttttaacaaggctagcggcggacgggtgagtaacacgtgggcaacctgcctgtaagaccgggataacgccgggaaaccggggctaataccggatagttttttcctccgtatggaggaaaaaggaaaggcggcttcggctgccacttacagatgggcccgcggcgcattagctagttggcggggtaacggcccaccaaggcaacgatgcgtagccgacctgagagggtgatcggccacattgggactgagacacggcccaaactcctacgggaggcagcagtagggaatcttccgcaatggacgaaagtctgacggagcaacgccgcgtgagtgaagaaggccttcgggtcgtaaaactctgttgctggggaagaacatgtgccgttcgaacagggcggcaccttgacggt

SEQ ID NO: 819 - DNA, 490 bp, Unknown
  Ascusbbf_114270, encodes 16S rRNA
agagtttgatcatggctcaggacgaacgctggcggcgtgcctaacacatgcaagtcgaacgaggtccatgcagtggcaacactgcggaagacctagtggcgaacgggtgagtaacacgtgaggaacctgccccgaagaccgggataaccctccgaaaggagggctaataccggatacccccttcagatcgcatgatttgatgaggaaatggattccgcttcgggagggcctcgcggcctatcagctagttggtggggtaacggcctaccaaggcatcgacgggtagctggtctgagaggacgatcagccacactgggactgagacacggcccagactcctacgggaggcagcagtggggaatcttgcgcaatgggcgaaagcctgacgcagcaacgccgcgtgggggatgaaggctttcgggttgtaaacccctttcagcagggacgaatcaagacggtacctgcagaagaagccccggctaactacgtg

SEQ ID NO: 820 - DNA, 488 bp, Unknown
  Ascusbbf_5501, encodes 16S rRNA
agagtttgatcctggctcaggatgaatgctggcggcatgcctaatacatgcaagtcgagcggtaacaggactagcttgctagttgctgacgagcggcggacggctgagtaacgcatgggaacgcaccccaaactgagggataacgcaccgaaaggtgtgctaataccgcatgtgatcttcggattaaagctttcgggcggtttgggagcggcctgtgtacgattagatagttggtgaggtaatggctcaccaagtcgacgatcgttagatggtttgagaggatgatcatccagactgggactgagacacggcccagactcctacgggaggcagcagtagggaatctttcacaatgggcgaaagcctgatggagcaatgccgcgtgcaggacgaaggccttcgggttgtaaactgcttttataagcgaggaatatgacggtaacttatgaataaggatcggctaactacgtgccagcagccgcggtaat

SEQ ID NO: 821 - DNA, 490 bp, Unknown
  Ascusbbf_125002, encodes 16S rRNA
agagtttgatcatggctcaggacgaacgctggcggcgtgcctaatacatgcaagtcgaacgaaactttcttacaccgaatgcttgcattcaccgtaagaagttgagtggcggacgggtgagtaacacgtgggtaacctgcctaaaagaaggggataacacttggaaacaggtgctaataccgtatatctctaaggatcgcatgatccttagatgaaagatggttctgctatcgcttttagatggacccgcggcgtattaactagttggtggggtaacggcctaccaaggtgatgatacgtagccgaactgagaggttgatcggccacattgggactgagacacggcccaaactcctacgggaggcagcagtagggaatcttccacaatggacgcaagtctgatggagcaacgccgcgtgagtgaagaaggtcttcggatcgtaaaactctgttgttagagaagaacacgagtgagagtaactgttcattc

SEQ ID NO: 822 - DNA, 490 bp, Unknown
  Ascusbbf_135317, encodes 16S rRNA
agagtttgatcctggctcaggatgaacgctagctacaggcttaacacatgcaagtcgcggggcagcagggcgtcagcttgctgacgttgctggcgaccggcgcacgggtgcgtaacgcgtatccaacctacccatgagtcaggaacagcccggcgaaagtcggattaatgcctgatgccgtgtgaagatggcatctgattcacacgaaaggcctcggccgctgatggatggggatgcgtacgattaggtagtaggcggggcaacggcccacctagccatcgatcgttaggggttctgagaggaaggtcccccacactggtactgagacacggaccagactcctacgggaggcagcagtgaggaatattggtcaatgggcgcgagcctgaaccagccaagtagcgtgcaggatgacggccctatgggttgtaaactgcttttatgcggggataaatcgcgggacgtgtcctgcgttgcaggtaccgcatga

SEQ ID NO: 823 - DNA, 490 bp, Unknown
  Ascusbbf_16874, encodes 16S rRNA
agagtttgatcatggctcaggacgaacgctggcggcgtgcctaatacatgcaagtcgagcgaatgacgagaagcttgcttctctgatttagcggcggacgggtgagtaacacgtgggcaacctgccctgtagactgggataacttcgggaaaccggagctaataccggataatccatttcacctcatggtgaaatgttaaaaggcgcatctcgcgtcactacaggatgggcccgcggtgcattagctagttggtggggtaacggcctaccaaggcaacgatgcatagccgacctgagagggtgatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaacaagtacgttaggaaatgaacgtaccttgacggtacctta

SEQ ID NO: 824 - DNA, 490 bp, Unknown
  Ascusbbf_40070, encodes 16S rRNA
agagtttgatcatggctcaggacgaacgctggcggcgtgcttcaaacatgcaagtcgaacggagttaagtgaaagcttgcttttacttaacttagtggcggactggtgagtaacgcgtgaacaatctgcctatcacagggggataacagttggaaacgactgctaataccgcataagaccacagggtggcatcacctaggggtcaaaggagttaaatctggtgatagatgagtttgcgtatcattagctagttggtgagggtaacggcccaccaaggcaacgatgattagccgatctgagaggatgaccggccacactgggactgagatacggcccagactcctacgggaggcagcagttaggaatattgggcaatggaggaaactctgacccagcaacgccgcgtgaaggaagaaggttttcggactgtaaacttctgatctgagggaaaaagaaagtgatggtacctcaggagaaagccacggctaac

SEQ ID NO: 825 - DNA, 490 bp, Unknown
  Ascusbbf_26240, encodes 16S rRNA
agagtttgatcctggctcaggatgaacgctggcggcgtgcctaatacatgcaagtcgaacgggtacagctatgtactagtggcgaacgggtgagtaacacgttggtgacctgccccaaagatgggaatatcacctggaaacgggtggcaaaaccgaataagcttatgatagttagagagtcataagtaaaagagcgatctactttgggaggggcctgcggcccatcagttagttggtgagggtaacggcccaccaagacgaagacgggtaggggacctgagagggtggtcccccacaatggaactgaaacacggtccatacacctgcgggtggcagcagtagggaatattgctaaatgggcgaaagcctgaagcagcaacgccgcgtggacgaaggaggccttcgggtcgtaaagtccttttatgtgggaaaaggaaggatggtaccacatgaataagtctcggctaactacgtgccagcagccgcggta

SEQ ID NO: 826 - DNA, 490 bp, Unknown
  Ascusbbf_30259, encodes 16S rRNA
agagtttgatcctggctcagattgaacgctagcgggatgctttacacatgcaagtcgaacggcagcgcgggtcttcggacctggcggcgagtggcgaacgggtgagtaatatatcggaacgtgcccagtagcgggggataactacgcgaaagcgtggctaataccgcatacgccctacgggggaaagggggggatcgcaagacctctcactattggagcggccgatatcggattagctagttggtgaggtaaaggctcaccaaggctgcgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcagggaagaaacggcgccggataatacctggcgcaactgacggtacctgcagaataagc

SEQ ID NO: 827 - DNA, 487 bp, Unknown
  Ascusbbf_10191, encodes 16S rRNA
agagtttgatcatggctcagaatgaacgttggcggcatggattaggcatgcaagtcgcgcgagaaccgagaaagcttgctttcgaggggacagcggcgaaagggagagtaacaggtagatacctaccctcaggtttgggatagcgtcgggaaactggcggtaataccaaataatatctccggatcaaagctccggcgcctgaggatgggtctgcttcctattagcttgttggtggggtaatggcctaccaaggctacgatgggtagcgggcgtgagagcgtggcccgtctcactgggactgagacactgcccagacacctacgggtggctgcagtcgagaatcttcggcaatggacgcaagtctgaccgagcgatgccgcgtgcgggatgaaggccttcgggttgtaaaccgctgtcagagggaaggaaattttgactgaacctcagaggaagggcgggctaagttcgtgccagcagccgcggtaat

SEQ ID NO: 828 - DNA, 490 bp, Unknown
  Ascusbbf_13593, encodes 16S rRNA
agagtttgatcatggctcagaacgaacgctggcggcgtgcttaacacatgcaagtcgaacgcgaaagcggcttcggccgtgagtagagtggcgcacgggtgagtaacgcgtagataacctgtcttcatattcgggataacacgccgaaaggggtactaataccggatacgcttgtatttcataggcaaggcaaggaaaggtggcctctacatgtaagctactgtatgaagaggggtctgcgtaccattagctagtaggtggggtaatggcctacctaggcgacgatggttagcgggtctgagaggatgatccgccacactggcactggaatacgggccagactcctacgggaggcagcagtgaggaatattgcgcaatgggggcaaccctgacgcagcgacgccgcgtgagtgaggaaggtcttcggatcgtaaagctctgtcaagagggaagaagtgctgggtggctaatatccgccctgtttgacggt

SEQ ID NO: 829 - DNA, 490 bp, Unknown
  Ascusbbf_7524, encodes 16S rRNA
agagtttgatcctggctcaggacgaacgctggcggcgtgcctaacacatgcaagtcgaacgagaatttataaaaagattccttcgggatgaaatttgtaaaggaaagtggcggacgggcgagtaacgcgtgaataacctgcccataagagtggaataatccgtggaaacgcggactaataccgcatatagagtatgaatcgcatggttaatacttgaaagatttatcgcttatggatggattcgcgtcagattagatagttggagaggtaacggctcaccaagtcgacgatctgtagccgaactgagaggttgatcggccgcattgggactgagacacggcccagactcctacgggaggcagcagtggggaatattgcgcaatggggggaaccctgacgcagcaacgccgcgtgcaggaagaaggtcttcggattgtaaactgttgtcgcaagggaagaagaagatgacggtaccttgtgagaaagtcac

SEQ ID NO: 830 - DNA, 490 bp, Unknown
  Ascusbbf_66851, encodes 16S rRNA
agagtttgatcatggctcaggatgaacgctagcggcaggcttaacacatgcaagtcgaggggcatcgcgaggtagcaatactttggcggcgaccggcgaaagggtgagtaacgcgtgagcaacatgcccttgagcgggggatagtcattggaaacgatgcgtaataccccgtaacacaatttcccgcatgggtggttgttgaaagatttatcgctcaaggattggctcgcgtaccattaggtagatggcggggtaacggcccaccatgccgacgatggttaggggttctgagaggaaggtcccccacattggaactgagacacggtccagactcctacgggaggcagcagtgaggaatattggtcaatggccgagaggctgaaccagccatgccgcgtgcgggaggacggccctatgggttgtaaaccgcttttgtcggggagcaataatcaccacgtgtggtgagacgagagtacccggcgaataagca

SEQ ID NO: 831 - DNA, 490 bp, Unknown
  Ascusbbf_235419, encodes 16S rRNA
agagtttgatcctggctcaggatgaacgctagctacaggcttaacacatgcaagtcgcggggtaacatgtcgagttcttcggaacctgacgatgacgaccggcgcacgggtgagtaacgcgtatccaacctgcctgttacccgggtatagcccgccgaaaggcggattaatccccgatgtgtccgatgacggcatcagaattggacgaaaggtttggcggtaacagatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatgggcgcaagcctgaaccagccaagtagcgtgcaggacgacggccctatgggttgtaaactgcttttatgcggggataaagtgagggacgtgtcccttattgtaggtaccgcatgaa

SEQ ID NO: 832 - DNA, 490 bp, Unknown
  Ascusbbf_330788, encodes 16S rRNA
agagtttgatcatggctcaggacgaacgctggcggcacgcttaacacatgcaagtcgaacgaggtccacggagcttgctcctgaagaccgagtggcgaacgggtgagtaacacgtgagaaacctgccccgaagaccgggataactcaccgaaaggtgagctaataccggataccttcacgacgtctcctggcgatgtgaagaaatggattccgctttgggagggtctcgcggcctatcagcttgttggtgaggtaacggctcaccaaggcgacgacgggtagctgttctgagaggaagatcagccacactgggactgagacacggcccagactcctacgggaggcagcagtggggaatcttgcgcaatgggcgaaagcctgacgcagcgatgccgcgtgcgggaagacggccttcgggttgtaaaccgctttcagcagggacgaaattgacggtacctgcagaagaagctccggccaactacgtgccagc

SEQ ID NO: 833 - DNA, 490 bp, Unknown
  Ascusbbf_1617850, encodes 16S rRNA
agagtttgatcctggctcaggatgaacgctagcgacaggcttaacacatgcaagtcgaggggcagcggggtgtagcaatacattgccggcgaccggcgcacgggtgagtaacgcgtatgcaacttacctatcagaggggaatagcccggcgaaagtcggattaatgccccataaaacaggggtcccgcatgggactatttgttaaagattcatcgctgatagataggcatgcgttccattaggcagttggcggggtaacggcccaccaaaccaacgatggataggggttctgagaggaaggtcccccacattggaactgagacacggtccaaactcctacgggaggcagcagtgaggaatattggtcaatggacgtgagtctgaaccagccaagtcgcgtgaaggaagaaggttctatggattgtaaacttcttttatacgggaataaagtgcgccacgtgtggtgttttgtatgtaccgtatgaataag

SEQ ID NO: 834 - DNA, 488 bp, Unknown
  Ascusbbf_746, encodes 16S rRNA
agagtttgatcatggctcagaacgaacgctggcggcaggcttaacacatgcaagttgaacgggattggaaggtagcttgctatttttcatgagagtagcgcactggtgagtaacacgtgggaacgtacctattggtgggggacaacagttggaaacgactgctaataccgcataagccctgagggggaaagattaattgccgatagatcggcccgcggaagattaggtagtaggtggggtaacggcctacctagccgacgatctatagctggtctaagaggacgatcagccacattggaactgagacacggtccagactcctacgggaggcagcagtgaggaatattgggcaatggaggcaactctgacccagccatgccgcgtgagtgatgaaggttttcggattgtaaagctctttcagatgagaagatgatgacggtatcatcagaagaagcaccggctaacttcgtgccagcagccgcggtaat

SEQ ID NO: 835 - DNA, 490 bp, Unknown
  Ascusbbf_146686, encodes 16S rRNA
agagtttgatcctggctcaggatgaacgctggcggcgtgcctaatacatgcaagtcgagcgaatggattgagagcttgctctcaagaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtac

SEQ ID NO: 836 - DNA, 490 bp, Unknown
  Ascusbbf_1463, encodes 16S rRNA
agagtttgatcatggctcagattgaacgctggcggcaggcttaatacatgcaagtcgaacggtaacagtgaggaagcaattccttagctgacgagtggcggacgggtgagtaaagtttgggaatctgtcctgcagagggggatagcagctggaaacggctgataaaaccgcgtacgctctgaggaggaaagtgacgggatcagcgatgaccgtcagctgtagggtgagcccaaatgggattagctagtaggggtggtaaaggcacacctaggcgatgatctctagctggttttagcggatgaccagccacattggaactgagacacggtccaaactcctacgggaggcagcagtagggaatattgcacaatggagggaactctgatgcagccatgccgcgtgtgtgaagaaggccttcgggttgtaaagcacttttattatagagaagagtgggagtaataataagactgccatgagatgtaacataatg

SEQ ID NO: 837 - DNA, 490 bp, Unknown
  Ascusbbf_19689, encodes 16S rRNA
agagtttgatcctggctcaggatgaacgctagcgacaggcttaacacatgcaagtcgaggggcagcggggctggcaacagccgccggcgaccggcgcacgggtgagtaacacgtatgcgacctgcccgccacagggggataaccgggagaaatcccgactaataccgcgtaagcctacggggggcatcccccggaggtgaaagccacggcggtggcggatgggcatgcggggcattagctagacggcggggcaacggcccaccgtggcgacgatgcctaggggttctgagaggaaggtcccccacactggtactgagacacggaccagactcctacgggaggcagcagtgaggaatattggtcaatgggcgggagcctgaaccagccaagtcgcgtgagggatgaaggtcctatggattgcagacctcttttgccggggagcaacgtgcgccacgcgtggcgcagtgagagtacccggagaaaaagcatc

SEQ ID NO: 838 - DNA, 490 bp, Unknown
  Ascusbbf_3390, encodes 16S rRNA
agagtttgatcctggctcaggataaacgctggcggcgcgcataacacatgcaagtcgagcgagaggagtagcttcggttacgaatctagcggcggacgggtgagtaacacgtagacaacctgccttgtagagggggatagccggaagaagttccggataataccgcataatacattttaatcgcatgattggaatgggaaaggtgaataaccgctataagaggggtctgcgactgattagctagttggagtggtaacggcacaccaaggcgacgatcagtagccggtttgagagaatgaacggccacattgggactgagatacggcccagactcctacgggaggcagcagtggggaatattgcgcaatgggggaaaccctgacgcagcgacgccgtgtaaaggatgaaggtcttcggatcgtaaacttatatcgattgtgaaaagtaaggatggtagcaaagtaagaagccccggctaactacgtgccag

SEQ ID NO: 839 - DNA, 490 bp, Unknown
  Ascusbbf_3571, encodes 16S rRNA
agagtttgatcatggctcaggacgaacgctggcggcatgcctaacacatgcaagtcgaacggagttcgaggggcttgctccttgaacttagtggcggacgggtgagtaacgcgtgagtaacctgcctttcagtggggaataatattctgaaaagagtactaataccgcataacgtatagaagccgcatgacttttataccaaagatttatcgctgagagatggactcgcgtccgattagccagttggtgaggtaacggctcaccaaagcaacgatcggtagccggactgagaggttgaacggccacattgggactgagacacggcccagactcctacgggaggcagcagtgggggatattgtgcaatgggggaaaccctgacacagcaatgccgcgtgaaggatgaaggtcttcggattgtaaacttcttttgtcaaggacgataatgacggtacttgacgaataagctccggctaactacgtgccagca

SEQ ID NO: 840 - DNA, 490 bp, Unknown
  Ascusbbf_45998, encodes 16S rRNA
agagtttgatcctggctcaggacgaacgctggcggcgtgcctaacacatgcaagtcgaacggagtgaaagcagcttgctgctggagcttagtggcggacgggtgagtaacacgtgagtaacctgcctttcagaggggaataatgtttggaaacggacactaataccgcataacatacaatcaacgcatgttgaatgtatcaaaggagcaatccgctgaaagatggactcgcgtctgattagccagttggcggggtaacggcccaccaaagcgacgatcagtagccggactgagaggttgaacggccacattgggactgagacacggcccagactcctacgggaggcagcagtgggggatattgcacaatgggcgcaagcctgatgcagcaacgccgcgtgcaggaagacggtcttcggattgtaaactgttgtcctctgtgacgaaagatgacggtagcagaggaggaagccacggctaactacgtgcca

SEQ ID NO: 841 - DNA, 490 bp, Unknown
  Ascusbbf_16650, encodes 16S rRNA
agagtttgatcctggctcaggatgaacgctagctacaggcttaacacatgcaagtcgaggggcatcatgtatctggcttgccagatatgatggcgaccggcgcacgggtgcgtaacgcgtgttcgacctgccctttactcgggaacagcccatcgaaagatggattaatgcccgatgttctccttatgccgcatgacatttggagcaaagatttatcggtagaggatgggaacgcgtccgattagcttgacggcggggtaacggcccaccgtggcgacgatcggtaggggttctgagaggaaggtcccccacactggaactgagacacggtccagactcctacgggaggcagcagtgaggaatattggtcaatggccgtaaggctgaaccagccaagtagcgtgaaggatgactgccctatgggttgtaaacttcttttgtacgggaataacccggtccacgtgtggtccgctgcatgtaccgtacgaat

SEQ ID NO: 842 - DNA, 470 bp, Unknown
  Ascusbbf_4926, encodes 16S rRNA
agagtttgatcctggctcagaacgaacgctggcggcaggcttaacacatgcaagtcgaacggttccttcggggacagtggcagacgggtgagtaacacgtgggaatctacccagtccttcgggataactgatggaaacgtcagctaataccggatacgcccttatggggaaagatttatcgggattggatgagcccgcgtaagattagctagttggtggggtaatggcccaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcaccggtgaagataatgacggtaaccggagaagaagccccggctaacttcgtgccagcagccgcggtaat

SEQ ID NO: 843 - DNA, 490 bp, Unknown
  Ascusbbf_630747, encodes 16S rRNA
agagtttgatcatggctcaggacgaacgctggcggcgtgcctaacacatgcaagtcgaacggagctaaggaagcttgcttccggagcttagtggcggacgggtgagtaacacgtgagtaacctgcctttcagaggggaataatgtttggaaacggacactaataccgcataacgtatctgaaccgcatgattcggataccaaaggagcaatccgctgaaagatggactcgcgtctgattagccagttggcggggtaacggcccaccaaagcgatggtcagtagccggactgagaggttgaacggtcacattgggactgagacacggcccagactcctacgggaggcagcagtgggggatattgcacaatgggcgcaagcctgatgcagcaacgccgcgtgcaggaagacggtcttcggattgtaaactgttgtcctctgtgacgataatgacggtagcagaggaggaagccacggctaactacgtgccag

SEQ ID NO: 844 - DNA, 490 bp, Unknown
  Ascusbbf_7804, encodes 16S rRNA
agagtttgatcatggctcaggacgaacgctggcggcgtgcttcatacatgcaagtcgaacgtgattttggtgcttgcaccaaatgaaagtggcggacgggtgagtaatgtgtagagaatctgcccttgagtgggggacaacagttggaaacgactgctaataccccatatgcgcgtagttgagatactattcgtgaaagatttattgctcaaggatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgatcgtagacgcttttcggagtgtaaagatctgtcagtggggacgaattttgactgtacccacagaggaagcaccggctaactccgtgccagcagccg

SEQ ID NO: 845 - DNA, 490 bp, Unknown
  Ascusbbf_20244, encodes 16S rRNA
agagtttgatcctggctcaggatgaacgctggcggcgtgcctaatacatgcaagtcgaacggagcacttcggtgcttagtggcgaacgggtgagtaatatatgaacaacctacccctttgaccgggataacacactgaaaagcgtgctaataccggataggcgatcgagaggcatctcttgattattaaaggagcgcatgctccacattgggatgggttcatatcgcattagctagttggtgaggtaacggcccaccaaggcgatgatgcgtagccgatctgagaggatgaccggccacattgggactgagacacggcccagactcctacgggaggcagcagtagggaattttcggcaatgggcgcaagcctgaccgagcaacgccgcgtgaacgatgaaggtcttatggattgtaaagttctgttacgagggaagaacagcactgataggaaatgatcagtgtgtgacggtacctcgccagaaagccac

SEQ ID NO: 846 - DNA, 490 bp, Unknown
  Ascusbbf_10077, encodes 16S rRNA
agagtttgatcatggctcagaacgaacgctggcggcgcgtcttaagcatgcaagtcgaacggcaagaagagagcttgctctcttcctagagtggcggactggtgagtaacacgtgggtgacgtaccctttggacggggatagccgatagaaatatcgggtaataccggataaggacacacaggttggagctgtgtgtggaaagtagctacggctacgccgaaggaacggcctgcgacccatcagctagtaggtgaggtaagagcccacctaggcaatgacgggtatccggcctgagagggtgaacggacacattgggactgagatacggcccagactcctacgggaggcagcagctaagaatattccgcaatggacgaaagtctgacggagcgacgccgcgtggacgatgaaggccggaaggttgtaaagtccttttattattgaagaataatcagaagagggaatgcttctgaggtgaccgtagataat

SEQ ID NO: 847 - DNA, 490 bp, Unknown
  Ascusbbf_228882, encodes 16S rRNA
agagtttgatcatggctcaggatgaacgctagctacaggcttaacacatgcaagtcgaggggtaacatgatcggagcttgctccgattgatgacgaccggcgcacgggtgagtaacgcgtatccaacctgcccatgagtcagggataaccttccgaaagggagcctaatacctgatgttgtgcgatgatggcatcagagttgcaccaaagagttttgctcatggatggggatgcgtaggattaggcagtcggcggggtaacggcccaccgagccgacgatccttaggggttctgagaggaaggtcccccacactggtactgagacacggaccagactcctacgggaggcagcagtgaggaatattggtcaatggtcggaagactgaaccagccaagtagcgtgcaggacgacggccctacgggttgtaaactgcttttatgcggggataaagtcggggacgcgttccccgtttgcaggtaccgcatgaat

SEQ ID NO: 848 - DNA, 485 bp, Unknown
  Ascusbbf_21459, encodes 16S rRNA
agagtttgatcatggctcagaacgaacgctggcggcaggcttaacacatgcaagtcgaacggaacgtaggtagcttgctatctatgtcagtggcgcacgggtgagtaacgcgtaggaatctgtcctttagcctgggatagcctctggaaacggagggtaaaaccggatgagccctgagggggaaatgagaaatcagccgaaggaggagcctgcgttagattaggcagttggtggggtaatggcctaccaaaccgacgatctatagctggtctgagaggatgatcagccacattgggactgagacacggcccaaactcctacgggaggcagcagtggggaatattggacaatgggggagaccctgatccagccatgccgcgtgagtgatgacggccttcgggttgtaaagctcttttacatgggaagatgatgacggtaccatgagaataagcaccggcaaacttcgtgccagcagccgcggtaat

SEQ ID NO: 849 - DNA, 490 bp, Unknown
  Ascusbbf_71572, encodes 16S rRNA
agagtttgatcatggctcaggatgaacgctggcggcgtgcctaatacatgcaagtcgaacgaggtggatgggagcttgctccttgatacctagtggcgaacgggtgagtaacacgtaggtaacctgcccttaagcttgggatacccagaggaaactttggctaataccggataacaacagaagaggcatctcttttgtttgaaaggcccttcacggggtcacttaaggatggacctgcggcgcattagctagttggtgagataacagcccaccaaggcgaggatgcgtagccgacctgagagggtgatcggccacattggaactgagacacggtccaaactcctacgggaggcagcagtaaggagttttcggcaatgggggaaaccctgaccgagcaacgccgcgtgagtgatgacggccctatgggttgtaaagctctgttgtgagggacgaatgactagtcgaggaaatgcgattagtttgacggtac

SEQ ID NO: 850 - DNA, 490 bp, Unknown
  Ascusbbf_24806, encodes 16S rRNA
agagtttgatcatggctcaggatgaacgctggcggcgtgcctaacacatgcaagtcgagcgagaagttcatgaagaattcttcggaggacggattgagcggaaagcggcggacgggtgagtaacgcgtaggtaacctgccctgtacaaagggatagccactggaaacggtgattaataccttatgataccggacagtcacatggttgaccggtcaaagattttatcggtacaggatggacctgcgtctgattagttagttggtgaggtaacggctcaccaaggcgacgatcagtagccgacctgagagggtgatcggccacattggaactgagacacggtccaaactcctacgggaggcagcagtggggaatattgcacaatgggcgcaagcctgatgcagcaacgccgcgtgaacgaagaaggctcttgggtcgtaaagttctgttctgagggaagaagaaagtgacggtacctcaggagaaagccccg

SEQ ID NO: 851 - DNA, 470 bp, Unknown
  Ascusbbf_715764, encodes 16S rRNA
agagtttgatcatggctcagaacgaacgctggcggcaggcttaacacatgcaagtcgagcacctcagcaatgaggagcggcagacgggtgagtaacgcgtgggaatctacccatctctacggaacaactgcgggaaactggagctgataccgtatacgtccttcgggagaaagatttatcggagatggatgagcccgcgttggattagctagttagtagggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaactacgtgccagcagccgcggtaat

SEQ ID NO: 852 - DNA, 490 bp, Unknown
  Ascusbbf_69157, encodes 16S rRNA
agagtttgatcctggctcagattgaacgctagcgggatgctttacacatgcaagtcgaacggcagcgcggacttcggtctggcggcgagtggcgaacgggtgagtaatatatcggaacgtgcccagtagcgggggataactacgcgaaagcgtggctaataccgcatacgccctacgggggaaagggggggatcgcaagacctctcactattggagcggccgatatcagattagctagttggtggggtaaaggcccaccaaggctgtgatctgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcagggaagaaacggcaccggctaataccgggtgtcactgacggtacctgcagaataagcac

SEQ ID NO: 853 - DNA, 490 bp, Unknown
  Ascusbbf_22010, encodes 16S rRNA
agagtttgatcatggctcaggattaacgctggcggcgtgcctaatacatgcaagtcgaatggtagcaataccatggcgaacgggtgagtaacacgtaggtaacctgtccttaagacgaggataaccattggaaacgatggataatactggataggagtgattgaggcatcttgattgctttaaagatttatcacttgaggaggggcctgcggcgcattagctagatggcggggtaatagcccaccatggcgatgatgcgtagccggactgagaggttgaacggccacaatggaactgagaacggtccatactcctacgggaggcagcagtagggaattttcggcaatgggcgaaagcctgaccgagcaacgccgcgtgaacgaagaagtatttcggtatgtaaagttcttttattggggaagaaaagataaagattgacggtacccaatgaataagctccggctaactacgtgccagcagccgcggtaat

SEQ ID NO: 854 - DNA, 490 bp, Unknown
  Ascusbbf_58294, encodes 16S rRNA
agagtttgatcatggctcagattgaacgctggcggcgtgcttaacacatgcaagtcgagcggtaacgcgggggcaaccctggcgacgagcggcgaacgggtgagtaatgcttcggaatcttcccggtggtggggaataacttggggaaactcaagctaataccgcatacgacctacgggtgaaagcaggggatcgcaagaccttgcgccattggatgagccgaagtcggattagctagttggtggggtaaaggcctaccaaggcgacgatccgtagctggtctgagaggacgaccagccacactgggactgagacacggcccagactcctacgggaggcagcagtggggaatattggacaatgggggaaaccctgatccagcgacgccgcgtgtgtgaagaaggcctgcgggttgtaaagcacttttagtagggatgaaaagccaagggctaatatcctttggtgttgacctaacctacagaaaaagcac

SEQ ID NO: 855 - DNA, 490 bp, Unknown
  Ascusbbf_104018, encodes 16S rRNA
agagtttgatcatggctcagaacgaacgctggcggcgcgtcttaagcatgcaagtcgagcggcaaggtaaagcttgctttaccctagagcggcggactggtgagtaacgcgtgggtgacgcaccccctcggcggggatagcctgcagaaatgcagggtaataccggataagccggcttccgttggaggggagccgggaaaggagccattgctccgcgaggggagcggcccgcgtcccatcagctagtaggcggtgtaacggaccacctaggctatgacgggtacccggcctgagagggcggacgggcacattgggactgagatacggcccagactcctacgggaggcagcagctaagaatattccgcaatgggcgaaagcctgacggagcgacgccgcgtggacgatgaaggccggaaggttgcagagtcctttggcgcgcgaggaaggaggggaggagtggaaagcctccccggtgactgtagcgcgag

SEQ ID NO: 856 - DNA, 490 bp, Unknown
  Ascusbbf_133455, encodes 16S rRNA
agagtttgatcctggctcaggataaacgctagcggcaggcctaacacatgcaagtcgagcggcagcacgaagtagcaatattttggtggcgagcggcggacgggtgagtaacgcgtatgcaacctgcccatcacacggagatagccgaccgaaaggacgattaaactccgatggcatcaagagggggcatccccatttgattaaatattcataggtgatggatgggcatgcgtggcattagttagttggcggggcaacggcccaccaagacgatgatgcctatgggttctaaaaggaagatcccacacatcggtactgagacacggaccgaactcctacgggaggcagcagtgaggaatattggacaatgggggcaaccctgatccagccaaaccgcgtgggggaaggaggccgttaaggtcgtaaaccccttttatatgggagcaatccgcttcatgtatggagcgttgagagtaccatttgaataagc

SEQ ID NO: 857 - DNA, 490 bp, Unknown
  Ascusbbf_65575, encodes 16S rRNA
agagtttgatcctggctcaggatgaacgctagctacaggcttaacacatgcaagtcgaggggcatcacgtgaggcagcaatgcatctgggtggcgaccggcgaatgggtgagtaacgagtatccaacctggcccatactcgggcacagccccgcgaaagcgggattaatgcccgatgcggcgtatttcccgcatgggaattacgtcaaaggtataaactggtatgggatggggatgcgtccgattagctagacggcggggtaacggcccaccgtggcgatgatcggtaggggttctgagaggaaggtcccccacattggaactgagacacggtccaaactcctacgggaggcagcagtgaggaatattggtcaatggccgcaaggctgaaccagccaagtagcgtgagggatgaccgccctatgggtcgtaaacctcttttgcgcgggaataatccgcactacgtgtagtgcgttgcatgtaccgtgcga

SEQ ID NO: 858 - DNA, 468 bp, Unknown
  Ascusbbf_20773, encodes 16S rRNA
agagtttgatcatggctcagaacgaacgctggcggcaggcctaacacatgcaagtcgaacgccccgcaaggggagtggcagacgggtgagtaacgcgtgggaacctacctagtggtacggaataactcggggaaacccgtgctaataccggataagcccgaaaggggaaagatttatcgccattagatgggcccgcgtcggattagcttgttggtgaggtaatggctcaccaaggcgacgatccgtagctggtctgagaggatgatcagccacactgggactgagacacggcccagactcctacgggaggcagcagtggggaatattggacaatgggggaaaccctgatccagccatgccgcgtgagtgacgaaggccttagggttgtaaagctcttttggcggggacgataatgacggtacccgcagaataagccccggctaacttcgtgccagcagccgcggtaat

SEQ ID NO: 859 - DNA, 490 bp, Unknown
  Ascusbbf_102571, encodes 16S rRNA
agagtttgatcctggctcaggacgaacgctggcggcgtgcttaaaacatgcaagtcgaacgggaagttgagaagcttgcttttcaacttctagtggcggacgggtgagtaacgcgtgagtaacctgcctactacaggggaataacacagagaaatttgtgctaataccgcataagaccacaggatggcatcatctaggggtcaaaggagcaatccggtagtagaggggcttgcgtctcattagcttgttggtggggtaacggcctaccaaggcaacgatgagtagccgatctgagaggatgaacggccacactggaactgagaaacggtccagactcctacgggaggcagcagttaggaatattgggcaatggaggaaactctgacccagcaacgccgcgtgaaggatgaaggttttcggattgtaaacttctgatctgagggaaaaagaaagcgatggtacctcaggagaaagccacggctaactacgt

SEQ ID NO: 860 - DNA, 490 bp, Unknown
  Ascusbbf_394443, encodes 16S rRNA
agagtttgatcatggctcaggacgaacgctggcggcgtgcctaatacatgcaagtcgagcgaaccaattgaaagcctagctttcatgaggttagcggcggacgggtgagtaacacgtgggtaacctgccctatagactgggataactcgcggaaacgcgtgctaataccggataacacatcagagtgcatactttgatgttgaaagatggttctgctatcactataggatgggcccgcggcgcattagcttgttggtggggtaacggcctaccaaggcgacgatgcgtagccgacctgagagggtgatcggccacactgggactgagacacggcccagactcctacgggaggcagcagtagggaatcttccacaatgggcgaaagcctgatggagcaacgccgcgtgagcgaagaaggtcttcggatcgtaaagctctgttgtaagggaagaacaagtgcagtagtaactggctgcaccttgacggtacc

SEQ ID NO: 861 - DNA, 490 bp, Unknown
  Ascusbbf_113623, encodes 16S rRNA
agagtttgatcctggctcaggatgaacgctggcggcgtgcataacacattcaagtcgaacggagttaagggcttcggtccttaacttagtggcggacgggtgagtaacgcgtgagcaacctgcccctgtgtgtgggataacgtctggaaacggacgctaataccgcatgaaccaacgggaccgcatgattctgttggcaaagatttattgcacagggatgggctcgcgtccgattagatagttggtggggcaacggcctaccaagtcgacgatcggtagccggactgagaggttgaacggccacattggaactgagagacggtccagactcctacgggaggcagcagtggggaatattgggcaatgggcgaaagcctgacccagcgacgccgcgtgaaggaagacggtcttcggattgtaaacttcttttatgtaggacgaagagagtgacggtactacaagaataagccacggctaactacgtgccagc

SEQ ID NO: 862 - DNA, 490 bp, Unknown
  Ascusbbf_194010, encodes 16S rRNA
agagtttgatcatggctcagaacgaacgctggcggcgcgtcttaagcatgcaagtcgagcggcaagctgccttcgggcagcctagagcggcggactggtgagtaacgcgtggatgacgcaccctcgcgacggggatagcctgtggaaacacagggtaataccggataagccgggcattgttggaggatgtccgggaaaggggctattgccccgcgggaggagcggtccgcgtcccatcagctggtaggcggtgtaacggaccacctaggcgatgacgggtacccggcctgagagggcggacgggcacattgggactgagatacggcccagactcctacgggaggcagcagctaagaatattccgcaatgggcgaaagcctgacggagcgacgccgcgtggacgatgaaggccggaaggttgcagagtcctttggcgcgcgaggaaggaggggaggaatggaaagcctccccggtgactgtagcgcgagaa

SEQ ID NO: 863 - DNA, 490 bp, Unknown
  Ascusbbf_124726, encodes 16S rRNA
agagtttgatcctggctcaggacgaacgctggcggcacgcttaacacatgcaagtcgaacggtgaagatgcttcggtatcggaacagtggcggacgggtgagtaacacgtgagcaatctgcctttaagagtggaatagcaactggaaacggttggtaataccgcataatatacatttaccgcatgatagatgtatcaaagatttatcgcttaaagatgagctcgcgtctgattagctagttggtgaggtaacggcccaccaaggcgacgatcagtagccggactgagaggttgaacggccacattgggactgagacacggcccagactcctacgggaggcagcagtggggaatattgcacaatgggcgcaagcctgatgcagcgatgccgcgtgagggaagaaggttttcggattgtaaacctctgttgacagggacgataatgacggtacctgttcagaaagctccggctaactacgtgccagcagccg

SEQ ID NO: 864 - DNA, 490 bp, Unknown
  Ascusbbf_239868, encodes 16S rRNA
agagtttgatcatggctcaggacgaacgctggcggcgtgcctaacacatgcaagtcgaacggagataatttgaatgaagatttcggttggaattcgttttatcttagtggcggacgggtgagtaacgcgtgagtaacctgccgatgagagtggaataacgttctgaaaagaacgctaataccgcataacatatcgaaaccgcatgattttgatatcaaagattttatcgctcatcgatggactcgcgtccgattagccagttggcggggtaacggcccaccaaagcaacgatcggtagccggactgagaggttgaacggccacattgggactgagacacggcccagactcctacgggaggcagcagtgggggatattgcgcaatgggggcaaccctgacgcagcaacgccgcgtgaaggatgacggtcttcggattgtaaacttcttttgttaaggacgaagaaagtgacggtacttaacgaataagctc

SEQ ID NO: 865 - DNA, 490 bp, Unknown
  Ascusbbf_99590, encodes 16S rRNA
agagtttgatcctggctcaggatgaacgctggcggcgtgcctaacacatgcaagtcgaacgggaaccatcggatcggagattcgtcaaagagagggtggttttagtggcggacgggtgagtaacgcgtgggtaacctgcctcaaagagggggataacagttggaaacgattgctaataccgcataagcgcacgttcccgcatgggaacgggtgaaaaggaattatcgctttgagatggacccgcgtctgattaactagttggtggggtaacggcccaccaaggttacgatcagtagccggactgagaggttggacggccacattgggactgagacacggcccaaactcctacgggaggcagcagtgggggatattgcacaatgggggaaaccctgatgcagcgacgccgcgtgggtgaagaagtttttcggaatgtaaagccctatcagcagggaagatgatgacggtacctgactaagaagccccggct

SEQ ID NO: 866 - DNA, 490 bp, Unknown
  Ascusbbf_102028, encodes 16S rRNA
agagtttgatcatggctcaggacgaacgctggcggcgtgcttaacacatgcaagtcgaacgatgaactgggtgcttgcacctggggattagtggcgaacgggtgagtaacacgtgagtaacctgccctggactctgggataaccccgagaaatcggagctaataccggataggaccctgtaccgcatggtgtggggtggaaagtttttcggtttgggatggactcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgcgggatgacggccttcgggttgtaaaccgcttttagtagggaagaagggcttcggcttgacggtacctgcagaaaaaggaccggctaactacgt

SEQ ID NO: 867 - DNA, 490 bp, Unknown
  Ascusbbf_1560936, encodes 16S rRNA
agagtttgatcctggctcaggatgaacgctggcggcgtgcttaacacatgcaagtcgaacggggtacccttgattgaggcttcggccgattgataggactacctagtggcggacgggtgcgtaacacgtgagtaacctgcccttcagagggggacaacagttggaaacgactgctaataccgcataacgtatgagtatcgcatggtacacataccaaagattttatcgctgaaggatggactcgcggccgattagctagttggtggggtaacggcctaccaaggcgacgatcggtagccggactgagaggttgaccggccacattgggactgagacacggcccagactcctacgggaggcagcagtggggaatattgcacaatgggcgcaagcctgatgcagcaacgccgcgttaaggatgaaggttttcggatcgtaaacttatgtcttcagggacgaaatttgacggtacctgaggaggaagccacgg

SEQ ID NO: 868 - DNA, 490 bp, Unknown
  Ascusbbf_1817314, encodes 16S rRNA
agagtttgatcctggctcaggatgaacgctggcggcgtgcttaacacatgcaagtcgaacgggcagagatcagagaagttttcggatggaactgaaggaagctagtggcggacgggtgagtaacgcgtaaacaatctgccttagagagggggataacagatagaaatatttgctaataccgcataagaccacgttagggcatcctaatggggtaaaaggaggaatccgctttaagatgagtttgcgtactattagctagttggtgaggtaacggcccaccaaggcaacgatggttagccggcctgagagggtgaacggccacattggaactgagaacggtccagactcctacgggaggcagcagtgaggaatattgggcaatggaggaaactctgacccagcaacgccgcgtgaaggaagaaggttttaggattgtaaacttctgttataggggaagaaaaggtgacggtaccctatgagaaagctacgg

SEQ ID NO: 869 - DNA, 490 bp, Unknown
  Ascusbbf_431008, encodes 16S rRNA
agagtttgatcatggctcagaacgaacgctggtagcgtggattaggcatgcaagtcgaacgggatccatgaagtagcaatacggattggtgagagtggcggaagggcgaggaacacgtgagcaacctgtccttgaggtggggaaaaccgttggaaacgacggctaataccgaatgtggcgcccggagacatctccggagcgctaaagggggcgaaagctctccctcttcgaggggctcgcgcaccatcagcttgttggcggggtaacggcccaccaaggcttacggttagctggtctgagaggatggccagccgcactgggactgagatactgcccagactcctacgggaggctgcagtcgaggatcattcgcaatgggggaaaccctgacgatgcgacgctgcgtggaggatgaaggccttcgggttgtaaactcctgtcatgatggaaaaggagaggggacctaatacgtcccttatttgatggtaca

SEQ ID NO: 870 - DNA, 490 bp, Unknown
  Ascusbbf_191987, encodes 16S rRNA
agagtttgatcatggctcaggatgaacgctagcggcaggcttaacacatgcaagtcgaggggcagcaggctgtagcaatacggtgctggcgaccggcgcaagggtgcgtaacgcgtgagcaacatacccgtcacagggggataagcgatggaaacgtcgtctaataccgcataaaacttagggcggcatcgtccggagttgaaacttacgagggtgacggattggctcgcgagacattagctagtcggcggggtaacggcccaccgaggctacgatgtctaggggttctgagaggaaggtcccccacactggaactgagacacggtccagactcctacgggaggcagcagtgaggaatattggacaatggccggaaggctgatccagccatgccgcgtgcaggaagacggtcctatggattgtaaactgcttttgtacgggagcaataagggcgtcgtgacgtccgatgagagtaccgtacgaataagca

SEQ ID NO: 871 - DNA, 490 bp, Unknown
  Ascusbbf_105165, encodes 16S rRNA
agagtttgatcctggctcaggacgaacgctggcggcgtgcctaacacatgcaagtcgaacggagtcatacgacggaagttttcggatggaagatgtattgacttagtggcggacgggtgagtaacgcgtgagtaacctgcctttcagagggggacaacatttggaaacgaatgctaataccgcataatgtatttttaccgcatgatagagataccaaaggagcaatccgctgaaagatggactcgcgtccgattagatagttggtgaggtaacggctcaccaagtcgacgatcggtagccggactgagaggttgaacggccacattgggactgagacacggcccagactcctacgggaggcagcagtgggggatattgcacaatgggcgaaagcctgatgcagcaacgccgcgtgagggaagacggttttcggattgtaaacctctgttcttagtgaagaaacaaatgacggtagctaagcagcaagcca

SEQ ID NO: 872 - DNA, 490 bp, Unknown
  Ascusbbf_734888, encodes 16S rRNA
agagtttgatcatggctcaggatgaacgctagcggcaggcttaacacatgcaagtcgaggggcagcgaggatagcaatatctgtcggcgaccggcggaagggtgagtaacgcgtgagcaacatgcccgcatcagggggatagtcactggaaacggtgcgtaataccccgtaacatcatgtgaggcatctcatatggttgaaagattaatcggatgcggattggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccgggaggctgatccagccatgccgcgtgatggagtaaggccctatgggtcgtaaacatcttttctcgggaggcaataagggccacgagctggtccgatgagagtacccggggaataagcat

SEQ ID NO: 873 - DNA, 490 bp, Unknown
  Ascusbbf_929471, encodes 16S rRNA
agagtttgatcatggctcaggatgaacgctagctacaggcttaacacatgcaagtcgcggggcagcatgtatctggcttgccagatatgatggcgaccggcgcacgggtgagtaacgcgtatccaacctgccccttaccacgggatagccctccgaaagggggattaataccgtatgtggccacgagacggcatccgaccgtggctaaaggtttagcggtaagggatggggatgcgtctgattagccagccggcggggtaacggcccaccggggcgacgatcagtaggggttctgagaggaaggtcccccacattggaactgagacacggtccaaactcctacgggaggcagcagtgaggaatattggtcaatgggcgcgagcctgaaccagccaagtagcgtgagggaagacggccctacgggttgtaaacctcttttgcgcggggataaactgcgccacgtgtggcgttttgcaggtaccgcgcgaat

SEQ ID NO: 874 - DNA, 490 bp, Unknown
  Ascusbbf_93189, encodes 16S rRNA
agagtttgatcctggctcaggatgaacgctagcgacaggcctaacacatgcaagtcgaggggtaacagggagcttgctccgctgacgaccggcgcacgggtgagtaacgcgtatgcaacctgcccgcaacattgggataatccggcgaaagtcggtctaataccgaatgatatcaattgatcgcatgtttaattgattaaagatttattggttgcggatgggcatgcgtagcattaggcagttggtgaggtaacggctcaccaaaccgacgatgcttaggggttctgagaggaaggtcccccacactggtactgagacacggaccagactcctacgggaggcagcagtgaggaatattggtcaatggacgcaagtctgaaccagccaagtcgcgtgcaggaagactgccctatgggttgtaaactgcttttatataggaataaagttagttacgtgtagctatttgcatgtactatatgaataaggatcg

SEQ ID NO: 875 - DNA, 490 bp, Unknown
  Ascusbbf_278793, encodes 16S rRNA
agagtttgatcatggctcaggatgaacgctggcggcgtgcttaacacatgcaagtcgaacggacttgttctaaaggcgagcgaagtgcttgcattgaactcaactgtgaacaagttagtggcggacgggtgagtaacgcgtgggtaacctgcctttatcagggggataacagttagaaatgactgctaataccgcataagcgcacagtgaggcatctcacggtgtgaaaagatttatcggatagagatggacccgcgttagattagccagttggcggggtaacggcccaccaaagcgacgatctatagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaa

SEQ ID NO: 876 - DNA, 490 bp, Unknown
  Ascusbbf_731332, encodes 16S rRNA
agagtttgatcctggctcaggacgaacgctggcggcgtgcctaacacatgcaagtcgagcggggatgcaaggaacggaggcttcggcagaagggagctgcattccagcggcggacgggtgagtaacgcgtgaacaatctgtcccgaacagggggataacacttggaaacaggtgctaataccgcataagaccacagcaccgcatggtggaggggtcaaaggagagatccggtttagggtgagttcgcgtctgattagatagttggtgaggtaacggcccaccaagtcaacgatcagtagccgacctgagagggtgatcggccacattggaactgagagacggtccaaactcctacgggaggcagcagtgggaatattgggcaatgggcgaaagcctgacccagcaacgccgcgtgagggaagaaggttttcggattgtaaacctctgttgtggatgacgaaggaagtgacggtaatccacaaggaagccc

SEQ ID NO: 877 - DNA, 490 bp, Unknown
  Ascusbbf_1527014, encodes 16S rRNA
agagtttgatcctggctcaggatgaatgctggcggcgtgcctaatacatgcaagtcgagcggtaacagggggtctcaccgtttccttgacacacctagcgctatgatcgtaggttgtgcaaatctcgagggaacagtgagaccctgctgacgagcggcggacggctgagtaacgcgtgggaacggaccccaaactgagggataactactcgaaagagtggctaataccgcatgtgatcttcggattaaagtcttcggacggtttgggactggcctgcgtacgattagatagttggtgaggtaatggctcaccaagtcgacgatcgttagatggtttgagaagatgatcatccagactgggactgagacacggcccagactcctacgggaggcagcagtagggaatctttcacaatgggcgaaagcctgatggagcaacgccgcgtgcaggatgacggccttcgggttgtaaactgcttttataaccgaga

SEQ ID NO: 878 - DNA, 490 bp, Unknown
  Ascusbbf_36703, encodes 16S rRNA
agagtttgatcctggctcaggatgaacgctggcggcgtgcttaacacatgcaagtcgaacgggaattactttattgaaacttcggtcgatttaatttaattctagtggcggacgggtgagtaacgcgtgggtaacctgccttatacagggggataacagtcagaaatgactgctaataccgcataagcgcacggaaccgcatggttctgtgtgaaaaactccggtggtataagatggacccgcgttggattagcttgttggcagggtaacggcctaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggcta

SEQ ID NO: 879 - DNA, 490 bp, Unknown
  Ascusbbf_10846, encodes 16S rRNA
agagtttgatcatggctcagattgaacgctggcggcaggcttaacacatgcaagtcgaacggtagcaggaagaagcttgcttctttgctgacgagtggcggacgggtgagtaatgcttgggaatctggcttatggagggggataactactggaaacggtagctaataccgcgtaatgtctaaggactaaagggtgggactttcgggccacctgccataagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgatgaggaaggcagataagttaatagcttatttgattgacgttagtcacagaag

SEQ ID NO: 880 - DNA, 490 bp, Unknown
  Ascusbbf_1959, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacagggggataacggagggaaacttccactaataccccatattgttattctttcgcatgttgggatgacgaaagcttcggtggttacggatgggcatgcgtgacattaggtagttggtgaggcaacggctcaccaagccgacgatgtctaggggagctgagaggcttatcccccacactggtactgagacacggaccagactcctacgggaggcagcagtgaggaatattggtcaatggacggaagtctgaaccagccatgccgcgtggaggaagaaggtcctatgggttgtaaactccttttgttcgagagtaataagtgggatgcgtcccacgatgagagtatcggacgaataagc

SEQ ID NO: 881 - DNA, 490 bp, Unknown
  Ascusbbf_6599, encodes 16S rRNA
agagtttgatcatggctcaggacgaacgctggcggcacgcctaacacatgcaagtcgaacggacgagaaggagcttgcttcttcaagttagtggcggacgggtgagtaacacgtgagcaacctgcctttgagagggggatagcttctggaaacggatggtaataccccataacatacatttttcgcatggagagtgtatcaaatgaatttcgctcgaagatgggctcgcgtctgattagatagttggtgaggtaacggctcaccaagtcgacgatcagtagccggactgagaggttgaacggccacattgggactgagacacggcccagactcctacgggaggcagcagtggggaatattgcacaatgggggaaaccctgatgcagcgatgccgcgtggaggaagaaggttttcggattgtaaactccttttatgagggacgataatgacggtacctcaagaaaaagctccggctaactacgtgccagca

SEQ ID NO: 882 - DNA, 490 bp, Unknown
  Ascusbbf_86522, encodes 16S rRNA
agagtttgatcatggctcagaatgaacgctggcggcatggattaggcatgcaagtcgaacgagaaagcccgcaagggcgagtaaagtggcgaaagggtgagtaacacgtgagcaacctgcccccgagaccggaacaagcctgggaaaccgggtctgaaaccggatgaggaccgggaaggcatcttcccgcctccaaacattcatggctcggggatgggctcgcggcccattagctcgttggcggggtaacggcccaccaaggctacgacgggtaggtggtctgagaggatggtcacccacactgggactgagacactgcccagactcctacgggaggctgcagtcgagaatcttccgcaatgggcgaaagcctgacggagcgatgccgcgtgagggacgaaggccttcgggtcgtaaacctctgtcgcaggggacgaaacaaaatgacggtaccctgcaagaaagccacggctaactacgtgccagcagc

SEQ ID NO: 883 - DNA, 490 bp, Unknown
  Ascusbbf_71021, encodes 16S rRNA
agagtttgatcctggctcaggacgaacgctggcggcgtgcttaacacatgcaagtcgaacgctgaagcactagcttgctggtgtggatgagtggcgaacgggtgagtaacacgtgagcaacctgccctggactctgggataagcgctggaaacggtgtctaatactggatatgacctatcaccgcatggtgtgtaggtggaaagatttatcggtttgggatgggctcgcggcctatcagcttgatggtgaggtagtggctcaccatggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagccttttaggtgacggtacttgcagaaaaagcgccggctaactacg

SEQ ID NO: 884 - DNA, 489 bp, Unknown
  Ascusbbf_62291, encodes 16S rRNA
agagtttgatcctggctcagaacgaacgctggcggcatggattaggcatgcaagtcgaacgaagtagcaatacttagtggcgcaagggtgaggaacacgtgagtgacctacccgcaagtttggaacagctcctggaaacgggaattaataccggatgtgatcatatttctgcatggagatatgattaaagcagtaatgcgcttgcggctgggctcgcgtcccattagctagttggtgaggtaacggcccaccaaggccatgatgggtagctggtctgagaggacgaccagccacactgggactgagaactgcccagactcctacgggaggctgcagtcgagaattttgggcaatggacgaaagtctgacccagcaatgccgcgtgcgggatgaaggtcttcggattgtaaaccgctgtttggagggacgaaacttgacggtacttccagagaaagccacggctaactacgtgccagcagccgcggtaat

SEQ ID NO: 885 - DNA, 472 bp, Unknown
  Ascusbbf_35830, encodes 16S rRNA
agagtttgatcctggctcagagcgaacgctggcggcaggcttaacacatgcaagtcgaacgggtaccttcgggtgctagtggcagacgggtgagtaacacgtgggaacgtacctttcggttcggaataatacagggaaacttgtactaataccggatacgccctttgggggaaagatttatcgccgatagatcggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaat

SEQ ID NO: 886 - DNA, 490 bp, Unknown
  Ascusbbf_7538, encodes 16S rRNA
agagtttgatcatggctcaggatgaacgctagcgacaggcctaacacatgcaagtcgaggggcagcggccggtagcaataccgggccggcgaccggcgaatgggtgagtaacgcgtatgcaacctttccgcgagacgggtatagccttccgaaagggagattaacccccggtagtcctggttccccgcatgagggaccaggtaaatatttatagcttgcgggtgggcatgcgtcccattaggcagttggcggggtaacggcccaccaaaccggcgatgggtaggggttctgagaggaaaatcccccacattggaactgagacacggtccaaactcctacgggaggcagcagtgaggaatattggtcaatgggcgaaagcctgaaccagccaagtcgcgtgcgggacgaaggccctacgggtcgtaaaccgcttttgtacgggaataaagtcagggacgcgtccctgtttgtaggtaccgtaagaataagg

SEQ ID NO: 887 - DNA, 490 bp, Unknown
  Ascusbbf_132780, encodes 16S rRNA
agagtttgatcctggctcaggatgaacgctggcggcgtgcctaacacatgcaagtcgagcgagaaactcatgaccaatacttcggttgcgtgattgagcggaaagcggcggacgggtgagtaacgcgtaggcaacctgccctttgcagagggatagcctcgggaaaccgggattaaaacctcataacgcatcagccggacatccggcagatgccaaagatttatcggcagaggatgggcctgcgtctgattagttagttggtggggtaacggcctaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaaggatgaaggcccttgggtcgtaaacttctgttctaagggaagataatgacggtaccttaggagcaagtcccggcta

SEQ ID NO: 888 - DNA, 488 bp, Unknown
  Ascusbbf_8073, encodes 16S rRNA
agagtttgatcctggctcagaacgaacgctggcggcaggcttaacacatgcaagttgaacgggattcattagtagcttgctattgatgatgagagtggcgcacgggtgagtaatacgtgggaacgtacctagtagttcggaacaactgatggaaacgtcagctaataccggataagccctgagggggaaagatttatcgctattagaacggcccgcggcagattaggcagttggtggggtaaaggcctaccaaacctacgatctgtagctggtctgagaggacgatcagccacattgggactgagacacggcccagactcctacgggaggcagcagtgaggaatattgggcaatgggggcaaccctgacccagccatgccgcgtgagtgaagaaggttttcggattgtaaagctctttcgggagagaagatgatgacggtatctccagaagaagccccggcaaacttcgtgccagcagccgcggtaat

SEQ ID NO: 889 - DNA, 490 bp, Unknown
  Ascusbbf_1340931, encodes 16S rRNA
agagtttgatcctggctcaggatgaacgctagcggcaggcttaacacatgcaagtcgaggggtaacgcggggtagcaatactctggcgacgaccggcgcacgggcgcgtaacgcgtatgcaacctacctgtaacaggggtataacggagagaaatttccactaatcccccatattgttagagattcgcatgtttctctaacgaaagcttcggtggttacggatgggcatgcgtgacattagctagttggtaaggtaacggcttaccaaggcgacgatgtctaggggggctgagaggctgacccccaaaacgggtccggggaaacggacaagattccaacgggaggcagcagtgaggaatattggtcaatggacggaagtctgaaccagccatgccgcgtggaggaagaaggtcctatgggttgtaaactccttttgttcgagagtaataagaggcttgcgagcctcgatgagagtatcggacgaataagc

SEQ ID NO: 890 - DNA, 490 bp, Unknown
  Ascusbbf_21624, encodes 16S rRNA
agagtttgatcctggctcaggatgaacgctggcggcatgcctaagacatgcaagtcgaacgaggtggcccatagaagatggagtgcttgcacaaagttggaaatggtttaccacctagtggcagacgggtgagtaacacgtaggtgacctgccctttagatggggataacaattggaaacgattgataataccgaataagatataagagtcaatcttatattgaaaggagcctttaaagcttcgcttaaggatgggcctgcggcgtattaactagttggtggggtaatggcctaccaaggtaacgatgcgtagccgaactgagaggttgatcggccacactgggactgagacacggcccagactcctacgggagacagcagttaggaatattcgtcaatgggggaaaccctgaacgagcaatgccgcgtgagtgatgaaggtctttggattgtaaaactctgttgtatggaaaaaatgattaggttagga

SEQ ID NO: 891 - DNA, 490 bp, Unknown
  Ascusbbf_74368, encodes 16S rRNA
agagtttgatcctggctcaggatgaacgctggcggcgtgcctaacacatgcaagtcgaacgggacttattgagacgatttcggtctgatcattaagtttagtggcggacgggtgagtaacgcgtggacaacctgcctttcacagggggatagcagctggaaacggctggtaataccgcatacgctcatgccaccgcatggtggtgtgaggaaagatttatcggtgaaagatggatccgcgtctgattagccagttggcggggtaacggcccaccaaagcgacgatcagtagccggcctgagagggcggacggccacattgggactgagacacggcccagactcctacgggaggcagcagtgggggatattgcacaatgggcgcaagcctgatgcagcgacgccgcgtgagtgaagaagtatttcggtatgtaaagctctatcagcagggaagaaaggcccgcaagggagatgacggtacctgactaagaa

SEQ ID NO: 892 - DNA, 490 bp, Unknown
  Ascusbbf_32155, encodes 16S rRNA
agagtttgatcctggctcaggacgaacgctggcggcgtgcctaacacatgcaagtcgaacggagttacgagacttcggttttgtaacttagtggcggacgggtgagtaacgcgtgagcaacctgccttacagagggggatagccattggaaacgatggataataccgcataacgtatggtcatggcatcttgatcataccaaaggagcaatccgctgtaagatgggctcgcgtccgattagatagttggcggggtaacggcccaccaagtcgacgatcggtagccggactgagaggttgaacggccacattgggactgagacacggcccagactcctacgggaggcagcagtgagggatattgcacaatgggcgaaagcctgatgcagcaacgccgcgtgaaggatgacggttttcggattgtaaacttctgttctaagtgaagataatgacattagcttaggagaaagccacggctaactacgtgccag

SEQ ID NO: 893 - DNA, 490 bp, Unknown
  Ascusbbf_487771, encodes 16S rRNA
agagtttgatcatggctcaggatgaacgctagcggcaggcttaacacatgcaagtcgcggggcagcgagggtagcaatacctgtcggcgacctgcggaagggtgcgtaacgcgtgagcaacttgcccgtggttgggggataaccggtggaaacgccgcctaataccccgtaacaattggaatcacatgtttctgatttgatagccttaaggtgtccacggataggctcgcgtccgattagccagttggcggggcaacggcccaccaaagctacgatcggtaggggatctgagaggatggccccccacattgggactgagacacggcccaaactcctacgggaggcagcagtgaggaatattggtcaatgggcggaagcctgaaccagccatgccgcgtgcgggatgtaggtcctatggattgtgaaccgcttttgcagtggagcaataaggtggtcgtgaccagcgatgagagtacactgcgaataagca

SEQ ID NO: 894 - DNA, 472 bp, Unknown
  Ascusbbf_11684, encodes 16S rRNA
agagtttgatcctggctcagaacgaacgctggcggcatgcctaacacatgcaagtcgcacggtcctttcgggggcagtggcgaacgggtgagtaacgcgtgggaacctaccctggagtgggggataaccactggaaacggtggctaataccgcatatgccctgcggggcaaagcagcaatgcgctcttggaggggcccgcgtccgattagctagttggtggggtgacggcctaccaaggctgcgatcggtagctggtctgagaggatgatcagccacactgggactgagacacggcccagactcctacgggaggcagcagtggggaatattggacaatgggcgcaagcctgatccagcaatgccgcgtgcgtgatgaaggccttcgggttgtaaagcgctttcgcccacgacgatgatgacggtagtgggagaagaagccccggctaactccgtgccagcagccgcggtaat

SEQ ID NO: 895 - DNA, 490 bp, Unknown
  Ascusbbf_9836, encodes 16S rRNA
agagtttgatcctggctcaggacgaacgctggcggcgtgcctaacacatgcaagtcgaacggagcgaaagaagcttgcttctggagcttagtggcggacgggtgagtaacacgtgagtaacctgcctttcagaggggaataatgtctggaaacggacactaataccgcataatatattggaatcgcatgattttgatatcaaaggagcaatccgctgaaagatggactcgcgtctgattagccagttggcggggtaacggcccaccaaagcgacgatcagtagccggactgagaggttgaacggccacattgggactgagacacggcccagactcctacgggaggcagcagtgggggatattgcacaatggggggaaccctgatgcagcaacgccgcgtgcaggaagacggtcttcggattgtaaactgttgtcctctgtgacgataatgacggtagcagaggaggaagccacggctaactacgtgccag

SEQ ID NO: 896 - DNA, 490 bp, Unknown
  Ascusbbf_162254, encodes 16S rRNA
agagtttgatcatggctcaggataaacgctggcggcgtgcttaacacatgcaagtcgaacggggttaatgacttcggtcgttaacttagtggcggacgggtgagtaacgcgtgggtaacctgccctgcagagggggacaacagctggaaacggctgctaataccgcatacgccggtcataccgcatggtattaccgggaaagattcatcgctgcaggatggacccgcgtctgattagccagttggcggggtaacggcccaccaaagcgacgatcagtagccgatctgagaggatgtacggccacattgggactgagacacggcccagactcctacgggaggcagcagtggggaattttgcacaatggggggaaccctgatgcagcgacgccgcgtgagtgaagaagtatttcggtatgtaaagctctatcagcagggacaaagatgatggtacctgaataagaagcaccggctaaatacgtgccagcagc

SEQ ID NO: 897 - DNA, 490 bp, Unknown
  Ascusbbf_15329, encodes 16S rRNA
agagtttgatcctggctcaggataaacgctggcggcgcacataagacatgcaagtcgaacggaagtcgttgtaatgatgccctcatgaacagagaacttgttcaacgtgaatgaagattgacttacaacaatggctttagtggcggactggtgagtaacacgtaagcaacctgcctattagaggggaataacaacgagaaatcgttgctaataccgcatatgcccggccattcacatgaatagccggggaaaggagcaatccgctaatagatgggcttgcgtctgattagttagttggtggggtaacggcctaccaagaccgcgatcagtagccggactgagaggttcaacggccacattgggactgagatacggcccagactcctacgggaggcagcagtcgggaatattgcgcaatggaggaaactctgacgcagtgacgccgcgtataggaagaaggttttcggattgtaaactattgtctgcaggg

SEQ ID NO: 898 - DNA, 490 bp, Unknown
  Ascusbbf_7615, encodes 16S rRNA
agagtttgatcatggctcaggataaacgctggcggcgcacataagacatgcaagtcgaacgaacttaattacttgcttgcaagtaaagcggttagtggcggactggtgagtaacacgtaagaaatctacctattagtggggaataacagtgagaaatcattgctaataccgcatatgccataggaatcgcatgattctagtgggaaaggagcaattcgctaatagatgagcttgcgtctgattagctagttggtggggcaatggcctaccaaggcaacgatcagtagccggactgagaggttgaacggccacattgggactgagatacggcccagactcctacgggaggcagcagtcgggaatattgcgcaatggaggaaactctgacgcagtgacgccgcgtataggaagaaggttttcggattgtaaactattgtctactgggaagataacagactgtaccagtaaagaaagctccggctaactacgt

SEQ ID NO: 899 - DNA, 490 bp, Unknown
  Ascusbbf_1567199, encodes 16S rRNA
agagtttgatcctggctcagaatgaacgctggcggcatggattaggcatgcaagtcgaacgagaaagcggcttcggccgcgagtaaagtggcgaaagggtgagtaacacgtgaggaacctgccccctggcccggaacaagcctgtgaaaacgggtctgaaaccggatgaggccccttcccgcatgggaagtcggccaaatattcatagccaagggatggcctcgcgtcccattagctagttggcggggtaacggcccaccaaggctgcgacgggtaggtggtctgagaggatggtcacccacactgggactgagacactgcccagactcctacgggaggctgcagtcgagaatcttccgcaatgggcgcaagcctgacggagcgatgccgcgtgagggacgaaggccttcgggtcgtaaacctctgtgggggggaacgaacgcaatgacggtacccccttagaaagccacggctaactccgtgccagcag

SEQ ID NO: 900 - DNA, 490 bp, Unknown
  Ascusbbf_8746, encodes 16S rRNA
agagtttgatcctggctcaggacgaacgctggcggcgtgcttaacacatgcaagtcgaacggaccccagcaatggggttagtggcggacgggtgagtaacacgtgagcaacctgccctgtattacgggataacacagagaaatttgtgctaatacggtataagaccacgaggaaggcatctttcggtggtaaaagattttatcgatacaggaggggctcgcggcccattagatagttggtgagggtaacggcccaccaagtcgacgatgggtagccgacctgagagggtgatcggccacattggaactgagatacggtccaaactcctgcgggaggcagcagtggggaatattgggcaatggaggcaactctgacccagcaacgccgcgtgaacgaagaaggccttcgggttgtaaagttctttaattggtgaagaagacaatgacggtagccaaagaataagccacggctaactacgtgccagcagccg

SEQ ID NO: 901 - DNA, 490 bp, Unknown
  Ascusbbf_2713, encodes 16S rRNA
agagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataactactggaaacggtagctaataccgcgtaatctcttaggagtaaagggtgggactttcgggccacctgccataagatgagcccaagtgggattaggtagttggtggggtaaaggcctaccaagccgacgatctctagctggtctgagaggatggccagccacactggaactgagacacggtccagactcctacgggaggcagcagtggggaatattgcacaatggggggaaccctgatgcagccatgccgcgtgaatgaagaaggccttcgggttgtaaagttctttcggtgatgaggaaggtatcaaatttaatagatttggtaattgacgttagtcacagaag

SEQ ID NO: 902 - DNA, 490 bp, Unknown
  Ascusbbf_11809, encodes 16S rRNA
agagtttgatcatggctcagattgaacgctggcggcaggcttaacacatgcaagtcgagcgcgaaagggtttcggcctgagtagagcggcggacgggtgagtaacgcgtgggaatctgcctggtaatgggggataacgtttcgaaaggagcgctaataccgcatacgccctaagggggaaagtgggggatcttcggacctcacgttatcagatgagcctgcgtcggattagctagtaggtggggtaaaggcctacctaggcgacgatccgtaactggtctgagaggatgatcagtcacactggaactgagacacggtccagactcctacgggaggcagcagtggggaatattggacaatgggggcaaccctgatccagccatgccgcgtgtgtgaagaaggccttcgggttgtaaagcactttaagttgggaggaaggctttaaggttaataaccttgaagattgacgttaccaacagaataagcaccgg

SEQ ID NO: 903 - DNA, 490 bp, Unknown
  Ascusbbf_222241, encodes 16S rRNA
agagtttgatcatggctcaggacgaacgctggcggcgtgcttaacacatgcaagtcgagcggtaaggccctttcgggggtacacgagcggcgaacgggtgagtaacacgtgagtaatctgcccttcacttcgggataactaccggaaacggtggctaataccggatatgaccatgcgacgcatgttgtgtggtggaaagttctggcggtggaggatgtgctcgcggcctatcagcttgttggtgaggtaacggctcaccaaggcttcgacgggtagccggcctgagagggtgaccggccacactgggactgagacacggcccagactcctacgggaggcagcagtggggaatattggacaatgggcgaaagcctgatccagcaacgccgcgtgagggatgactgccttcgggttgtaaacctctttcagtagggacgaagcgcaagtgacggtacctacagaagaagcaccggccaactacgtgccagca

SEQ ID NO: 904 - DNA, 490 bp, Unknown
  Ascusbbf_1261527, encodes 16S rRNA
agagtttgatcatggctcaggatgaacgctagcggcaggcttaacacatgcaagtcgaggggcagcgcggacttcggtctggcggcgagtggcgaacgggtgagtaatgtatcggaacgtgcctagtagcgggggataactacgcgaaagcgtagctaataccgcatacgccctacgggggaaagcgggggaccttcgggcctcgcactattagagcggccgatatcggattagctagttggtgaggtaaaggctcaccaaggcgacgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcaggaaagaaacggctccggctaatatctggagcaactgacggtacctgcagaataagcac

SEQ ID NO: 905 - DNA, 490 bp, Unknown
  Ascusbbf_266837, encodes 16S rRNA
agagtttgatcatggctcaggataaacgctggcggcgcacataagacatgcaagtcgaacggaagtcgttacagtagaagtggattgaagatttatcagattgaagcggaagttgtaacaatggctttagtggcggactggtgagtaacacgtaagcaatctacctattagaggggaataacaatgagaaatcattgctaataccgcataagcttgtaggatcgcatgatccagcaagaaaaggagtaatccgctaatagatgagcttgcggctgattagctagttggttaggtaacggctgaccaaggcgacgatcagtagccgggctgagaggctctgcggccacattgggactgagatacggcccagactcctacgggaggcagcagtcgggaatattgcgcaatggaggaaactctgacgcagtgacgccgcgtataggaagaaggttttaggattgtaaactattttagacagggaagaaaaatg

SEQ ID NO: 906 - DNA, 490 bp, Unknown
  Ascusbbf_7227, encodes 16S rRNA
agagtttgatcctggctcaggacgaacgctggcggcgtgcttcatacatgcaagtcgaacgagaagttaccttcgggtaatggaaagtggcggacgggtgagtaatgtgtagagaatctgccctagagagggggacaaccgttggaaacgacagctaataccccatatgagcgtaactgaaatgttattcttgaaaactccggtgctctgggatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgatcgagacgcttttcggagtgtaaagatctgtcacaggggacgaacgatgacggtaccctgagaggaagcaccggctaactccgtgccagcagccgcgg

SEQ ID NO: 907 - DNA, 490 bp, Unknown
  Ascusbbf_8884, encodes 16S rRNA
agagtttgatcatggctcagattgaacgctggcggcaggcttaacacatgcaagtcgaacggtagcacataggagcttgctccttgggtgacgagtggcggacgggtgagtaatgcttgggaatctggcttatggagggggataactactggaaacggtagctaataccgcgtaatctcttaggagtaaagggtgggactttcgggccacctgccataagatgagcccaagtgggattaggtagttggtggggtaaaggcctaccaagccgacgatctctagctggtctgagaggatggccagccacactggaactgagacacggtccagactcctacgggaggcagcagtggggaatattgcacaatggggggaaccctgatgcagccatgccgcgtgaatgaagaaggccttcgggttgtaaagttctttcggtgatgaggaaggtgattgttttaatagaacagtcaattgacgttagtcacagaag

SEQ ID NO: 908 - DNA, 490 bp, Unknown
  Ascusbbf_16205, encodes 16S rRNA
agagtttgatcctggctcaggatgaacgctggcggcatgcctaagacatgcaagtcgaacgaagtagcctaatgaagattgagtgcttgcacgatttctgatttagatttctacttagtggcagacgggtgagtaacacgtgggtaacctacctcagagactgggataacagttagaaatgattgctaataccggatgattcatagttagataactaattatgctaaaaggagctttcgcttcactttgagatgggcttgcgttgtattagttagttggtggggtaatggcctaccaagacaacgatgcatatccgagctgagaggctgatcggacacactgggactgagacacggcccagactcctacgggagacagcagttaggaatattcgtcaatgggggaaaccctgaacgagcaatgccgcgtgagtgattaaggtcttatagattgtaaaactctgttgtaaagaaagaaaccttgagatagg

SEQ ID NO: 909 - DNA, 490 bp, Unknown
  Ascusbbf_184350, encodes 16S rRNA
agagtttgatcatggctcaggatgaacgctggcggcgtgcctaacacatgcaagtcgagcgagaaatcgcgcaatgaagcttcggtagatttgagcgatggacagcggcggacgggtgagtaacgcgtgggaaacctgccctttacagggggacagccgagagaaatttcgattaataccccataacgcatgggagtcgcatggctctgatgccaaagatttatcggtaaaggatggtcccgcgtctgattagctggttggtgaggtagcggctcaccaaggcgacgatcagtagccggcctgagagggtgaacggccacattggaactgagacacggtccaaactcctacgggaggcagcagtggggaatattgcacaatgggcgcaagcctgatgcagcaacgccgcgtgaaggatgaaggctttcgagtcgtaaacttctgtccttggggaagaacaaatgacggtacccttggaggaagccccggc

SEQ ID NO: 910 - DNA, 490 bp, Unknown
  Ascusbbf_5442, encodes 16S rRNA
agagtttgatcatggctcaggatgaacgctggcggcgtgcttaacacatgcaagtcgaacggagtatgttaaccgagaccttcgggtctcacctgatatacttagtggcggacgggtgagtaacgcgtgagcaaccaaccttatgcagagggataacaattagaaatgattgctaatacctcataagaccacgctatcgcatggtaaagtgggaaaaactccggtggcataagacgggctcgcgttcgattagctagatggtggggtaacggcctaccatggcgacgatcgatagccggactgagaggtcgaccggccacattgggactgagacacggcccagactcctacgggaggcagcagtggggaatattgcacaatgggggaaaccctgatgcagcgacgccgcgtgagtgaagaagtatttcggtatgtaaagctcttttagcagggaagatgatgacggtacctgcagaaaaagccccggcta

SEQ ID NO: 911 - DNA, 490 bp, Unknown
  Ascusbbf_103243, encodes 16S rRNA
agagtttgatcctggctcaggatgaacgccggcggtgtgcctaatacatgcaagtcgagcgcactggcccaactgatatgacgtgcttgcactgatttgacgatggattaccagtgagcggcggacgggtgagtaacacgtgggcaacctgccctggagcgggggataacatctggaaacaggtgctaataccgcatgactactaaaaccacatggttttagtataaaagaaggcttcggctttcactctaggatgggcccgcggtgcattagctagttggtaaggtaacggcttaccaaggcgatgatgcatagccgagttaagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttgaagaagaacgtgcgtgagag

SEQ ID NO: 912 - DNA, 490 bp, Unknown
  Ascusbbf_193661, encodes 16S rRNA
agagtttgatcctggctcaggataaacgctggcggcgcacataagacatgcaagtcgaacggaagtcgttatcaatgagtttgattgaaagatttatctggaaagagaatgatttgataacaatggctttagtggcggactggtgagtaacgcgtgagcaacctgcctattagaggggaataacagtgagaaatcattgctaataccgcatatgccatagttatcgcatgatagcagtgggaaaggagtaatccactagtagatgggctcgcgtctgattagatagttggtggggtaatggcctaccaagtcaacgatcagtagccggactgagaggttgaacggccacattgggactgagatacggcccagactcctacgggaggcagcagtcgggaatattgcgcaatggaggaaactctgacgcagtgacgccgcgtataggaagaaggttttcggattgtaaactattgtcgttagggaagataaa

SEQ ID NO: 913 - DNA, 490 bp, Unknown
  Ascusbbf_14197, encodes 16S rRNA
agagtttgatcatggctcaggatgaacgctggcggcgtgcctaacacatgcaagtcgaacggtgatggtttgatattttcggatggataatcatcatagtggcggacgggtgagtaacgcgtggataacctgcctctcactgggggatagcagctggaaacggctggtaataccgcatacgatcctttaatcgcatgattgaaggaagaaagatttatcggtgagagatggatccgcgtctgattagccagttggcggggtaacggcccaccaaagcgacgatcagtagccggcctgagagggtgatcggccacattgggactgagacacggcccaaactcctacgggaggcagcagtgggggatattgcacaatgggcgcaagcctgatgcagcgacgccgcgtgagtgaagaagtatttcggtatgtaaagctctatcggcagggaagaaaggcccgaaagggagatgacggtacctgactaagaagc

SEQ ID NO: 914 - DNA, 490 bp, Unknown
  Ascusbbf_9419, encodes 16S rRNA
agagtttgatcatggctcaggacgaacgctggcggcatgcttaacacatgcaagtcgaacgggtctgattccttcgggatgaaagattagtggcggacgggtgagtaatgtatgagcaatctgcccttgtcattgggataacatagggaaacttatgctaataccaaatatgaccacggtgtcgcatggcactgcggtgaaagctccggcggacaaggatgagctcatatcctattagttagttggtgagataacagcccaccaagactgcgatgggtagccgagctgagaggctgatcggccacattgggactgaaacacggcccagacttctacggaaggcagcagtggggaatattggtcaatggaggcaactctgaaccagcaatgccgcgtgagtgaagaagatcttacgatcgtaaaactctaaacttaggaacgataatgacggtacctaaggataagccccggctaactacgtgccagcagc

SEQ ID NO: 915 - DNA, 490 bp, Unknown
  Ascusbbf_109452, encodes 16S rRNA
agagtttgatcatggctcagaacgaacgctggcggcgcgtcttaagcatgcaagtcgggcggcaaggatgtgcttgcacatccctagagcggcggactggtgagtaacgcgtgggtgacgcaccctccggacggggatagcctgcagaaatgcagggtaataccggatacggttccgtgtcctggaagcacggaaggaaaggagcttcggctccgccggaggagcggcctgcggcccatcagctagtcggcggggtaaaggcccaccgaggcgatgacgggtacccggcctgagagggtgggcgggcacattgggactgagatacggcccagactcctacgggaggcagcagctaagaatattccgcaatgggcgaaagcctgacggagcgacgccgcgtggacgatgaaggccggaaggttgcagagtcctttggcacgcgaggaaggagcggggaagggaatgtccccgcggtgactgtagcgtgaga

SEQ ID NO: 916 - DNA, 490 bp, Unknown
  Ascusbbf_161627, encodes 16S rRNA
agagtttgatcctggctcaggacgaacgctggcggcgtgcctaatacatgcaagtcgagcgcatgacgaggagcttgctcctctgattgagcggcggacgggtgagtaacacgtgggcaacctgccctgtagacggggataacttcgggaaaccggagctaataccggataatcctcttccccacatggggaagagttgaaaggcgcttttgcgtcactacaggatgggcccgcggtgcattagctagttggtggggtaacggcctaccaaggcgacgatgcatagccgacctgagagggtgatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaaccagtacgtcaggcaatggacgtaccttgacggtaccttat

SEQ ID NO: 917 - DNA, 490 bp, Unknown
  Ascusbbf_217178, encodes 16S rRNA
agagtttgatcctggctcaggataaacgctggcggcgcacataagacatgcaagtcgaacggaagtcgttataattgagtccaattgaaagatttatctggattgaagatgattttataacaatggctttagtggcggactggtgagtaacgcgtgagcaacctgcctatcagaggggaataacagtgagaaatcattgctaataccgcatatgccatatttatcgcatgataaaagtgggaaaggagtaatccactggtagatgggctcgcgtctgattagatagttggtggggtaacggcctaccaagtcaacgatcagtagccggactgagaggttgaacggccacattgggactgagatacggcccagactcctacgggaggcagcagtcgggaatattgcgcaatggaggaaactctgacgcagtgacgccgcgtataggaagaaggttttcggattgtaaactattgtcgttagggaagataaa

SEQ ID NO: 918 - DNA, 490 bp, Unknown
  Ascusbbf_7141, encodes 16S rRNA
agagtttgatcatggctcagaacgaacgctggcggcaggcttaacacatgcaagttgaacgggattaaattggtagcttgctattgatttatgagagtagcgcactggtgagtaacacgtgggaacgcacctattggtgggggacaacagttggaaacgactgctaataccgcataagccctaagggggaaaggagaaatttgccgatagaacggcccgcggaagattaggcagttggtggggtaaaggcctaccaaacctacgatctatagctgatctgagaggatgaacagccacattggaactgagacacggtccagactcctacgggaggcagcagtgaggaatattgggcaatggaggaaactctgacccagccatgccgcgtgagtgagaaggtcttcggattgtaaagctcttttatgcaggaagatgatgacagtactgcaagaaaaagcaccggcaaacttcgtgccagcagccgcggtaa

SEQ ID NO: 919 - DNA, 490 bp, Unknown
  Ascusbbf_306235, encodes 16S rRNA
agagtttgatcctggctcaggacgaacgctggcggcgtgcttaacacatgcaagtcgaacggggcgattgaaagcttgcttttatgagcctagtggcaaacgggtgagtaacgcgtgggcaacctaccggaaagatggggacaacatcccgaaaggggtgctaataccgaatgttgtacagggaacgcatgttccctgtattaaaggatctaatccgctttccgatgggcccgcgtccgattagctagttgggggggtagcggcccaccaaggcgacgatcggtagccggcctgagagggtgaacggccacattgggactgagacacggcccagactcctacgggaggcagcagtggggaatcttccgcaatgggcgaaagcctgacggagcaacgccgcgtgagtgaagaaggccttcgggccgtaaagctctgttgccggggaagagtggtccaaggggacttggacagggacggtacccggcgagga

SEQ ID NO: 920 - DNA, 468 bp, Unknown
  Ascusbbf_1738646, encodes 16S rRNA
agagtttgatcctggctcagaacgaacgctggcggcaggcttaacacatgcaagtcgaacgcatcgcaagatgagtggcagacgggtgagtaacgcgtgggaatctaccgtgccctgcggaatagctccgggaaactggaattaataccgcatacgccctacgggggaaagatttatcggggtatgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaat

SEQ ID NO: 921 - DNA, 488 bp, Unknown
  Ascusbbf_483267, encodes 16S rRNA
agagtttgatcctggctcaggatgaatgctggcggcgtgcctaatacatgcaagtcgagcggtaacagaggtagcttgctacctgctgacgagcggcggacggctgagtaacgcgtgggaacggaccccaaactgagggataactactcgaaagagtggctaataccgcatgtgatcttcggattaaaggatttatccggtttgggactggcctgcgtacgattagatagttggcggggtaaaggcccaccaagtcgacgatcgttagatggtttgagaggatgatcatccagactgggactgagacacggcccagactcctacgggaggcagcagtagggaatctttcacaatgggcgaaagcctgatggatcaacgccgcgtgcaggacgaaggccttcgggttgtaaactgcttttatatccgagaaatatgatggtaagatatgaataaggaccggctaactacgtgccagcagccgcggtaat

SEQ ID NO: 922 - DNA, 490 bp, Unknown
  Ascusbbf_1008900, encodes 16S rRNA
agagtttgatcctggctcaggatgaacgctggcggcgcgcctaacacatgcgagtcgaacggcacccacctccgggtggaagcgagtggcgaacggctgagtaacacgtggagaacctgcccccttccccgggatagccgcccgaaaggacgggtaataccggatacccccgggtgccgcatggcgcccgggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatgggggcaaccctgacgcagcgacgccgcgtgcgggacggaggccttcgggtcgtaaaccgctttcagcagggaagagacgagactgtacctgcagaagaagccccggctaactacgtgccagcagccgc

SEQ ID NO: 923 - DNA, 490 bp, Unknown
  Ascusbbf_35023, encodes 16S rRNA
agagtttgatcatggctcaggatgaacgctggcggcacgcttaacacatgcaagtcgagcggagcaaatacttcggtagttgcttagcggcggacgggtgagtaacacgtgggtaacctaccccatacagggggataacgtatagaaatgtacgctaataccgcataagccaacagggaggcatcttctggttggaaaagcgctagtggtatgggatgggcccgcgactgattagctggttggtgaggtaacggcccaccaaggcgacgatcagtagccggtctgagaggatggacggccacattgggactgagacacggcccagactcctacgggaggcagcagtggggaatattgcacaatggggggaaccctgatgcagcgatgccgcgtgaaggaagaagtatttcggtatgtaaacttctatcagcagggaagaagaaagacagtacctgagtaagcagccccggctaactacgtgccagcagcc

SEQ ID NO: 924 - DNA, 490 bp, Unknown
  Ascusbbf_83882, encodes 16S rRNA
agagtttgatcctggctcaggacgaacgctggcggcgcgcctaacacatgcaagtcggacggggatcatgtagaagcttgcttagacatgattttagtggcggacgggtgagtaacgcgtgaggacttgtcagttacagggggacaacggatggaaacgtcagctaataccccataagccgagaggtaaaaggagcgatccggtaacagagagactcgcgttccatcagctagttggaggggtaaaggctctccaaggcgaagacggatagccggactgagaggttggccggccacattggaactgagagacggtccagactcctacgggaggcagcagtggggaatattgggcaatgggggaaaccctgacccagcgacgccgcgtgggtgaagaaatccttcgggatgtaaagccctgttttgcgggaagaagcgagtgacggtaccgcaagagaaagccacggcaaactacgtgccagcagccgcgg

SEQ ID NO: 925 - DNA, 490 bp, Unknown
  Ascusbbf_230, encodes 16S rRNA
agagtttgatcctggctcaggacgaacgctggcggcgtgcctaacacatgcaagtcgaacgaagcactgaaattgatttcttcggaatgatttttctttgactgagtggcggacgggtgagtaacacgtgagcaacctgcctttcagagcgggatagcagttggaaacgactgataataccgcatgacatgttttctccgcatgaggaaaacatcaaatgatttttcgctgaaagatgggctcgcgtccgattaggtagttggtgaggcaacggctcaccaagccgacgatcggtagccggactgagaggtcgatcggccacattgggactgagacacggcccagactcctacgggaggcagcagtgggggatattgcacaatgggcgcaagcctgatgcagcaacgccgcgtgagggaggacggtcttcggattgtaaacctctgtccttggggaagaaacaaatgacggtacccttggaggaagccac

SEQ ID NO: 926 - DNA, 490 bp, Unknown
  Ascusbbf_8633, encodes 16S rRNA
agagtttgatcctggctcaggatgaacgctagcgataggcctaacacatgcaagtcgaggggcagcacatgaagtagcaatacggatggtggcgaccggcgcacgggtgagtaacgcgtatgcaacctacctacaacaggggaataactcgttgaaagacggactaataccccataatacagggatcccgcatgggaatatttgttaaagatttatcggttgtagatgggcatgcgttccattagctagttggtgaggtaacggctcaccaaggcaacgatggataggggaactgagaggtttatcccccacactggtactgagacacggaccagactcctacgggaggcagcagtgaggaatattggtcaatggacgcaagtctgaaccagccacgtcgcgtgaaggaagacggccctacgggttgtaaacttcttttgtaagggaataaagtgagccacgtgtggctttttgcatgtaccttacgaat

SEQ ID NO: 927 - DNA, 490 bp, Unknown
  Ascusbbf_15081, encodes 16S rRNA
agagtttgatcctggctcaggataaacgctggcggcgcacataagacatgcaagtcgaacggacttaatcgattcttttagtttcgaagcggttagtggcggactggtgagtaatacataagcaacctgcctataagaggggaacaacagttagaaatgactgctaataccgcatatgccataattatcacatgataatagtgggaaaggagcaatccgcttatagatgggcttatgcctgattagctagttggtggggtaatggcctaccaaggcaacgatcagtagccggactgagaggttcaacggccacattgggactgagatacggcccagactcctacgggaggcagcagtcgggaatattgcgcaatggaggaaactctgacgcagtgacgccgcgtgcaggaagaaggttttcggattgtaaactgctttagacagggaagatacaagacagtacctgtagaataagctccggctaactacg

SEQ ID NO: 928 - DNA, 470 bp, Unknown
  Ascusbbf_15532, encodes 16S rRNA
agagtttgatcctggctcagaacgaacgctggcggcaggcttaacacatgcaagtcgagcgcccttttcggagggagcggcagacgggtgagtaacacgtgggaatctacccatctctagggaataactcagggaaacttgtgctaataccctatacgccctttgggggaaagatttatcggagatggatgagcccgcgttggattagctagttggtgaggtaatggctcaccaaggcgacgatccatagctggtctgagaggatgatcagccacactgggactgagacacggcccagactcctacgggaggcagcagtggggaatattggacaatgggcgcaagcctgatccagccatgccgcgtgtgtgatgaaggccttagggttgtaaagcactttcaccgatgaagataatgacggtagtcggagaagaagccccggctaacttcgtgccagcagccgcggtaat

SEQ ID NO: 929 - DNA, 490 bp, Unknown
  Ascusbbf_8482, encodes 16S rRNA
agagtttgatcctggctcaggacgaacgctggcggcatgcctaacacatgcaagtcgaacggagctttcgagagcttgcttttgaaagcttagtggcggacgggtgagtaacgcgtgagcaacctgcctttcagtggggaataatattctgaaaagagtactaataccgcataacgtacagaaaccgcatgatttttgtaccaaagatttatcgctgagagatgggctcgcgtccgattagccagttggtggggtaacggcctaccaaagcgacgatcggtagccggactgagaggttgaacggccacattgggactgagacacggcccagactcctacgggaggcagcagtgggggatattgcgcaatgggggaaaccctgacgcagcaatgccgcgtggaggatcgaaggtcttcggattgtaaactccttttgtcagggacgaaaaatgacggtacctgacgaataagctccggctaactacgtgcc

SEQ ID NO: 930 - DNA, 490 bp, Unknown
  Ascusbbf_10701, encodes 16S rRNA
agagtttgatcatggctcaggacgaacgctggcggcgtgcctaacacatgcaagtcgaacgagaatttacgaattgatttcttcggaatgacgtttgtaaaggaaagtggcggacgggcgagtaacgcgtgaataacctgcccataagagggggataatccatggaaacgtggactaataccgcatattgaagttttatcgcatggtgagactttgaaagattttatcgcttatggatggattcgcgtcagattagctagttggtgaggtaacggctcaccaaggcgacgatctgtagccgaactgagaggttgatcggccgcattgggactgagacacggcccagactcctacgggaggcagcagtggggaatattgcgcaatgggggcaaccctgacgcagcaacgccgcgtgcaggaagaaggtcttcggattgtaaactgttgtcgcaagggaagaagacagtgacggtaccttgtgagaaagtca

SEQ ID NO: 931 - DNA, 486 bp, Unknown
  Ascusbbf_6883, encodes 16S rRNA
agagtttgatcatggctcagaacgaacgctggcggcaggcttaacacatgcaagttgaacgggattattgatagcttgctattaatatgagagtggcgcacgggtgagtaatacgtgggaacatacctatcggttcggaacaactgttggaaacgacagctaataccggatacggcctaagggggaaagatttatcgccgatagaatggcccgcggcagattaggcagttggtggggtaaaggcctaccaaaccgacgatctgtagctggtctgagaggacgatcagccacattgggactgagacacggcccagactcctacgggaggcagcagtgaggaatattgggcaatgggggaaaccctgacccagccatgccgcgtgagtgaagaaggttttcggattgtaaagctctttcagatgtgaagatgatgacggtagcatcagaagaagccccggcaaacttcgtgccagcagccgcggtaat

SEQ ID NO: 932 - DNA, 490 bp, Unknown
  Ascusbbf_7158, encodes 16S rRNA
agagtttgatcatggctcaggagaaacgctggcggcgcacataagacatgcaagtcgaacggaaccaagtcgaatgtttacatgagactgaagtttagtggcggacgggtgagtaacacgtgagcaacctgcctttaggagggggataacattgagaaatcagtgctaataccgcataacgcataaggttcgcatggaccatatgccaaaggagaaatccacctaaagatgggctcgcggctgattagccagttggtggggtaacggcctaccaaagcgatgatcagtagccgagctgagaggcacaacggccacattgggactgagacacggcccagactcctacgggaggcagcagtcgggaatattgcacaatggaggaaactctgatgcagtgacgccgcgtacaggaagaaggtctttggattgtaaactgttgtcgacagggaagaaaaatgacagtacctgtggaggaagctccggcaaacta

SEQ ID NO: 933 - DNA, 490 bp, Unknown
  Ascusbbf_16359, encodes 16S rRNA
agagtttgatcctggctcaggataaacgctggcggcgcacataagacatgcaagtcgaacggaagtcgtctaaaaatggattgaagatttatctgattgaagtttatagacaatggctttagtggcggactggtgagtaacgcgtgagcaacctgcctattagaggggaataacagtgagaaatcattgctaataccgcataagctgatagaatcgcatgatttagtcagaaaaggagtaatccgctaatagatgggctcgcgtctgattagctagttggtggggcaacggcctaccaaggcgacgatcagtagccggactgagaggttgaacggccacattgggactgagatacggcccagactcctacgggaggcagcagtcgggaatattgcgcaatggaggaaactctgacgcagtgacgccgcgtataggaagaaggttttcggattgtaaactattgtcgttagggaagaagaagtgacagtac

SEQ ID NO: 934 - DNA, 490 bp, Unknown
  Ascusbbf_13452, encodes 16S rRNA
agagtttgatcatggctcagaacgaacgctggcggcgcgtcttaagcatgcaagtcgaacgggatccacgcgcttgcgcgtggtgagagtggcggactggtgagtaacgcgtaggtgacgtaccctccggacggggatagcccttagaaataaggggtaataccggatacggttccgtgtgtcagaggcacggaaggaaaggagcttcggctccgccgggggatcggcctgcgtcccatcagccagttggcggggtaacggcccaccaaggcaatgacgggtatccggcctaagagggtgaacggacacattgggactgagatacggcccagactcctacgggaggcagcagctaagaatattccgcaatgggggaaaccctgacggagcgacgccgcgtggacgatgaaggccggaaggttgtaaagtcctttagtctgtgaggaataacgccggagggaatgccggcggatgactgtagcagaagaat

SEQ ID NO: 935 - DNA, 490 bp, Unknown
  Ascusbbf_52339, encodes 16S rRNA
agagtttgatcatggctcagaatgaacgctggcggcatggattaggcatgcaagtcgaacgccccgggcttgcccggggagtggcgaaagggtgcgcaacacgtgaggaacccgcccccgggtccgggacaagcgctggaaacggcgtctaataccggatggcgaccggaatcgcatgattccgcgtcgaaagtcttctcgcccggggaaggcctcgcgtcccattagctggatggcggggtgacggcccaccatggctacgacgggtaggtggtctgagaggatggtcacccacactgggactgagacactgcccagactcctacgggaggctgcagtcgagaatcttccgcaatgggcgcaagcctgacggagcgatgccgcgtgagggacggaggccttcgggtcgtaaacctctgtcacccgggacgaagcacgacggtaccgggagaggaagccacggctaactacgtgccagcagccgcggtaa

SEQ ID NO: 936 - DNA, 490 bp, Unknown
  Ascusbbf_16320, encodes 16S rRNA
agagtttgatcatggctcaggacgaacgctggcggcgtgcgtaacacatgcaagttgagcgacgacgtttccgaagtggcgacatggaggggacgagcggagcagcggacgggtgagtaatacatgagaagctgtcctgtggtgggggacaacgtctggaaacggacgctaataccccatagtctgagaggttaaagccgaaaggcgccatgggaggcgctcgtgtcctatcagctagttggtgaggtaacggctcaccaaggcgacgacgggtagccggcctgagagggtgtccggccacactgggactgagatacggcccagactcctacgggaggcagcagtggggaatattgggcaatgggaggaatcctgacccagcgacgccgcgtggatgaagaaggccttcgggtcgtaaaatccttttatgggggaagaaggaagtgacggtaccccatgaataagccccggctaactacgtgccagcagc

SEQ ID NO: 937 - DNA, 490 bp, Unknown
  Ascusbbf_38130, encodes 16S rRNA
agagtttgatcatggctcagattgaacgctagcgggatgctttacacatgcaagtcgaacggcagcgcgaaaagagcttgctctttttggcggcgagtggcgaacgggtgagtaatatatcggaacgtgcccagtagcgggggataactacgcgaaagcgtggctaataccgcatacgccctacgggggaaagggggggattcttcggaacctctcactattggagcggccgatatcagattagcttgttggtgaggtaaaggctcaccaaggccgcgatctgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcagggaagaaacggcgtcgactaataattggcgcaactgacggtacctgca

SEQ ID NO: 938 - DNA, 490 bp, Unknown
  Ascusbbf_56958, encodes 16S rRNA
agagtttgatcctggctcaggatgaacgctagctacaggcttaacacatgcaagtcgaggggcagcgggaggatagcttgctatccttgccggcgaccggcgcacgggtgcgtaacgcgtatccaacctgcccgcaagtcagggccagcccggcgaaagtcggattaatccctgatgtggtgcgaagaggacatctgattcacattaaaggtttaccgcttgcggatggggatgcgtaggattaggtagtaggcggggcaacggcccacctagccgtcgatccttaggggttctgagaggaaggtcccccacactggtactgagacacggaccagactcctacgggaggcagcagtgaggaatattggtcaatggtcgggagactgaaccagccaagtagcgtgcaggacgacggccctacgggttgtaaactgcttttatgcggggataaaggaagccacgtgtggttttttgcaggtaccgcatgaat

SEQ ID NO: 939 - DNA, 490 bp, Unknown
  Ascusbbf_55782, encodes 16S rRNA
agagtttgatcatggctcaggatgaacgctggcggcgtgcctaacacatgcaagtcgagcggagatatatcggagattcttcggatgatcttttatatcttagcggcggatgggtgagtaacacgtgggtaacctgccctgcactggggaataacagttggaaacgactgttaataccgcatatgcgcacgaggtcgcatgaccttgggcggaaagatttatcggtgcaggatgggcccgcgtcggattaacttgttggtgaggtaatggcccaccaaggtgatgatccgtagccgacctgagagggtgaccggccacattgggactgagacacggcccaaactcctacgggaggcagcagtgggggatattgcacaatgggcgcaagcctgatgcagcgacgccgcgtgaaggaagacgtatttcggtatgtaaacttctatcagcggggaagaagatgacggtacccgactaagaagccccggctaat

SEQ ID NO: 940 - DNA, 490 bp, Unknown
  Ascusbbf_40912, encodes 16S rRNA
agagtttgatcatggctcaggatgaacgctggcggcgtgcctaacacatgcaagtcgaacgggaaccttgcgacggagacttcggttgaagttgtaagaattctagtggcggacgggtgagtaacgcgtgggtaacctgcccttaagaggggaataacattgagaaatcagtgctaatacaccatatgcttacagcatcgcatgatgcagtgaggaaaagaatttcgcttaaggatggacccgcgtttgattagccagttggtagggtaacggcctaccaaagcaacgatcaatagccggcctgagagggtgaacggccacattggaactgagacacggtccaaactcctacgggaggcagcagtggggagtattgcacaatgggcgaaagcctgatgcagcaacgccgcgtgagtgaagaagtatttcggtatgtaaagctctatcgatggggaataagatgaaggtacccaagtaagaagccccggct

SEQ ID NO: 941 - DNA, 480 bp, Unknown
  Ascusbbf_47220, encodes 16S rRNA
agagtttgatcatggctcagaacgaacgctggcggcaggcttaacacatgcaagtcgaacgtgaagctaccttcgggtagtggaaagtggcagacgggtgagtaacgcgtgggaatatacccctcggttcggaataactcatggaaacgtgagctaataccgaatacggcctatgggcgaaagatttatcgccgagggattagcccgcgttggattagctagttggtggggtaaaggcctaccaaggcgacgatccatagctggtctgagaggatgatcagccacactgggactgagacacggcccagactcctacgggaggcagcagtggggaatcttggacaatgggcgaaagcctgatccagccatgccgcgtgagtgaagaaggccttagggttgtaaagctctttcatcagggaagataatgacggtacctgaagaagaagccccggctaactccgtgccagcagccgcggtaat

SEQ ID NO: 942 - DNA, 470 bp, Unknown
  Ascusbbf_64314, encodes 16S rRNA
agagtttgatcctggctcagaacgaacgctggcggcaggcctaacacatgcaagtcgaacgctgtagcaatacagagtggcagacgggtgagtaacgcgtgggaaccttcccaatggtacggaatagctcagggaaacttgaggtaataccgtataagcccctagggggaaagatttatcgccattggatgggcccgcgtcggattagctagttggtagggtaatggcctaccaaggcaacgatccgtagctggtttgagagaatgaccagccacactgggactgagacacggcccagactcctacgggaggcagcagtggggaatcttggacaatgggcgcaagcctgatccagccatgccgcgtgagtgaagaaggccttagggttgtaaagctcttttgccggggacgataatgacggtacccggagaataagtcccggctaacttcgtgccagcagccgcggtaat

SEQ ID NO: 943 - DNA, 490 bp, Unknown
  Ascusbbf_1827789, encodes 16S rRNA
agagtttgatcatggctcaggatgaacgctagcggcaggcctaacacatgcaagtcgaggggcatcacggaaaagcttgcttttctggtggcgaccggcgcacgggtgaggaacacgtatggaacctgcccctgtcaggggaatagcccagggaaacttggattaatgccccatggtacctggggatcgcatgatcccccggttaaagattcatcggacagggatggccatgcgcaccattagctagttggtagggtaacggcctaccaaggcagcgatggttaggggccctgagagggggatcccccacactggtactgagacacggaccagactcctacgggaggcagcagtgaggaatattggacaatggccgagaggctgatccagccatgccgcgtgcaggatgactgccctatgggttgtaaactgcttttatacggaagaaacccccccacgtgtggggggctgacggtaccgtaagaataag

SEQ ID NO: 944 - DNA, 490 bp, Unknown
  Ascusbbf_130969, encodes 16S rRNA
agagtttgatcctggctcaggatgaacgctggcggcgtgcctaatacatgcaagtcgaacgagtggttgcctcttccttcgggttgaggctgccgcgagtggcgtacgggtgagtaacacgtaggcaatctgcccttaggactgggatacccagacgaaagtttggctaataccggataactacgggggaggcatctcctccgcttgaaaggcgcttcggcgccacctttggatgagcctgcggcgcattagctagttggtgagataacagcccaccaaggcagggatgcgtagccgatctgagaggatgaccggccacaatgggactgagacacggcccatactcctacgggaggcagcagtagggagttttcggcaatgggcgaaagcctgaccgagcaacgccgcgtgagtgatgaaggtcttcggattgtaaagctctgttgcgagggacgaatggccgcggtaggcaatgaccgcggagatgacg

SEQ ID NO: 945 - DNA, 490 bp, Unknown
  Ascusbbf_51715, encodes 16S rRNA
agagtttgatcctggctcaggatgaacgctggcggcgtgcctaacacatgcaagtcgagcggagtatagtgtctaagagatttcggtcgaattaatctatacttagcggcggatgggtgaggaacgcgtgggcaacctgcccttcacagggggataacagctggaaacggctgttaataccgcatatgctcacagtaccgcatggtacagggaggaaagcgtacacggtgaaggatggacccgcgtcggattagccagttggtgaggtaacggcccaccaaagcgatgatccgtagccggcctgagagggcgaccggccacattgggactgagacacggcccaaactcctacgggaggcagcagtgggggatattgcacaatggggggaaccctgatgcagcgacgccgcgtgaaggaggaagtacttcggtatgtaaacttctatcagcagggaagaagatgacggtacctgcacaagaagccccggct

SEQ ID NO: 946 - DNA, 490 bp, Unknown
  Ascusbbf_194402, encodes 16S rRNA
agagtttgatcatggctcaggatgaacgctggcggcgtgcctaacacatgcaagtcgagcgggaatctcctgattgaaacttcggtagattgacggggaggatagcggcggacgggtgagtaacgcgtaggtaagctgccctatgcacagggatagcctagggaaacctggattaatacctgatgacgctgcgaggtcacatggccatgcagccaaagttttttcggcataggatgcacctgcgtctgattagctggttggtgaggtaacggcccaccaaggcgacgatcagtagccgacctgagagggtgatcggccacattggaactgagacacggtccaaactcctacgggaggcagcagtgaggaatattgcacaatggggggaaccctgatgcagcaacgccgcgtgagcgaagaaggtcttcggatcgtaaagctctgtcctaagggacgataatgacggtaccttaggaggaagccccggcta

SEQ ID NO: 947 - DNA, 490 bp, Unknown
  Ascusbbf_166540, encodes 16S rRNA
agagtttgatcatggctcaggacgaacgctggcggcgtgcttaacacatgcaagtcgaacgaggtttaccggagagcttgctcgaaggtaaaccgagtggcggacgggtgagtaacgcgtgaacaatctgtctcatacagggggataacgcatcgaaagatgtgctaataccgcgtaggaccacaggaggacatcctccaggggtgaaaggagcaatccggtatgaggtgagttcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgaaagcctgacccagcaacgccgcgtgaaggaagaaggttttcggatcgtaaacttctgtcctatatgaagatcatgacggtagtataggaggaagccccggctaactacg

SEQ ID NO: 948 - DNA, 490 bp, Unknown
  Ascusbbf_114984, encodes 16S rRNA
agagtttgatcatggctcaggacgaacgctggcggcgtgcttaatacatgcaagtcgaacgaggtccaacctttcgcaagattggggaagacctagtggcgaacgggtgcgtaacacgtgagaaacctgccccggtctctggaataacaagtggaaacacttgctaataccggatgccgtctgaccaccgcatggtggattgacgaaagatttatcggatcgggagggtctcgcggcctatcagcttgttggcgaggtaacggctcaccaaggcatcgacgggtagctggtctgagaggatgatcagccacactgggactgagacacggcccagactcctacgggaggcagcagtagggaatcttgcacaatgggcgaaagcctgatgcagcaacgccgcgtgcgggaagaaggccttagggttgtaaaccgctttcagcagggaagaaaatgacggtacctacagaagaaggtgcggccaactacgtgc

SEQ ID NO: 949 - DNA, 490 bp, Unknown
  Ascusbbf_46288, encodes 16S rRNA
agagtttgatcatggctcaggatgaacgctagcggcaggcctaacacatgcaagtcgaggggcatcacggaaaagcttgcttttctggtggcgaccggcgcacgggtgaggaccacgtatggaacctgcccctgtcaggggaatagcccagggaaacttggattaatgccccatggtaccggggggtcgcatgaccctttggttaaagatttatcggacagggatggccatgcgcaccattagctagttggtagggtaacggcctaccaaggcgacgatggttaggggccctgagagggggatcccccacactggtactgagacacggaccagactcctacgggaggcagcagtgaggaatattggacaatggccgagaggctgatccagccatgccgcgtgcaggatgactgccctatgggttgtaaactgcttttatacgggaagaaacccccccacgtgtggggggctgacggtaccgtaagaataa

SEQ ID NO: 950 - DNA, 490 bp, Unknown
  Ascusbbf_138789, encodes 16S rRNA
agagtttgatcatggctcaggacgaacgctggcggcgtgcctaacacatgcaagtcgaacggagcaggggacttcggttctctgctgagtggcgaacgggtgagtaacgcgtgagcaacctgaccttgagagggggataacgacgggaaactgtcgctaataccgcatgagaccacagcccggcatcggggaggggtcaaaggagaaatccgctgaaggaggggctcgcgtcccattagatagttggcggggcaacggcccaccaagtcgacgatgggtagccgagctgagaggctgatcggccacactggaactgagacacggtccagactcctacgggaggcagcagtggggaatattgggcaatgggcgcaagcctgacccagcaacgccgcgtgagggaagaaggctttcgggttgtaaacctctgtccttggtgacgaaggaagtgacggtagccaaggaggaagccccggctaactacgtgcca

SEQ ID NO: 951 - DNA, 490 bp, Unknown
  Ascusbbf_116550, encodes 16S rRNA
agagtttgatcctggctcaggataaacgctggcggcgcacataagacatgcaagtcgaacggaagtcgttatatttgattctgaatgaaagatttatccggaatgatgatgattttataacaatggctttagtggcggactggtgagtaacgcgtaagcaatctgcctattagaggggaataacagtgagaaatcattgctaataccgcatatgccatgagtatcgcatgatacaattgggaaaggagtaatccgctaatagatgagcttgcgtctgattaacttgttggtggggtaacggcctaccaaggtgacgatcagtagccggactgagaggttgaacggccacattgggactgagatacggcccagactcctacgggaggcagcagtcgggaatattgcgcaatggaggaaactctgacgcagtgacgccgcgtataggatgaaggttttcggattgtaaactattgtcgttagggaagattta

SEQ ID NO: 952 - DNA, 490 bp, Unknown
  Ascusbbf_302938, encodes 16S rRNA
agagtttgatcctggctcaggacgaacgctggcggcgtgcctaacacatgcaagtcgagcgaggggaggggcttcggccccgaaccgagcggcggacgggtgagtaacgcgtgaatgatctgtccctcacaggggaataacacttggaaacaggtgctaataccgcataagaccacggtgctgcatggcactgaggtaaaaggagcgatccggtgaggggtgagttcgcgtccgattagccagttggcggggtaagagcccaccaaagcgacgatcggtagccgacctgagagggtgatcggccacactggaactgagacacggtccagactcctacgggaggcagcagtgggaatattgggcaatgggcgaaagcctgacccagcaacgccgcgtgagggaagaaggttttcggattgtaaacctctatcgcaggggacgaaggaagtgacggtaccctgcaaggaagccccggctaactacgtgccag

SEQ ID NO: 953 - DNA, 490 bp, Unknown
  Ascusbbf_64802, encodes 16S rRNA
agagtttgatcctggctcaggacgaacgctggcggcgtgcttaacacatgcaagtcgaacgaggttatcatcaggaaggcttcggccggagagaggataaccgagtggcggacgggtgagtaacgcgtgagcaacctgtcttctacagggggataacgccccgaaaggggtgctaataccgcataggaccacggtaccgcatggtacagaggtgaaaggagcaatccggtagaaggtgggctcgcgtcccattagatagttggtgaggtaacggctcaccaagtcgacgatgggtagccgacctgagagggtgatcggccacattggaactgagatacggtccagactcctacgggaggcagcagtggggaatattgggcaatgggcgaaagcctgacccagcaacgccgcgtgagggaagaaggtcttcgggttgtaaacctctgtcctaagtgaaaaggaaggatggtagcttaggaggaagccccgg

SEQ ID NO: 954 - DNA, 490 bp, Unknown
  Ascusbbf_44453, encodes 16S rRNA
agagtttgatcatggctcaggatgaacgctggcggcgtgcttaacacatgcaagtcgaacgggcttagatcggaagcttgcttttgatttaagttagtggcggacgggtgagtaacgcgtgggtaacctaccctgtgcagggggatagcagctggaaacggctgataaaaccgcataacacggcgatgccgcatggcaatgccgtcaaatatttataggcacaggatgggcccgcgtctgattagctagttggcggggcaacggcccaccaaggcgacgatcagtagccggcctgagagggtgaacggccacattgggactgagacacggcccaaactcctacgggaggcagcagtggggaatattggacaatgggggaaaccctgatccagcgacgccgcgtgagtgaagaagtatttcggtatgtaaagctctatcagcagggaagatgatgacggtacctgactaagaagcaccggctaaatacgtg

SEQ ID NO: 955 - DNA, 490 bp, Unknown
  Ascusbbf_67583, encodes 16S rRNA
agagtttgatcatggctcaggacgaacgctggcggcgtgcttaacacatgcaagtcgaacgaggttagagacttcggtttttaaccgagtggcggacgggtgagtaacgcgtgagcaatctgtcccagacagggggataacaactggaaacagttgctaataccgcataagaccacgtcatcgcatggtgatgaggtaaaaggagcaatccggtttggggtgagttcgcgtctgattagatagttggcgaggtaacggctcaccaagtcgacgatcagtagccgacctgagagggtgaccggccacattgggactgagacacggcccagactcctacgggaggcagcagtggggaatattgggcaatgggggaaaccctgacccagcaacgccgcgtgagggaagaaggttttcggattgtaaacctctgtccttggggacgaacaagatgacggtacccgaggaggaagccccggctaactacgtgcca

SEQ ID NO: 956 - DNA, 490 bp, Unknown
  Ascusbbf_384556, encodes 16S rRNA
agagtttgatcctggctcaggatgaacgctggcggcatgcctaagacatgcaagtcgaacgaagtagtccaaagaaaaatgagtgcttgcacgaatttggaaatggttcgctacttagtggcagacgggtgagtaacacgtgggtaacctacctcagagactgggataacaattagaaatgattgctaataccggatgatttgtaatatgataacatgttatactaaaaggagctacggctttactttgagatgggcttgcggtgtattagctagttggtgaggtaatggctcaccaaggcaacgatgcatatccgagctgagaggctgatcggacacattgggactgagacacggcccagactcctacgggagacagcagttaggaatattcgtcaatggggggaaccctgaacgagcaatgccgcgtgagtgatgacggtcttatagattgtaaaactctgttgtaaaggaagaaatcttattatagg

SEQ ID NO: 957 - DNA, 490 bp, Unknown
  Ascusbbf_73740, encodes 16S rRNA
agagtttgatcatggctcagaatgaacgttggcggcgtggattaggcatgcaagtcgagcgagaacccagcaatgggggacagcggcgaaagggacagtaatgtgtagattatctgccctcaggcccgggatagctgcgggaaactgcaggtaataccggatgatatctccggatcaaaggtgtgattccgcctgaggatgagtctacatcctattagctagttggcagggtaatggcctaccaaggcgatgatgggtagcgggtgtgagagcacgacccgcgtcattgggactgagacactgcccagacacctacgggtggctgcagtcgagaatcttcggcaatgggcgaaagcctgaccgagcgacgccgcgtgcgggatgaaggccttcgggttgtaaaccgctgtcagaggggatgaaatgcaggtgggttctcccatctgtttgacatagcctcagaggaaggacgggctaagttcgtgccagc

SEQ ID NO: 958 - DNA, 490 bp, Unknown
  Ascusbbf_107690, encodes 16S rRNA
agagtttgatcatggctcaggacgaacgctggcggcacgcttaacacatgcaagtcgaacggagttgtttggagcttgctctgaacaacttagtggcggacgggtgagtaacacgtgagcaacctgcctttgagagcggaatagcttctggaaacggatggtaataccgcataacattaacggaccgcatgatctgttaatcaaagatttatcgctcaaagatgggctcgcggctgattagatagttggtggggtaacggcctaccaagtcgacgatcagtagccggactgagaggttgaacggccacattgggactgagacacggcccagactcctacgggaggcagcagtggggaatattgcacaatgggcggaagcctgatgcagcgatgccgcgtggaggaagaaggttttcggattgtaaactccttttatcagggacgataatgacggtacctgaagaaaaagctccggctaactacgtgccag

SEQ ID NO: 959 - DNA, 472 bp, Unknown
  Ascusbbf_82420, encodes 16S rRNA
agagtttgatcatggctcagaacgaacgctggcggcatgcctaacacatgcaagtcgaacggagggcttcggccctcagtggcggacgggtgagtagcgcgtgggaacctgccccgtggtacggaataacgtctggaaacggacgctaataccgtatgcgccctgtgggggaaagatttatcgccatgggaggggcccgcgtccgattaggtagttggtggggtaacggcctaccaagccgacgatcggtagctggtctgagaggatgatcagccacactgggactgagacacggcccagactcctacgggaggcagcagtggggaatattggacaatgggggcaaccctgatccagcaatgccgcgtgagtgatgaaggccttcgggttgtaaagctctttcgcacgcgacgatgatgacggtagcgtgagaagaagccccggctaacttcgtgccagcagccgcggtaat

SEQ ID NO: 960 - DNA, 490 bp, Unknown
  Ascusbbf_1499390, encodes 16S rRNA
agagtttgatcatggctcaggatgaacgctggcggcatgcctaagacatgcaagtcgaacgaagtagcctgttgaagattgagtgcttgcacaatttctgatacagttttctacttagtggcagacgggtgagtaacacgtgggtaacctacctcaatgactgggataacagttagaaatgactgctaataccggataattcatagttagataactagctatgctaaaagaagcgtttgcttcactttgagatgggcttgcgttgtattagcttgttggtggggtaatggcctaccaaggctacgatgcatatccgagctgagaggctgatcggacacactgggactgagacacggcccagactcctacgggagacagcagttaggaatattcgtcaatgggggaaaccctgaacgagcaatgccgcgtgagtgatgaaggtctttttgattgtaaaactctgttgtaaagaaagaaaccttaagatagg

SEQ ID NO: 961 - DNA, 490 bp, Unknown
  Ascusbbf_191167, encodes 16S rRNA
agagtttgatcatggctcaggatgaacgctagcggcaggcttaacacatgcaagtcgaggggcatcgcgggggtagcaatacacctggcggcgaccggcggaagggtgcgtaacgcgtgagcaacatgcccgtcacagggggataacagttggaaacgactcctaataccccgtaacatcatttgtggcatcgcagatggttgaaagctttttgcggtgacggattggctcgcgtgacattagctagttggagtggtaacggcacaccaaggcgacgatgtctaggggttctgagaggaaggtcccccacactggaactgagacacggtccagactcctacgggaggcagcagtgaggaatattggtcaatgggcggaagcctgaaccagccatgccgcgtgaaggaataaggtcctatggatcgtaaacttcttttgtacgggagcaataagggcgtcgtgacgtccgatgagagtaccgtacgaataa

SEQ ID NO: 962 - DNA, 490 bp, Unknown
  Ascusbbf_400781, encodes 16S rRNA
agagtttgatcatggctcaggatgaacgctggcggcaggcttaatacatgcaagtcgaacggtaaggccgagtgtagcaatacacgaggtacacgagtggcgcacgggtgcgtaacgcgtatgcaacctgcccctgaccgggacaaaacagctggaaacggctgctaatatcccatggttaccgaggagggcatcctcctttgtataaagatttattggtcggggatgggcatgcgtattattaggtagttggtggggtaacggcccaccaagccgacgatgattaggggttctgagaggattaacccccacactggaactgagacacggtccagactcctacgggaggcagcagtagggaatattgggcaatggaggcaactctgacccagccatgccgcgtgaaggaagacggccctatgggttgtaaacttcttttatcgtggagtaaacccggtcacgtgtggccggttgagagtacacgaggaat

SEQ ID NO: 963 - DNA, 490 bp, Unknown
  Ascusbbf_51195, encodes 16S rRNA
agagtttgatcatggctcaggattaacgctggcggcgtgcctaatacatgcaagtcgaatggtttagcttgctagaccatggcgaacgggtgagtaacacgtaggtaacctgtcttaaagacgaggataaccattggaaacgatggataatactggataggacataataaagcacatgcaaacatgtttaaaggagcaatccacttaaagaggggcctgcggcgcattagctagttggtgagataagagcccaccaaggcaatgatgcgtagccggactgagaggttgaacggccacaatgggactgagaacggcccatactcctacgggaggcagcagtagggaattttcggcaatgggcggaagcctgaccgagcaacgccgcgtgaacgaagaagtatttcggtatgtaaagttcttttatttgggaagaaaagacagattgactgtaccaaatgaataagctccggctaactacgtgccagcagcc

SEQ ID NO: 964 - DNA, 490 bp, Unknown
  Ascusbbf_234038, encodes 16S rRNA
agagtttgatcatggctcagaacgaacgctggcggcgcgtcttaagcatgcaagtcgaatggcaagaagagagcttgctctcttcctagaatggcggactggtgagtaacgcgtgggtgacgtaccctttagctggggatagcttttagaaataagagataataccgaataagctgcattttgttagagggaatgcaggaaaggatctttagattcactgaaggaacggcccgcgtactattagttagttggtgaggtaacggcccaccaaggcgatgatagttacccggcctaagagggggatcgggcacattgggactgagatacggcccagactcctacgggaggcagcagctaagaatattccgcaatggacgaaagtctgacggagcgacgccgcgtggacgaagaaggccggaaggttgtaaagtccttttataactgaggaataaggaagatgagagaaacgtcttctggtgactgtaggtta

SEQ ID NO: 965 - DNA, 490 bp, Unknown
  Ascusbbf_88954, encodes 16S rRNA
agagtttgatcatggctcaggacgaacgctggcggcgtgcttaacacatgcaagtcgagcgagggcatttggcttcggctgaatgaccgagcggcggacgggtgagtaacgcgtgaacgatctgtccctaacagggggataccacttggaaacaggtgctaataccgcataagaccacagtgctgcatggcacaggggtaaaaggagcaatccggtgaggggtgagttcgcgtccgattagccagttggcggggtaacggcccaccaaagcgacgatcggtagccgacctgagagggtgatcggccacattggaactgagagacggtccaaactcctacgggaggcagcagtgggaatattgggcaatgggcgaaagcctgacccagcaacgccgcgtgaaggaagaaggttttcggattgtaaacttctgtcctaagagacgaaggaagtgacggtaacttaggaggaagccccggctaactacgtgcc

SEQ ID NO: 966 - DNA, 490 bp, Unknown
  Ascusbbf_303878, encodes 16S rRNA
agagtttgatcctggctcaggacgaacgctggcggcgtgcctaacacatgcaagtcgagcgaagaagctccttcgggaggttcttagcggcggacgggtgagtaacacgtgggtaacctgcctcaaagagggggatagcctcccgaaagggagattaataccgcataataagtgcggttcgcatgaaccgcactttaaaggagaaatccgctttgagatggacccgcggcgcattagctagttggtaaggcaatggcttaccaaggcaacgatgcgtagccgacctgagagggtgaacggccacattggaactgagagacggtccagactcctacgggaggcagcagtggggaatattgcacaatgggcgaaagcctgatgcagcaacgccgcgtgagtgaagaaggttttcggattgtaaagctctgtcatctgggacgataatgacggtaccagatgaggaagccacggctaactacgtgccagcagc

SEQ ID NO: 967 - DNA, 490 bp, Unknown
  Ascusbbf_503803, encodes 16S rRNA
agagtttgatcatggctcaggatgaacgctggcggcgtgcctaacacatgcaagtcgaacgaagcacttaagctgatccttcgggagaagtttttgtgactgagtggcggacgggtgagtaacgcgtgggtaacctgccctgtacagggggataacagtcagaaatgactgctaataccgcataagcgcacaaaaggacatcctttggtgtgaaaaactccggtggtacaggatgggcccgcgtctgattagcttgttggcggggtaaaggcccaccaaggcgacgatcagtagccggtctgagaggatgaacggccacattggaactgagacacggtccaaactcctacgggaggcagcagtggggaatattgcacaatggggggaaccctgatgcagcaacgccgcgtgagtgaagaagtatttcggtatgtaaagctctatcagcagggaagataatgacggtacctgactaagaagctccggctaa

SEQ ID NO: 968 - DNA, 490 bp, Unknown
  Ascusbbf_87202, encodes 16S rRNA
agagtttgatcctggctcaggacgaacgctggcggcgtgcttaatacatgcaagtcgaacgagaagcagatgcttgcatctgtggaaagtggcgaacgggtgagtaacgcgtatgtaaccaacctcatgcagggggatagcccagggaaacctggattaaacccgcataagaccacagtaccgcatgatacagtggtaaaaactccggtggcatgagacggacatgcgtcttattaggtagttggtgaggtaacggctcaccaagccgacgatgagtagccgacctgagagggtgatcggccacattgggactgagacacggcccagactcctacgggaggcagcagtagggaatattgcgcaatgggggcaaccctgacgcagcaacgccgcgtgagtgattgaaggttttcggatcgtaaagctctgttctgggggaagataatgacggtaccccagcaggaagctccggctaaatacgtgccagcag

SEQ ID NO: 969 - DNA, 490 bp, Unknown
  Ascusbbf_373496, encodes 16S rRNA
agagtttgatcctggctcaggatgaacgctggcggcgtgcataacacattcaagtcgaacggacatattggcttcggtcgatatgttagtggcggacgggtgagtaacgcgtgagcaacctgcccctatgtgcgggataacggctggaaacggacgctaataccgcataatccaacggaaccgcatgattttgttggcaaagatttattgcatagggatgggctcgcgtccgattagatagttggcggtgcaacggaccaccaagtcgacgatcggtagccggactgagaggttgaacggccacattggaactgagaaacggtccagactcctacgggaggcagcagtggggaatattgggcaatgggcgaaagcctgacccagcgacgccgcgtgaaggaagacggtcctcggattgtaaacttcttttatgtaggacgaagcaatgacggtactacatgaataagccacggctaactacgtgccagca

SEQ ID NO: 970 - DNA, 490 bp, Unknown
  Ascusbbf_195284, encodes 16S rRNA
agagtttgatcctggctcaggatgaacgctagcgacaggcctaacacatgcaagtcgaggggtaacaggggagcttgctcccgctgacgaccggcgcacgggtgagtaacacgtatgcaacctacccgtaagagggggataacccggagaaatccggactaacaccgcataataccgtttgggggcatcctcggacggttaaatattcatagcttacggatgggcatgcgcatgattagctagttggtggggtaacggcctaccaaggcgacgatcattaggggtcctgagagggaaatcccccacattggtactgagacacggaccaaactcctacgggaggcagcagtgaggaatattggtcaatgggcgagagcctgaaccagccatgtcgcgtgaaggatgaatgtcctatggattgtaaacttcttttataggggaataaagtgggtcttgcgaggccttttgcatgtaccctatgaataagcat

SEQ ID NO: 971 - DNA, 490 bp, Unknown
  Ascusbbf_480532, encodes 16S rRNA
agagtttgatcatggctcaggatgaacgctagcggcaggcttaacacatgcaagtcgcggggcagcgcgggtagcaatacctggcggcgaccggcggaagggtgcgtaacgcgtgagcaacatgcccgtatcagggggataaccgatggaaacgtcgcctaataccccataacaacagtccccgcatgaggacagtttgaaagttacggcggatacggattggctcgcgtgacattagctggttggcggggtaacggcccaccaaggcgacgatgtctaggggttctgagaggaaggtcccccacactggaactgagacacggtccagactcctacgggaggcagcagtgaggaatattggtcaatgggcgcaagcctgaaccagccatgccgcgtgcaggaatgaggccctatgggtcgtaaactgcttttgctgcggagcaataagtgtcacgtgtggcacgatgagagtacgcagcgaataagcatc

SEQ ID NO: 972 - DNA, 490 bp, Unknown
  Ascusbbf_240570, encodes 16S rRNA
agagtttgatcatggctcaggatgaacgctggcggcgtgcttaacacatgcaagtcgagcgagaagcccatgatcgatacttcggttgattgattgggtggaaagcggcggacgggtgagtaacgcgtaggcaacctgccccttgcagagggatagccattggaaacgatgattaatacctcataatgcgggaccaagacatcttggacctgccaaagatttatcggcaagggatgggcctgcgtctgattagctggttggtggggtaacggctcaccaaggcgacgatcagtagccgacctgagagggtgatcggccacattggaactgagacacggtccagactcctacgggaggcagcagtggggaatattgcacaatgggcgcaagcctgatgcagcaacgccgcgtgaaggaagaaggcctttgggtcgtaaacttctgtccttagggaagataatgacggtacctttggaggaagccccggcta

SEQ ID NO: 973 - DNA, 487 bp, Unknown
  Ascusbbf_108476, encodes 16S rRNA
agagtttgatcatggctcagggtgaacgctggcggcgtgcctaagacatgcaagtcgaacgggcctgatttcggtcaggctagtggcggacgggtgagtaacacgtgggtgatctaccccaaagtctgggacaactaggggaaaccttagctaatcccggatggtgaggcttctcctgtgaagtctctaaagatttatcgctttgggatgagcccgcggcgcatcagctagttggtggggtaatggcctaccaaggcgacgacgcgtagctggtctgagaggacgaccagccacaggagcactgagacacgggctccactcctacgggaggcagcagttaggaatcttcgtcaatgggcgaaagcctgaacgagcgacgccgcttgagggacgaagcccttcggggtgtaaacctctgaacaggggacgatgatgacggtaccctgctaatagcaccggctaactccgtgccagcagccgcggtaat

SEQ ID NO: 974 - DNA, 490 bp, Unknown
  Ascusbbf_299235, encodes 16S rRNA
agagtttgatcatggctcagaacgaacgctggcggcgcgtcttaagcatgcaagtcgagcggtagcagcaatgcgagagcggcggacgggtgagtaacacgtgggtaatctgccctccagtcggggatagcctgtggaaacacaggataataccggatgcgatggtcttgcacaagtgagatcaggaaaggggccaaggccccgctggaggatgagcccgcgtcccattagctagatggcggggtaacggcccaccatggcgatgatgggtagccggcctgagagggtgaacggccacattggaactgagacacggtccagactcctacgggaggcagcagctaagaatcttccacaatggacggaagtctgatggagcgacgccgcgtgcgcgatgaaggccgtgaggttgtaaagcgcttttcttgagggggaacaacacgggcagggaatggcccgtggatgacgtgaatcgaggaataagccccgg

SEQ ID NO: 975 - DNA, 490 bp, Unknown
  Ascusbbf_1735636, encodes 16S rRNA
agagtttgatcatggctcaggatgaacgctggcggcgtgcctaatacatgcaagtcgaacgctaaccttcgggttagagtggcgaacgggtgagtaacacgtaggtaacctgcccataagacgaggataactactggaaacggtagctaatactggatagtatatagagtcgcatggctttatatttaaagatgccttcaagcatcacttatggatggacctgcggcgcattagctagtcggtgagatagcagcccaccaaggcgacgatgcgtagccggactgagaggttgaacggccacattgggactgagacacggcccagactcctacgggaggcagcagtagggaattttcggcaatggacgcaagtctgaccgagcaacgccgcgtgagtgatgaagttcttcggaacgtaaaattcttttatttgaaaagaacgtatattgtaggaaatgacagtatagtgatggtaccaaatgaataagccc

SEQ ID NO: 976 - DNA, 490 bp, Unknown
  Ascusbbf_233315, encodes 16S rRNA
agagtttgatcatggctcaggataaacgctggcaccatgcctaatacatgcatgtcgtacgagagcttcggctcgagtggcaaatgggtgagtaacacgtagggaaccttccctagcgacgaggataacggttggaaacgactgctaatactggatagtatatcggaccgcatgatctgatatttaaagctgtgaagcgcgctaggatggccctgcggcgcattagatagttggtgaggtaacggcccaccaagtctgtgatgcgtagctgcactgagaggtgaaacagccacattgggactgagacacggcccaaactcctacgggaggcagcagtagggaattttcggcaatgggcgaaagcctgaccgagcaatggtgcgtgaacgatgaagatccttggattgtaaagttcttttattggggatgaaaaaacgtgaagagcgtaattgacagtacccattgaataagccccggccaactatgtgcc

SEQ ID NO: 977 - DNA, 490 bp, Unknown
  Ascusbbf_1817296, encodes 16S rRNA
agagtttgatcatggctcaggacgaacgctggcggcgtgcctaacacatgcaagtcgagcgaggacattggattagcttgctaagctgatgttcgagcggcggacgggtgagtaacgcgtgaacaatctgtcccggacagggggataacacttggaaacaggtgctaataccgcataagcccacggggtcgcatgacgctgagggaaaaggaggaatccggttcggggtgagttcgcgtccgattagatagttggtgaggtaacggcccaccaagtcaacgatcggtagccgacctgagagggtgatcggccacattggaactgagacacggtccaaactcctacgggaggcagcagtgggaatattgggcaatgggcgaaagcctgacccagcaacgccgcgtgagggaagaaggttttcggattgtaaacctctgtcctcagggacgaaggaagtgacggtacctgaggaggaagccccggctaacta

SEQ ID NO: 978 - DNA, 490 bp, Unknown
  Ascusbbf_722956, encodes 16S rRNA
agagtttgatcatggctcaggacgaacgctggcggcgtgcttaacacatgcaagtcgaacggagcgtacggacggaagttttcggacggaagactgtacgcttagtggcggacgggtgagtaacgcgtgagcaatctgcccataagagggggacaacagccggaaacagctgctaataccgcatgagaccacattaccgcatggtagaggggtcaaagaaattcgcttatggatgagctcgcgtccaattaggcagttggcggggcaacggcccaccaaaccgacgattggtagccgacctgagagggtgaacggccacattggaactgagacacggtccaaactcctacgggaggcagcagtggggaatattgggcaatggaggcaactctgacccagcaacgccgcgtgagggaagaaggttttcggattgtaaacctctgtcctatgggacgaacaaatgacggtaccatgggaggaagctccggct

SEQ ID NO: 979 - DNA, 490 bp, Unknown
  Ascusbbf_282448, encodes 16S rRNA
agagtttgatcatggctcaggatgaacgctagcggcaggcctaacacatgcaagtcgaggggcagcgcggggtagcaatactctggcggcgaccggcggaagggtgcgtaacgcgtgagcaacctgcccgtgtccggggcataatcggtggaaacgccgtctaattccccataacaacagaactgacatcagttttgtttaaaaactttttgcggacacggatgggctcgcgtctgattagcttgttggcggggtaacggcccaccaaggcgacgatcagtaggggttctgagaggaaggtcccccacactggaactgagacacggtccagactcctacgggaggcagcagtgaggaatattggtcaatgggcggaagcctgaaccagccatgccgcgtgaaggaataaggccctatgggtcgtaaacttcttttgacggggagcaataagggtcacgtgtggtccgatgagcgtactcgtcgaataagc

SEQ ID NO: 980 - DNA, 490 bp, Unknown
  Ascusbbf_220652, encodes 16S rRNA
agagtttgatcatggctcaggatgaacgctagcgacaggcctaacacatgcaagtcgaggggcagcacgatgtagcaatacgttggtggcgaccggcgcacgggtgcgtaacaggtatgcaatctgtcccataccggggcatagcccgctgaaaggcggattaattctccatgtgtcatgagagggcatccttttatgatgaaacgtaagggtatgggatgagcatgcttatgattagatagtaggcggggtaacggcccacctagtcgacgatcattaggggtcctgagagggagatcccccacattggaactgagacacggtccaaactcctacgggaggcagcagtgaggaatattggtcaatgggcggaagcctgaaccagccaagtcgcgtgaaggaagacggttctatggattgtaaacttcttttgtccgagggtaaagtgagtcacgtgtggcttattgcaagtatcggacgaataagcatc

SEQ ID NO: 981 - DNA, 490 bp, Unknown
  Ascusbbf_267757, encodes 16S rRNA
agagtttgatcctggctcagattgaacgctggcggcatgccttacacatgcaagtcgaacggtaacaggtcttcggatgctgacgagtggcgaacgggtgagtaatacatcggaacgtgcccaagagtgggggataacgaggcgaaagctttgctaataccgcatacgatctcaggatgaaagcaggggaccgcaaggccttgcgctcctggagcggccgatggcagattaggtagttggtgggataaaagcttaccaagccaacgatctgtagctggtctgagaggatgatcagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaaagcttttctctaataaagggaagtgatgacggtaccgtaagaataagcaccg

SEQ ID NO: 982 - DNA, 490 bp, Unknown
  Ascusbbf_258156, encodes 16S rRNA
agagtttgatcatggctcaggatgaacgctggcggcgtgcttaacacattcaagtcgaacggacgaggggagcttgctccccaagttagtggcggacgggtgagtaacgcgtgagcaacctgcctttctaagcgggataacagagggaaaccgctgctaataccgcataacgtatgatgaacgcatgttcgacataccaaaggagcgatccgaagaaagatgggctcgcgtctgattagatagttggtgaggtaacggcccaccaagtctgcgatcagtagccggactgagaggttgaacggccacattggaactgagaaacggtccagactcctacgggaggcagcagtggggaatattgggcaatgggcgaaagcctgacccagcgacgccgcgtgagggaagaaggtcttcggattgtaaacctttgtcaacagggacgaagcaagtgacggtacctgtggaggaagccacggctaactacgtgcca

SEQ ID NO: 983 - DNA, 490 bp, Unknown
  Ascusbbf_293717, encodes 16S rRNA
agagtttgatcctggctcaggatgaacgctggcggcgtgcctaacacatgcaagtcgaacggttaaggcggcttcggccgcgaatagagtggcgaacgggtgagtaacacgtgaccaacctgccccgcgcaccgggacagcctcgtgaaaacgggattaataccggatactccggcgggcccgcatgggcccgccgggaaagctccggcggcgcgggatggggtcgcggcccattaggtagacggcggggtgacggcccaccgtgccgacgatgggtagccgggttgagagaccgaccggccacattgggactgagatacggcccagactcctacgggaggcagcagtggggaatattgcgcaatgggggcaaccctgacgcagcaacgccgcgtgcgggaagaaggccttcgggttgtaaaccgctttcagcagggaagacatcgacggtacctgcagaagaagccccggctaactacgtgccagcagc

SEQ ID NO: 984 - DNA, 490 bp, Unknown
  Ascusbbf_728453, encodes 16S rRNA
agagtttgatcctggctcagattgaacgctggcggcacgcttaacacatgcaagtcgaacggttgtgaatagcttgctatttacgatagtggcggacgggtgagtaatgcgtaggaacctacctagaagcgggggataacatggggaaactcgtgctaagaccgcatacgctctgaggaggaaaagctggtagtaataccagttacttttagatgggcctacgtcggattagctagttggttaggtaaaggctgaccaaggcgatgatccgtagctggtttgagaggacgaacagccacactgggactgagaacggcccagactcctacgggaggcagcagtggggaatcttggacaatgggggaaaccctgatccagcgatgccgcgtgtgtgaagaaggcctgcgggttgtaaagcactttagtgggggaggaaagccgtaagtttaagagatgtacggattgacgttaccccaagaataagcaccgg

SEQ ID NO: 985 - DNA, 490 bp, Unknown
  Ascusbbf_725566, encodes 16S rRNA
agagtttgatcatggctcaggacgaacgctggcggcgtgcttaacacatgcaagtcgaacggggaacaaacgcttcggcatttgtttccagtggcggacgggtgagtaacgcgtgaacaagctgtccttcacagggggataacactgagaaatcagtgctaataccgcataagaccacattgccgcatggcagaggggtcaaaggagtaatccggtgaagggggcgttcgcgtcccattagatagttggtgaggtaacggcccaccaagtcagcgatgggtagccgagctgagaggctgatcggccacactgggactgagacacggcccagactcctacgggaggcagcagtgggaatattgggcaatgggggaaacccttacccagcaacgccgcgtgagagaagaaggttttcggattgtaaatctctgtccttgggggcgaagtaagtgacggtacccagggaggaagccccggctaactacgtgcc

SEQ ID NO: 986 - DNA, 490 bp, Unknown
  Ascusbbf_1686680, encodes 16S rRNA
agagtttgatcctggctcaggacgaacgctggcggcgtgcctaacacatgcaagtcgagcggggatacattggaggagagcttcggcaggaatcggatgtatttcagcggcggacgggtgagtaacgcgtgaacaatctgtcccggacagggggataacacttggaaacaggtgctaataccgcatgagaccacagccccgcatgggggaggggtcaaaggagtgatccggtccggggtgagtccgcgtctgattagctggttggtgaggtaatggcccaccaaggcgacgatcagtagccgacctgagagggtgatcggccacattggaactgagagacggtccaaactcctacgggaggcagcagtggggaatattgggcaatgggcgaaagcctgacccagcaacgccgcgtgagggaagaaggttttcggattgtaaacctctgtccttggggacgaaggaagtgacggtacccgaggaggaagcc

SEQ ID NO: 987 - DNA, 490 bp, Unknown
  Ascusbbf_174382, encodes 16S rRNA
agagtttgatcatggctcaggatgaacgctggcggcgtgcctaatacatgcaagtcgaacgggggtacttgtaccctagtggcgaacgggtgaggaacacgtaggtaacctgccttttagtttgggatacccagaggaaactttggctaataccggatatgaattttggaggcatctccgaaatttgaaaggagcgtttgctccgctttaagatggacctgcggcgcattagctagttggtgagataacagcccaccaaggcgaggatgcgtatccgatctgagaggatgaccggacacattggaactgagacacggtccaaactcctacgggaggcagcagtaaggagttttcggcaatgggcgaaagcctgaccgagcaacgccgcgtgagtgatgacggccctatgggttgtaaagctctgttgtaagggaagaatgacgaggtgaggaaatgcacttcgtttgacggtaccttaccagaaagccac

SEQ ID NO: 988 - DNA, 490 bp, Unknown
  Ascusbbf_241703, encodes 16S rRNA
agagtttgatcatggctcaggatgaacgctggcggcgtgcctaacacatgcaagtcgaacggagcagttccttcgggagctgcttagtggcggacgggtgagtaacgcgtgagcaacctgcccttcagagggggacaacagttggaaacgactgctaataccgcatgatgtatccgggaggcatcttccggataccaaagatttatcgctgaaggatgggctcgcgtctgattagatagttggtgaggtaacggcccaccaagtctacgatcagtagccggactaagaggttgaacggccacattgggactgagatacggcccagactcctacgggaggcagcagtggggaatattgggcaatggggggaaccctgacccagcaacgccgcgtgaaggaagaaggctttcgggttgtaaacttcttttaagagggacgaagaagtgacggtacctcttgaataagccacggctaactacgtgccagcagc

SEQ ID NO: 989 - DNA, 490 bp, Unknown
  Ascusbbf_1745532, encodes 16S rRNA
agagtttgatcatggctcaggacgaacgctggcggcgtgcctaacacatgcaagtcgagcggggatatcaggaacggcggcttcggctaaagggagaggtattccagcggcggacgggtgagtaacgcgtgaactatctgtcccggacagggggataacacttggaaacaggtgctaataccgcataagaccacgtggccgcatggccgaggggtcaaaggagcgatccggtccggggtgagttcgcgtctgattaaatagttggtgaggtaacggcccaccaagtcaacgatcagtagccgacctgagagggtgaacggccacattggaactgagagacggtccaaactcctacgggaggcagcagtgggaatattgggcaatgggcgaaagcctgacccagcaacgccgcgtgagggaagaaggttttcggattgtaaacctctgttgtgggtgacgaaggaagtgacggtagtccacaaggaagccc

SEQ ID NO: 990 - DNA, 490 bp, Unknown
  Ascusbbf_19818, encodes 16S rRNA
agagtttgatcatggctcaggatgaacgctggcggcgtgcctaacacattcaagtcgaacggagttattccggcgaggtcttcgggccaagctgttttaacttagtggcggacgggtgagtaacgcgtgagcaacctgcctttgcaaccgggataacagccggaaacagctgctaatacgggatgatgtatatctgccgcatgacagatataccaaagatccgttgtgcaaagatgggctcgcgtctgattagatagttggcggggcaacggcccaccaagtcgacgatcagtagccggactgagaggttgaacggccacattggaactgagatacggtccagactcctacgggaggcagcagtggggaatattgggcaatggacgaaagtctgacccagcgacgccgcgtgagggaagaaggtcttcggattgtaaacctctgttgatagggaagaagacagtgacggtacctatcgaggaagtcacgg

SEQ ID NO: 991 - DNA, 490 bp, Unknown
  Ascusbbf_85825, encodes 16S rRNA
agagtttgatcctggctcagagttaacgctggcggcgtgcctaacacatgcaagtcgagcgaattcttacagagcatcgtaagagttagcggcaaacgggtgagtaacacatgggaaacctcccttagaatggggaatatctccgtgaaaacggagctaataccgcataagaccacagtttggcatcaaacaggggtaaaagcagcaatgcgttctaagatggtcctgtgtcctatcagctagttggtgagataacggcttaccaaggctaagacgggtatccggcctgaaagggtgaacggacacactggaactgagacacggtccagactcctacgggaggcagcagtggggaattttggacaatgggggaaaccctgatccagcgacgccgcgtggaggacgaaggtcttcggattgtaaactccttttggaggggaagaaaaaaatgacggtaccctcagaaaaagccacggctaacttcgtgcca

SEQ ID NO: 992 - DNA, 490 bp, Unknown
  Ascusbbf_154177, encodes 16S rRNA
agagtttgatcatggctcagaacgaacgccggcggcgcgtcttaagcatgcaagtcgggcgggattgaggagcttgctcctcatgagagcggcggactggtgagtaacgcgtgggcgacgtaccccctgcaccgggacagccggcagaaatgccgggtgatacgggataagctcttaccctgcggtggggtgagaggaaagcggctacggccgcggcaggggaacggcccgcgtcccatcagctagtcggcggggtaaaggcccaccgaggcaacgacgggtacccggactgagaggttggacgggcacattgggactgagatacggcccagactcctacgggaggcagcagctaagaatattccgcaatgggcgaaagcctgacggagcgacgccgcgtggacgatggaggccggaaggttgtaaagtcctctggcgggggaagaagaagcaggggagggaatgcccctgcggtgaccgtaccccgaga

SEQ ID NO: 993 - DNA, 490 bp, Unknown
  Ascusbbf_8939, encodes 16S rRNA
agagtttgatcatggctcaggacgaacgctggcggcgtgcttcatacatgcaagtcgaacgagaagcaggagcttgctcctgtggaaagtggcggacgggtgagtaatatgtagagaatctgccctagagagggggacaacagagggaaacttctgctaataccccatatgagcgtagctgaaatgctattcttgaaaactccggtgctctaggatgagtctgcatctgattagcttgttggcggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgaacgatgacgcccctcggggtgtaaagttctgtcagtagggacgaaacttgacggtacctacagaggaagcaccggctaactccgtgccagcagccg

SEQ ID NO: 994 - DNA, 470 bp, Unknown
  Ascusbbf_38717, encodes 16S rRNA
agagtttgatcatggctcagaacgaacgctggcggcaggcctaacacatgcaagtcgaacgctgtagcaatacagagtggcagacgggtgagtaacacgtgggaatcttcctatcggtgcggaatagcccagggaaacttggggtaataccgcatacgcccttcgggggaaagatttatcgccgatagacgagcccgcgtctgattagctagttggtggggtaatggcctaccaaggcgacgatcagtagctggtctgagaggatgatcagccacactgggactgagacacggcccagactcctacgggaggcagcagtggggaatattggacaatgggcgaaagcctgatccagccatgccgcgtgagtgacgaaggtcttcggattgtaaagctcttttggcggggacgataatgacggtacccgcagaataagccccggctaacttcgtgccagcagccgcggtaat

SEQ ID NO: 995 - DNA, 490 bp, Unknown
  Ascusbbf_12288, encodes 16S rRNA
agagtttgatcctggctcaggacgaacgctggcggcgtgcctaatacatgcaagtcgtacgcttctttttccaccggagcttgctccatcggaaaaagaagagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatccct

SEQ ID NO: 996 - DNA, 490 bp, Unknown
  Ascusbbf_27513, encodes 16S rRNA
agagtttgatcctggctcaggacgaacgctggcggcgtgcttcacacatgcaagtcgaacggaaaggccctttcgggggtactcgagtggcgaacgggtgagtaacacgtgagtaatctgcctttggctttgggataagcctcggaaacggggtctaataccggatgtgacctgtccctgcatgggggtgggtggaaagtttttcggccagagatgagctcgcggtttatcagcttgttggtggggtaatggctcaccaaggctttgacggatagccggcctgagagggcgaccggccacactgggactgagacacggcccagactcctacgggaggcagcagtggggaatattgcgcaatgggcgaaagcctgacgcagcgacgccgcgtgagggatgacggccttcgggttgtaaacctctttcagtaccgacgaagtgagaatgacggtaggtacagaagaagcgccggctaactacgtgccagcag

SEQ ID NO: 997 - DNA, 490 bp, Unknown
  Ascusbbf_25768, encodes 16S rRNA
agagtttgatcctggctcaggatgaacgctggcggcgtgcctaacacatgcaagtcgaacggttaaaccggcttcggccggaaatagagtggcgaacgggtgagtaacacgtgaccaacctgccccgcgcaccgggatagccccccgaaagggggattaataccggatgcgccgggagggccgcatggccctcccgggaaagcctttgcggcgcgggatggggtcgcggcccatcaggtagtaggcggggtagaggcccgcctagcctacgacgggtagccgggttgagagaccgaccggccacattgggactgagatacggcccagactcctacgggaggcagcagtggggaatattgcgcaatgggggcaaccctgacgcagcaacgccgcgtgcgggacgaaggccttcgggttgtaaaccgctttcagcagggaagacatcgacggtacctgcagaagaagccccggctaactacgtgccagcagc

SEQ ID NO: 998 - DNA, 490 bp, Unknown
  Ascusbbf_12913, encodes 16S rRNA
agagtttgatcatggctcaggacaaacgctggcggcgcacataagacatgcaagtcgaacggacttaatcgatttatttataaattgaagcggttagtggcggactggtgagtaacacgtgggcaacctgcctttaagaggggaataacagtgagaaatcattgctaataccgcataatgttattttgtcgcatgacagagtaaccaaaggagcaatccgcttaaagatgggcccgcgcctgattagctagttggtgtggtaacggcataccaaggcgacgatcagtagccggactgagaggttcaacggccacattgggactgagatacggcccagactcctacgggaggcagcagtcgggaatattgcacaatggaggaaactctgatgcagtgacgccgcgtataggaagaaggttttcggattgtaaactattgtcgaaggggaagaataaatgacagtacccttggaggaagccccggctaacta

SEQ ID NO: 999 - DNA, 490 bp, Unknown
  Ascusbbf_137997, encodes 16S rRNA
agagtttgatcatggctcaggacgaacgctggcggcgtgcctaatacatgcaagtcgagcggaccaattagaaagcttgctttttgattggttagcggcggacgggtgagtaacacgtgggtaacctgccctatagaccgggataactcgcggaaacgcgtgctaataccggataacacatcgaagcgcatgcttcggggttgaaagatggttctgctatcactataggatgggcccgcggcgcattagctagttggtggggtaacggcctaccaaggcgacgatgcgtagccgacctgagagggtgatcggccacactgggactgagacacggcccagactcctacgggaggcagcagtagggaatcttccacaatgggcgaaagcctgatggagcaacgccgcgtgagcgaagaaggtcttcggatcgtaaagctctgttgtaagggaagaacaagcgcagcagtcactggctgcgccctgacggtac

SEQ ID NO: 1000 - DNA, 490 bp, Unknown
  Ascusbbf_235920, encodes 16S rRNA
agagtttgatcatggctcaggacgaacgctggcggcgtgcctaacacatgcaagtcgaacggacgaagggagcttgctcccctagttagtggcgaacgggtgagtaacgcgtgagcaacctgcctttcagagggggacaacggttggaaacgaccgctaataccgcatgaagcatcggggtcgcatggccttgatgttaaagatttatcgctgaaagatgggctcgcgtctgattagatagttggcggggtaacggcccaccaagtcgacgatcagtagccggactgagaggttgaacggccacattgggactgagatacggcccagactcctacgggaggcagcagtggggaatattgggcaatgggggaaaccctgacccagcaacgccgcgtgaaggaagaaggctttcgggttgtaaacttcttttaccagggacgaaggacgtgacggtacctggagaaaaagccacggctaactacgtgccagc

SEQ ID NO: 1001 - DNA, 490 bp, Unknown
  Ascusbbf_20277, encodes 16S rRNA
agagtttgatcatggctcaggacgaacgctggcggcgtgcctaatacatgcaagtcgagcggacggatgggagcttgctcccagaagttagcggcggacgggtgagtaacacgtgggcaacctgccctatagttggggataactccgggaaaccggggctaataccgaatgatataatttagctcctgctagattgttgaaagatggtttacgctatcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtacctt

SEQ ID NO: 1002 - DNA, 490 bp, Unknown
  Ascusbbf_44545, encodes 16S rRNA
agagtttgatcatggctcagattgaacgctggcggcaggcttaacacatgcaagtcgagcggtaacagagagaagcttgcttctctgctgacgagcggcggacgggtgagtaatgcctaggaatctgcctagtagtgggggataacttgccgaaaggtaagctaataccgcatacgtcctacgggagaaaggaggggaccttcgggcctttcgctattagatgagcctaggtcggattagttagttggtgaggtaatggctcaccaagaccgcgatccgtaactggtctgagaggatgatcagtcacactggaactgagacacggtccagactcctacgggaggcagcagtggggaatattggacaatgggggaaaccctgatccagccatgccgcgtgtgtgaagaaggtcttaggattgtaaagcactttaagttgggaggaagggcagttaactaatatttgactgttttgacgttaccgacagaat

SEQ ID NO: 1003 - DNA, 490 bp, Unknown
  Ascusbbf_5791, encodes 16S rRNA
agagtttgatcatggctcaggacgaacgctggcggcgtgcttaacacatgcaagtcgaacgaggttattttgatgagatcttcggatggattcggaataaccgagtggcggacgggtgagtaacgcgtgagcaacctgtcttacacagggggataacgctccgaaaggagtgctaataccgcataggaccacggtgctgcatggcattgaggtgaaaggagcaatccggtgtaaggtgggctcgcgtcccattagatagttggtgaggtaacggctcaccaagtcgacgatgggtagccgacctgagagggtgatcggccacattggaactgagatacggtccagactcctacgggaggcagcagtggggaatattgggcaatgggcgaaagcctgacccagcaacgccgcgtgagggaagaaggtcttcgggttgtaaacctctgtcctaagtgaaaaggaaggatggtagcttaggaggaagccccgg

SEQ ID NO: 1004 - DNA, 490 bp, Unknown
  Ascusbbf_9749, encodes 16S rRNA
agagtttgatcatggctcaggacgaacgctggcggcatgcctaacacatgcaagtcgaacggagttattgagagcttgctcttaataacttagtggcggacgggtgagtaacgcgtgagcaacctgcctttcagtggggaataatactttgaaaagagtactaataccgcatgaagtatattgaccgcatgatcgatataccaaagatttatcgctgagagatgggctcgcgtccgattagctagttggtggggtaacggcccaccaaggcgacgatcggtagccggactgagaggttgaacggccacattgggactgagacacggcccagactcctacgggaggcagcagtgggggatattgcgcaatgggggaaaccctgacgcagcaatgccgcgtgaaggattgaaggtcttcggattgtaaacttcttttgtcagggacgaacaatgacggtacctgacgaataagctccggctaactacgtgcc

SEQ ID NO: 1005 - DNA, 490 bp, Unknown
  Ascusbbf_42129, encodes 16S rRNA
agagtttgatcctggctcagagttaacgctggcatcgtgcataacacatgcaagtcgaacgggactttgctttgtagcaatacagagtaaagtttagtggcagacgggtgagtaatgtataaggaacctaccttcgagtggggaataacagtccgaaaggattgctaataccccataacataacctagtggcatcacttagttatcaaagatttatcgcttgaagatggtcttatattctatcagctagttggcagtgtaacggactaccaaggctacgacggatagccggcctgaaagggcgaccggccacaagggcactgagacacgggccctactcctacgggaggcagcagtggggaattttggacaatgggcgaaagcctgatccagcaacgatgcgtggaggacgaaggttctcggattgtaaactccttttgtgagggaagaaaaaaatgacggtacctcacgaataagccacggctaactac

SEQ ID NO: 1006 - DNA, 490 bp, Unknown
  Ascusbbf_4121, encodes 16S rRNA
agagtttgatcatggctcaggacgaacgctggcggcgtgcttaacacatgcaagtcgaacggagttaagcgctgaaatgatgctagcttgctagtggattttcttgcttaacttagtggcggacgggtgagtaacgcgtgagtaacctgcctctcagtggggaataacgccctgaaaagagcgctaataccgcataatatatttttgccgcatgacaggaatatcaaagatttatcgctgagagatggactcgcgtccgattagctagttggcggggtaacggcccaccaaggcgacgatcggtagccggactgagaggttgaacggccacattgggactgagacacggcccagactcctacgggaggcagcagtgggggatattgcgcaatgggggaaaccctgacgcagcaacgccgcgtggaggatgacggttttcggattgtaaactccttttataagggacgaactaagacggtaccttatgaat

SEQ ID NO: 1007 - DNA, 490 bp, Unknown
  Ascusbbf_25066, encodes 16S rRNA
agagtttgatcatggctcaggattaacgctggcggcgtgcctaacacatgcaagtcgaacggaatatcttcggatatttagtggcgaacgggtgagtaatatacaggtaatgtaccttcgtactgcgaataacaagctgaaaagtttgctaatacggaatagtttccttagagggcatcctttgaggaataaagatttatcgtgcggagatcagcctgtatcctattagttagttggtggggtaatggcctaccaagacgacgatgggtaactggtctgagaggatgagcagtcacattggaactgagaaacggtccaaactcctacgggaggcagcagtgaggaattttgcgcaatgggggaaaccctgacgcagcaacgccgcgtgagtgatgacggccttcgggttgtaaagctctgtcgtgtatgacgagtagggacggtaatacacaaggaagcctcggctaactacgtgccagcagccgcggta

SEQ ID NO: 1008 - DNA, 490 bp, Unknown
  Ascusbbf_1324844, encodes 16S rRNA
agagtttgatcctggctcaggacgaacgctggcggcgtgcttaacacatgcaagtcgaacgaagctcccaaagcaagacttcggtcaagtggagggaagacttagtggcggacgggtgagtaacgcgtgagcaacctgcccttcagagggggacaacagttggaaacgactgctaataccgcataacatagggagatggcatcatttctctatcaaagaaatatcgctgaaggatgggctcgcgtctgattagctggttggtggggtaaaggcctaccatggcgatgctcagtagccggagtgggaggttgaacggcaacattgggactggggtacggcccagactccgacgggaggcagcagtggggaatattgggcaatgggggaaaccctgacccagcaacgccgcgtgaaggaagaaggctttcgggttgtaaacttcttttatctgggacgaaggaagtgacggtaccagatgaataagccacag

SEQ ID NO: 1009 - DNA, 490 bp, Unknown
  Ascusbbf_947, encodes 16S rRNA
agagtttgatcctggctcaggacgaacgctggcggcgtgcctaacacatgcaagtcgaacgagaatttagcggatgattccttcgggatgaatttgctgaaggaaagtggcggacgggcgagtaacgcgtgaataacctgcccataagagggggataatccgtggaaacgcggactaataccgcatattgagtgattatcgcatggtttttacttgaaagatttatcgcttatggatggattcgcgtcagattagatagttggtgaggtaacggctcaccaagtcaacgatctgtagccgaactgagaggttgatcggccgcattgggactgagacacggcccagactcctacgggaggcagcagtggggaatattgcgcaatgggggaaaccctgacgcagcaacgccgcgtgcaggaagaaggtcttcggattgtaaactgttgtcgcaagggaagaagaaagtgacggtaccttgtgagaaagtcac

SEQ ID NO: 1010 - DNA, 490 bp, Unknown
  Ascusbbf_1682, encodes 16S rRNA
agagtttgatcatggctcaggacgaacgctggcggcgtgcctaatacatgcaagtcgagcgagtcccttcgggggctagcggcggacgggtgagtaacacgtaggcaacctgcctctcagaccgggataacatagggaaacttatgctaataccggataggtttttggatcgcatgatccgaaaagaaaagatggcttcggctatcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgtcagggacgaacaagtaccgttcgaacagggcggtaccttgacggtacctgacgagaaagcc

SEQ ID NO: 1011 - DNA, 490 bp, Unknown
  Ascusbbf_5102, encodes 16S rRNA
agagtttgatcatggctcaggatgaacgctagctacaggcctaacacatgcaagtcgaggggcagcatggagcttgcttgcaagctctgatggcgaccggcgaatgggtgagtcacgcgtgtccaacctgccccgcgcccggggatagcccttggaaatgaggattaagacccgatacgtgcgttgtccgcatggacgtcgcatgaaaccaggcacgggatggggacgcgtcggattagcttgacggcggggcaacggcccaccgtggcgacgatccgcaggggttctgagaggaaggtcccccacactggcactgagacacgggccagactcctacgggaggcagcagtgaggaatattggtcaatggccgagaggctgaaccagccaagtagcgtgcaggatgacggccctacgggttgtaaactgcttttgcgggaggataaagtgcgccacgcgctggcgctttgcaggtatcccgtgaataagga

SEQ ID NO: 1012 - DNA, 490 bp, Unknown
  Ascusbbf_12142, encodes 16S rRNA
agagtttgatcctggctcaggatgaacgctggcggcgtgcttaacacatgcaagtcgaacgaagcgccggaccttcgggaccggcgactgagtggcggacgggtgagtaacgcgtgggtaacctgccctgtacagggggataacagttagaaatgactgctaataccgcataagcatacgaggaggcatctccttgtgtgaaaaactccggtggtacaggatgggcccgcgtctgattagcttgttggcagggtaagggcctaccaaggcgacgatcagtagccggtctgagaggatgaacggccacattggaactgagacacggtccaaactcctacgggaggcagcagtggggaatattgcacaatgggggaaaccctgatgcagcaacgccgcgtgagtgatgaagtatttcggtatgtaaagctctatcagcagggaagatgatgacggtacctgactaagaagctccggctaaatacgtgccagc

SEQ ID NO: 1013 - DNA, 490 bp, Unknown
  Ascusbbf_19164, encodes 16S rRNA
agagtttgatcctggctcaggatgaacgctagctacaggcttaacacatgcaagtcgaggggcagcgggaagtttgcttgcaagcttcgccggcgaccggcgcacgggtgagtaacgcgtatccaacctgccccacggtcggggacagcccggcgaaagtcggattaacccccgatggtcccgcaagacggcatcagattgcgggtaaaggcttgtccgccgtgggatggggatgcgtaggattaggcagcaggcggggtgacggcccacctggccggcgatccttaggggttctgagaggaaggtcccccacactggtactgagacacggaccagactcctacgggaggcagcagtgaggaatattggtcaatgggcggaagcctgaaccagccaagtagcgtgcaggatgacggccctacgggttgtaaactgcttttatgcggggataaagtgcgccacgtgtggcgttttgcaggtaccgcatgaa

SEQ ID NO: 1014 - DNA, 490 bp, Unknown
  Ascusbbf_8544, encodes 16S rRNA
agagtttgatcatggctcagaacgaacgctggcggcatggattaggcatgcaagtcgaacgaggtagcaataccgagtggcggaagggtgaggaacgcgtgagtaatctgccccctagttgggaataacagttggaaacgactgctaataccgaatgtggcttttgggtcgcatgacctgaaggctaaagatttatcgctaggggatgagctcgcgtcccattagctagttggtgaggcaacggctcaccaaggcgacgatgggtagctggtctgagaggatggtcagccacactgggactgagacactgcccagactcctacgggaggctgcagtcgagaatcttgggcaatgcgcgaaagcgtgacccagcaatgccgcgtgcgggatgaaggtcttcggattgtaaaccgctgtcaaccgggacgaacacaatgactgtaccggtgaaggaagccacggctaactacgtgccagcagccgcggtaat

SEQ ID NO: 1015 - DNA, 490 bp, Unknown
  Ascusbbf_15359, encodes 16S rRNA
agagtttgatcctggctcaggatgaacgctggcggcgtgcttaacacatgcaagtcgagcgagaaacttacagatgacgcttcggttgattcagtaagcggaaagcggcggacgggtgagtaacgcgtaggcaacctgcccctggcagagggatagcatcgggaaactgatattaagacctcataacgcatccacatcacatgatgaggatgccaaagatttatcggcaagggatgggcctgcgtctgattagttagttggtgaggtaacggctcaccaaggcagcgatcagtagccgacctgagagggtgatcggccacattggaactgagacacggtccagactcctacgggaggcagcagtggggaatattgcacaatgggggaaaccctgatgcagcaacgccgcgtgagcgatgaaggcctttgggtcgtaaagctctgtccttggggaagaaaaaaatgacggtacccttggaggaagccccgg

SEQ ID NO: 1016 - DNA, 490 bp, Unknown
  Ascusbbf_224884, encodes 16S rRNA
agagtttgatcctggctcaggacgaacgctggcggcgtgcttcatacatgcaagtcgaacgagaaactaacttcggttagtggaaagtggcggacgggtgagtaatgtgtagagaatctgccttcaagcgggggatagccactggaaacggtgattaataccccatatgagcgtagctgaaatgctattcttgaaaactccggtgcttggagatgagtctgcatctgattagctagttgggggtgtaatggaccaccaaggcgacgatcagtagctggtttgagaggatgatcagccacaatgggactgagacacggaccatactcctacgggaggcagcagtagggaattttgcgcaatgggggaaaccctgacgcagcaacgccgcgtgatcgagacgcttttcggagtgtaaagatctgtcagtggggacgaataatgacggtacccacagaggaagcaccggctaactccgtgccagcagccgcgg

SEQ ID NO: 1017 - DNA, 490 bp, Unknown
  Ascusbbf_15621, encodes 16S rRNA
agagtttgatcatggctcagattgaacgctggcggcatgccttacacatgcaagtcgaacggtaacaggggcttcggcccgctgacgagtggcggacgggtgagtaatacatcggaatgtacccagtagtgggggatagctcggcgaaagccggattaataccgcatacgcactgtggtggaaagcgggggaccttcgggcctcgtgctattggagcagccgatgtcagattagctagttggtggggtaaaagcctaccaaggcgacgatctgtaactggtctgagaggacgaccagtcacactgggactgagacacggcccagactcctacgggaggcagcagtggggaattttggacaatgggcgcaagcctgatccagcaatgccgcgtgtgtgacgaaggccttcgggttgtaaagcacttttgttcgggaagaaatctgtcgggataatacctcgacgggatgacggtaccggaagaataagcac

SEQ ID NO: 1018 - DNA, 490 bp, Unknown
  Ascusbbf_12194, encodes 16S rRNA
agagtttgatcatggctcaggacgaacgctggcggcatgcttaacacatgcaagtcgaacgggcatatttggctatagcgatatagttggatatgtttagtggcgaacgggtgagtaacgcgtgagcaacctgccgtatacactgggataacagaccgaaaggactgctaataccggataagaccacgagaggggcatcccttgggggtcaaagtgatttagcggtatacgatgggctcgcgtcctattaggtagttggtgagataacagcccaccaagcctatgataggtagccgacttgagagagtgatcggccacaatggaactgagacacggtccatactcctacgggaggcagcagtggggaatattgggcaatgggcgaaagccttacccagcaatgccgcgtgaatgatgaaggtcttcggattgtaaatttcttttattggtgacgaacacaatgacggtagccgatgaataagccccggct

SEQ ID NO: 1019 - DNA, 490 bp, Unknown
  Ascusbbf_85994, encodes 16S rRNA
agagtttgatcctggctcaggacgaacgctggcggcgtgcctaacacatgcaagtcgaacggagttatgtcacgaagttcttcggagcggacgatatagcttagtggcggacgggtgagtaacgcgtgagcaacctgcctttcagagggggacaacggttggaaacgaccgctaataccgcatgaaatgactggatcgcatgatccggtcatcaaagattttatcgctgaaagatgggctcgcgtctgattagatagttggtggggtaacggcccaccaagtcgacgatcagtagccggactgagaggttgaacggccacattgggactgagatacggcccagactcctacgggaggcagcagtggggaatattgggcaatgggggcaaccctgacccagcaacgccgcgtgaaggaagaaggctttcgggttgtaaacttcttttaccgaggacgaagaacgtgacggtactcggagaaaaagccacgg

SEQ ID NO: 1020 - DNA, 490 bp, Unknown
  Ascusbbf_106840, encodes 16S rRNA
agagtttgatcatggctcaggattaacgctggcggcgtgcctaatacatgcaagtcgaatggtagcaataccatggcgaacgggtgagtaacacgtaggtaacctgtctttaagacgaggataaccgttggaaacgacggataatactcgataggtgattttagggcatcctagaatcattaaagatttatcacttagagaggggcctgcggcgcattagctagatggcggagtaatagcccaccatggcgatgatgcgtagccggactgagaggttgaacggccacaatggaactgagaacggtccatactcctacgggaggcagcagtagggaattttcggcaatgggcgaaagcctgaccgagcaacgccgcgtgaacgaagaagtatttcggtatgtaaagttcttttattggggaagaaaaatatccaaattgacggtacccaatgaataagctccggctaactacgtgccagcagccgcggtaa

SEQ ID NO: 1021 - DNA, 490 bp, Unknown
  Ascusbbf_24125, encodes 16S rRNA
agagtttgatcatggctcaggacgaacgctggcggcatgcctaatacatgcaagtcgaacgagctgacagagtgcttgcactctcgacgcgagtggcggacgggtgagtaacacgtgggaaacctacctgtaagtatgggataacattcggaaacggatgctaataccatatagattttagttccgcatggaactaaaagaaaagacggctttgctgtcgcttacagatggtcccgcggcgcattagctagttggtgggataaaagctcaccaaggccatgatgcgtagccgacctgagagggtaaccggccacactgggactgagacacggcccagactcctacgggaggcagcagtagggaatcttccgcaatggacgaaagtctgacggagcaatgccgcgtgaatgaagaaggtcttcggatcgtaaaattctgttgttagagaagaacaaggagtaagtaactactactcccttgacggtatcta

SEQ ID NO: 1022 - DNA, 490 bp, Unknown
  Ascusbbf_21126, encodes 16S rRNA
agagtttgatcatggctcaggacgaacgctggcggtatgcctaacacatgcaagtcgaacgggtgaatgaagagcttgctctttatttcattagtggcggacgggtgagtaacgcgtgagtaatctgccttgaagtgggggataacatttggaaacaagtgctaataccgcgtaagatatgttcttcgcatgaagtctgtatcatagtttttcgcttcaagatgagctcgcgtccgattagtttgttggcgaggtaaatgctcaccaagactgcgatcggtagccgggttgagagactgaacggccacattgggactgagacacggcccagactcctacgggaggcagcagtggggaatattgcacaatgggggaaaccctgatgcagcaataccgcgtgagggatgaaggctctagggttgtaaacctctgtccaaagggacgaattttgacggtacctttgaaggaagctccggctaactacgtgcca

SEQ ID NO: 1023 - DNA, 490 bp, Unknown
  Ascusbbf_31123, encodes 16S rRNA
agagtttgatcctggctcaggacgaacgctggcggcgtgcttaacacatgcaagtcgaacggacgatttcccttcggggagaaagttagtggcggacgggtgagtaacgcgtgagtaacctgccttggaatgggggataacacagggaaacctgtgctaataccgcataacatcacgatggggcatcccaatgtgatcaaagatttattgttccaagatgggctcgcgtccgattagatagttggtgaggtaacggcccaccaagtcgacgatcggtagccggactgagaggttggccggccacattgggactgagatacggcccagactcctacgggaggcagcagtgaggaatattaggcaatgggggaaaccctgacctagcgacgccgcgtgaaggatgaaggttttcggattgtaaacttcttttatgagggacgatagtgacggtacctcatgaataagccacggctaactacgtgccagcagc

SEQ ID NO: 1024 - DNA, 490 bp, Unknown
  Ascusbbf_16263, encodes 16S rRNA
agagtttgatcatggctcagattgaacgctggcggcaggcctaacacatgcaagtcgagcgcgaaagttcttcggaatgagtagagcggcggacgggtgagtaacgcgtgggaatctacccagtagtgggggacaacgtctcgaaagggacgctaataccgcatacgccctacgggggaaagggggggatcttcggacctctcgctattggatgagcctgcgtcggattagctagttggtggggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggttgtaaagcactttcagtggggagaaaggctgtttacttaatacgtaagcagattgatgttacccacagaagaagcaccgg

SEQ ID NO: 1025 - DNA, 490 bp, Unknown
  Ascusbbf_58276, encodes 16S rRNA
agagtttgatcctggctcagattgaacgctggcggcaggcctaacacatgcaagtcgagcgcgaaaggtcttcggactgagtaaagcggcggacgggtgagtaacgcgtgggaatctgcctggtagtgggggacaacagccggaaacggctgctaataccgcatacgccctatgggggaaagcgggggatctttcgagacctcgtgctatcagatgagcccgcgtcggattagctagtaggtgaggtaaaggctcacctaggcgacgatccgtagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttaagttgggaggaaggcctaaaggttaataccctttaggattgacgttaccaacagaataagcacc

SEQ ID NO: 1026 - DNA, 490 bp, Unknown
  Ascusbbf_130629, encodes 16S rRNA
agagtttgatcatggctcaggatcaacgctggcggcgtgcctaatgcatgcaagtcgaacggggcttccttcgggaggttcacgtggcggacgggtgaggaacacgtgggcgacctaccctggggcgggggatacccgcgagaaatcgtggataattccgcatacgctcgctctgcggttggcagggtgaggaaaggtgcatttcggtgcgccacccttggcggggcctgcggccgattagctagttgggggggtaacggcctcccaaggcgatgatcggtagctggtctgagaggacggccagccacacggggactgagacacggccccgactcctacgggaggcagcagcaaggaatcttccgcaatgggcgaaagcctgacggagcaacgccgcgtgcgggatgacgcctttcggggtgtaaaccgcttttctgggggaagaagatcatcgcaagatggtttgacggtaccgcaggaagaaggaccg

SEQ ID NO: 1027 - DNA, 490 bp, Unknown
  Ascusbbf_141355, encodes 16S rRNA
agagtttgatcctggctcaggatgaacgctggcggcgtgcttaacacatgcaagtcgaacggacatgtaacaccgctgctgatttagcttgctattgacgcagcaccgttgcatgttagtggcggacgggtgagtaacgcgtgggtaacctgcctttatccgggggataacagttagaaatgactgctaataccgcataagcgcacgagggggcatccttttgtgtgaaaaactccggtggatagagatggacccgcgttagattagccagttggcggggtaacggcccaccaaagcgacgatctatagccggcctgagagggcgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaagatgacggtacctgcaca

SEQ ID NO: 1028 - DNA, 490 bp, Unknown
  Ascusbbf_71145, encodes 16S rRNA
agagtttgatcctggctcaggatgaacgctagcggcaggcttaacacatgcaagtcgaggggcagcaggctgtagcaatacggtgctggcgaccggcgcaagggtgcgtaacgcgtgagcaatctgcccgtatcagggggataagcgatggaaacgtcgtctaataccgcataacaccgttcgtggcatcacggatggttgaaagcttcggtggatacggatgagctcgcgagacattagttagttggcggggtaacggcccaccaagaccgcgatgtctaggggaactgagaggttggtcccccacactggaactgagacacggtccagactcctacgggaggcagcagtgaggaatattggacaatggagggaactctgatccagccatgccgcgtgcaggaataaggtcctatggattgtaaactgcttttgagagggagcaataaggtgtacgtgtacaccgatgagagtacctttcgaataagca

SEQ ID NO: 1029 - DNA, 490 bp, Unknown
  Ascusbbf_109057, encodes 16S rRNA
agagtttgatcctggctcagattgaacgctggcggcaggcctaacacatgcaagtcgagcggtaacatgggagcttgctcctgatgacgagcggcggacgggtgagtaacgcgcaggaatctacctggtagtgggggatagctcggggaaactcgaattaataccgcatacgtcctacgggagaaagtgggggatcttcggacctcatgctatttgatgagcctgcgtaagattagctagttggtggggtaaaggcctaccaaggcgacgatctttaactggtctgagaggatgatcagtcacaccggaactgagacacggtccggactcctacgggaggcagcagtggggaatattggacaatgggggcaaccctgatccagccatgccgcgtgtgtgaagaaggccttcgggttgtaaagcactttaagttgggaggaaggccttgaggttaatacccttgaggattgacgttaccaacagaataagc

SEQ ID NO: 1030 - DNA, 490 bp, Unknown
  Ascusbbf_142245, encodes 16S rRNA
agagtttgatcctggctcaggacgaacgctggcggcgtgcctaacacatgcaagtcgaacggagcacccttgacagcggcttcggccaatggataggaatgcttagtggcggacgggcgagtaacgcgtgagcaacctgcccttcagagggggataacgttctgaaaagaacgctaataccgcatgatgcatcctggggacatccccgggatgccaaaggagcaatccgctgaaggatgggctcgcgtccaattaggtagttggtgaggtaacggcccaccaagccgacgattggtagccgaactgagaggttgatcggccgcattgggactgagacacggcccagactcctacgggaggcagcagtgggggatattgcgcaatgggggaaaccctgacgcagcaacgccgcgtgaaggaagaaggtcttcggattgtaaacttttgtcttgtgggaagataatgacggtaccacaggaggaagctccgg

SEQ ID NO: 1031 - DNA, 490 bp, Unknown
  Ascusbbf_137045, encodes 16S rRNA
agagtttgatcctggctcaggatgaacgctagcggcgggcctaatacatgcaagtcgaggggcagcggaggtagcaatacttgccggcgaccggcgcacgggtgcgtaacgcgtatgcaacctacccataacacgggaatagcccgaagaaattcggattaatactcgatagtatcacttgatggcatctgaaggtgattaaagatttatcggttatggatgggcatgcgtctgattagctagttggtgaggtaaaggctcaccaaggctacgatcagtaggggttctgagaggatgatcccccacaccggtactgagacacggaccggactcctacgggaggcagcagtaaggaatattggtcaatggacgcaagtctgaaccagccacgccgcgtgcaggatgacggccctatgggttgtaaactgcttttgtttgggaagaaaccccttttgcgaaagggactgacggtaccagacgaataagcacc

SEQ ID NO: 1032 - DNA, 490 bp, Unknown
  Ascusbbf_1621314, encodes 16S rRNA
agagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggcggggtaatggcccacctaggcgacgatccctagctggtctgagaggatgaccagccacactgaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcagtacggttaataaccgtactgattgacgttacccgcagaagaag

SEQ ID NO: 1033 - DNA, 490 bp, Unknown
  Ascusbbf_104898, encodes 16S rRNA
agagtttgatcatggctcaggatgaacgctagcgacaggcctaacacatgcaagtcgaggggtaacaggggcttcggcccgctgacgaccggcgcacgggtgagtaacgcgtatgcaacctacctgtaactgggggatagctccctgaaaggggaattaacaccgcataagaccacgctatcacatggtaaagtggtaaaatatttataggttacagatgggcatgcgtgacattagttagttggcggggtaacggcccaccaagactacgatgtctaggggttctgagaggaaggtcccccacactggtactgagacacggaccagactcctacgggaggcagcagtgaggaatattggtcaatggacgcaagtctgaaccagccatgtcgcgtgcaggaagactgccctatgggttgtaaactgcttttgtacgggaagaaaatcagctacgtgtagttgtttgccggtaccgtacgaataaggatcg

SEQ ID NO: 1034 - DNA, 490 bp, Unknown
  Ascusbbf_143721, encodes 16S rRNA
agagtttgatcctggctcaggatcaacgctggcggcgtgcctaatgcatgcaagtcgaacggggtcgccttcgggcggctcacgtggcggacgggtgaggaacacgtgggcgatctgccccgaggcgggggatagccaccagaaatggtgggtaagaccgcataagctcgctgaactgcggttcagtgaggaaaacctcttcggaggtaccttgggaggagcctgcggcggattagctagttggtggggtaacggcttaccaaggcgatgatccgtagctggtctgagaggatggccagccacaggggaactgagacacggtccccactcctacgggaggcagcagcaaggaattttccgcaatgggcgaaagcctgacggagcaacgccgcgtgggggatgacgcttttcggagtgtaaaccccttttctcagggaagaaaaaaatgacggtacctgaggaataaggaccggctaactacgtgccagca

SEQ ID NO: 1035 - DNA, 490 bp, Unknown
  Ascusbbf_85972, encodes 16S rRNA
agagtttgatcctggctcaggatgaacgctggcggtgtgcctaatacatgcaagtcgagcggggatcttcggatcctagcggcgaacgggtgagtaacacgttggtaatctaccttctagttggggatacccaggcgaaagcttggctaataccgtaatacgtattaagttgaaatacttaatataaaaggcccttcggggtcgctagtagatgagcctgcgtctgattagctagttggtgagataatagcccaccaaggcgaggatcagtagccgacctgagagggtgatcggccacaatggaactgagacacggtccatactcctacgggaggcagcagtagggagtcttcgacaatgggggaaaccctgatcgagcaacaccgcgtgaatgatgaaggtcttcggattgtaaagttcttttatttgggagaaattgtaagggtaggtaatgacctttacttgatagtaccatttgaataagcaacga

SEQ ID NO: 1036 - DNA, 490 bp, Unknown
  Ascusbbf_268429, encodes 16S rRNA
agagtttgatcatggctcaggacgaacgctggcggcgtgcttaacacatgcaagttgaacggtctgacatggaagcttgctgaagtgtcgggtagtagcggacgggtgagtaatgcatgagaagctgccattgggagggggacaacagttggaaacggctgctaataccccatatgccgaaaggtgaaagggagcgatccgcccgatgaggtgctcatgtcctatcagctggttggtgaggtaacggctcaccaaggcgacgacgggtagccggcctgagagggtgaccggccacactggaactgagatacggtccagactcctacgggaggcagcagtggggaatattgggcaatgggggcaaccctgacccagcgacgccgcgtgagggaagacggccttcgggttgtaaacctcttttgtacgggaagaaggacgtgacggtaccgtacgaataagtcccggctaactacgtgccagcagccgcggt

SEQ ID NO: 1037 - DNA, 490 bp, Unknown
  Ascusbbf_225345, encodes 16S rRNA
agagtttgatcatggctcaggatgaacgctagcgataggcctaacacatgcaagtcgaggggcagcacatgagtagcaatacgatggtggcgaccggcgcacgggtgagtaacacgtatgcaacctacctttaacaggggaataacccgttgaaaaacggactaatactccatgacacaggggtcccgcatgggaatatttgttaaagatttatcggttgaagatgggcatgcgttccattagcttgttggtgaggtaacggctcaccaaggctacgatggataggggaactgagaggtttatcccccacactggaactgagacacggtccagactcctacgggaggcagcagtgaggaatattggtcaatggaggcaactctgaaccagccaagtcgcgtgaaggatgaaggtcttatggattgtaaacttcttttgcaagggaataaagtgggggacgtgtcctcctttgcatgtaccttgcgaataa

SEQ ID NO: 1038 - DNA, 490 bp, Unknown
  Ascusbbf_257714, encodes 16S rRNA
agagtttgatcatggctcaggacgaacgctggcggtgtgcttaacacatgcaagtggtgcgacgaaccagacttcggtctggggcaaagccgcgaacgggtgagtaacacgtgggtaatctaccccgatgaccgggacaacccgaggaaactcgggctaataccggatgtggtacgcagacataagtctgcttactaaaggtagcttcggcttccgcattgggaggggcccgcggcccattagcttgttggtggggtcaaggcctaccaaggcaacgatgggtagctggtctgagaggacgatcagccacactgggactgagacacggcccagactcctacgggaggcagcagtggggaatcttgcgcaatgcgcgaaagcgtgacgcagcaacaccgcgtgagggaagacggccttagggttgtaaacctctttcagatgggacgaaggtcatccggtgaatagccgagatgattgacggtaccgtcag

SEQ ID NO: 1039 - DNA, 490 bp, Unknown
  Ascusbbf_260477, encodes 16S rRNA
agagtttgatcatggctcaggatgaacgctagcggcaggcttaacacatgcaagtcgaggggtagaaatagcttgctattttgagaccggcgcacgggtgcgtaacgcgtatgcaatctgccttgtactgggggatagcccggagaaatccggattaataccccatagtattttagagtggcatcactttattattaaagatttatcggtacaagatgagcatgcgtcccattagttagttggtgtggtaacggcacaccaagacgatgatgggtaggggtcctgagagggagatcccccacactggtactgagacacggaccagactcctacgggaggcagcagtgaggaatattggtcaatggacgcaagtctgaaccagccatgccgcgtgcaggatgacggtcctatggattgtaaactgcttttatatgggaagaaaccccttttcgtgaagagggctgacggtaccataagaataaggatcggc

SEQ ID NO: 1040 - DNA, 490 bp, Unknown
  Ascusbbf_1766429, encodes 16S rRNA
agagtttgatcctggctcaggatgaacgctggcggcgcgcctaacacatgcaagtcgaacgagcgagagagagcttgctttctcgagcgagtggcgaacgggtgagtaacgcgtgaggaacctgcctcaaagagggggacaacagttggaaacgactgctaataccgcataagcccacggctcggcatcgagcagagggaaaaggagcaatccgctttgagatggcctcgcgtccgattagctagttggtgaggtaacggcccaccaaggcgacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgttgttggggaagataatgacggtacccaacaaggaagtgacggctaactacgtgccag

SEQ ID NO: 1041 - DNA, 470 bp, Unknown
  Ascusbbf_145360, encodes 16S rRNA
agagtttgatcctggctcagaacgaacgctggcggcaggcttaacacatgcaagtcgaacgagaccttcgggtctagtggcgcacgggtgagtaacgcgtgggaatctaccttggagtctgggataacagttggaaacgactgctaataccggatacgccctgtgggggaaaggtttactgctccaagatgagcccgcgtccaattaggtagttggtggggtaaaggcctaccaagccgacgattggtagctggtctgagaggatggccagccacactgggactgagacacggcccagactcctacgggaggcagcagtggggaatattggacaatgggggcaaccctgatccagccatgccgcgtgagtgatgaaggccttagggttgtaaagctctttcgccggtgacgatgatgacggtaaccggagaagaagccccggctaacttcgtgccagcagccgcggtaat

SEQ ID NO: 1042 - DNA, 490 bp, Unknown
  Ascusbbf_566978, encodes 16S rRNA
agagtttgatcatggctcaggacgaacgctggcggcgtgcttaacacatgcaagtcgagcggtaaggcccttcggggtacacgagcggcgaacgggtgagtaacacgtgggcgacctgccctcagctctgggataagcctgggaaactgggtctaataccggataggacttggcctcgcatggggttgggtggaaagtttttcggctggggatgggcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgacgcagcgacgccgcgtgggggatgacggccttcgggttgtaaacctctttcgccatcgacgaagcctttgggtgacggtaggtggagaagaagcaccggccaactacgtgccagcag

SEQ ID NO: 1043 - DNA, 490 bp, Unknown
  Ascusbbf_1110058, encodes 16S rRNA
agagtttgatcatggctcagaacgaacgctggcggcgcgtcttaagcatgcaagtcgagcgggaatgtggtgcttgcaccacaggagagcggcggactggtgagtaacgcgtggatgacgcacccccctgacggggacagcctgcagaaatgcagggtgataccggatacgatcttgggtattggaagcccgggaggaaagcacctgcgggtgcgcagggggagcggtccgcggcccatcagcttgttggcggggtaaaggcccaccaaggcgacgacgggtacccggcctgagagggcggacaggcacattgggactgagatacggcccagactcctacgggaggcagcagctaagaatattccgcaatggggggaaccctgacggagcgacgccgcgtggacgatgaaggccggaaggttgtaaagtcctttttggaccgaggaagagccggtggagggaatgccaccggggtgactgtaggtctgga

SEQ ID NO: 1044 - DNA, 490 bp, Unknown
  Ascusbbf_1000190, encodes 16S rRNA
agagtttgatcctggctcaggacgaacgctggcggcgtgcttaacacatgcaagtcgagcggaaaggccctgattccttttggatgttgggtactcgagcggcgaacgggtgagtaacacgtgagtaatctgcccttcactttgggataagccttggaaacggggtctaataccggatatgacgcatccctgcatggggtgtgtgtggaaagccttcgggcggtgggggatgtgctcgcggcctatcagcttgttggtggggtaatggcctaccaaggctttgacgggtagccggcctgagagggtgaccggtcacactgggactgagacacggcccagactcctacgggaggcagcagtggggaatattggacaatgggcggaagcctgatccagcaacgccgcgtgggggatgaaggccttcgggttgtaaacctctttcagtaccgacgaagcttttgtgacggtaggtacagaagaagcaccggcc

SEQ ID NO: 1045 - DNA, 490 bp, Unknown
  Ascusbbf_257676, encodes 16S rRNA
agagtttgatcatggctcagagtgaacgctagcggcgtggctcagacatgcaagtcgagcggtgaagtccttcgggatggatcagcggcaaacgggtgagtaacacgtgagcaacctaccctcaagtatgggatagcctgtcgaaagacggattaataccgtatgtggtcttttttcgcatgagagaagtactaaagtcggggaccttcgggcctgacgtttgaggatgggctcgcggcctatcagctagttggcggggtaacggcccaccaaggcaaagacgggtaactgttctgagaggatgatcagtcacactggaactgagacacggtccagacacctacgggtggcagcagtttcgaatcattggcaatgggcgcaagcctgaccatgcgacgccgcgtgggggatgaaggtcttcggatcgtaaacccctgtcatcaaggactaacctctgtatatctaatatatatacagactgaattaactt

SEQ ID NO: 1046 - DNA, 490 bp, Unknown
  Ascusbbf_559955, encodes 16S rRNA
agagtttgatcctggctcagattgaacgctggcggcaggcctaacacatgcaagtcgagcgcgaaagttcttcgggatgagtaaagcggcggacgggtgagtaacgcgtgggaatctgcctggtaatgggggacaacatctcgaaagggatgctaataccgcatacgccctaagggggaaagtgggggatcttcggacctcacgttatcagatgagcccgcgtcggattagctagtaggtagggtaaaggcctacctaggcgacgatccgtaactggtctgagaggatgatcagtcacactggaactgagacacggtccagactcctacgggaggcagcagtggggaatattggacaatgggggcaaccctgatccagccatgccgcgtgtgtgaagaaggccttcgggttgtaaagcactttaagttgggaggaaggctatttggtgaatacccaagtagattgacgttaccaacagaataagcaccgg

SEQ ID NO: 1047 - DNA, 490 bp, Unknown
  Ascusbbf_641654, encodes 16S rRNA
agagtttgatcctggctcagattgaacgctggcggcatgcctaacacatgcaagtcgaacggcagcgcgggcttcggcctggcggcgagtggcggacgggtgaggaatgcataggaatctgccctgatgtgggggataacgtagggaaacttacgctaataccgcatgagaccttacgcttggcggcgtatggtgaaagtgggggaccttcgggcctcacgcatttggatgagcctatgccggattagcttgttggtggggtaaaggcctaccaaggcgacgatccgtagctggtctgagaggatgatcagccacactgggactgagacacggcccagactcctacgggaggcagcagtggggaatattggacaatgggcgcaagcctgatccagcaatgccgcgtgtgtgaagaaggccttcgggttgtaaagcacttttgtccgggaagaaaaccttgggattaatactttcgaggaatgacggtacc

SEQ ID NO: 1048 - DNA, 490 bp, Unknown
  Ascusbbf_1566194, encodes 16S rRNA
agagtttgatcctggctcaggacgaacgctggcggtgtgcttaacacatgcaagtcgagcggtaaggccctttcgggggtacacgagcggcgaacgggtgagtaacacgtgagtaacctgcccttcacttggggataactcccggaaacgggggctaataccggatgttcactgtctcgcgcatgcggggtggtggaaagttttttcggtgagggatgggctcgcggcctatcagcttgttggtggggtgatggcctaccaaggcttcgacgggtagccggcctgagagggtgaccggccacactgggactgagacacggcccagactcctacgggaggcagcagtggggaatattggacaatgggcgcaagcctgatccagcaacaccgcgtgagggatgacggccttcgggttgtaaacctctttcagttccgacgaagccttgacctgtggggttggggtgacggtagggacagaagaagcaccggc

SEQ ID NO: 1049 - DNA, 490 bp, Unknown
  Ascusbbf_422941, encodes 16S rRNA
agagtttgatcctggctcaggatgaacgctggcggcgtgcctaacacatgcaagtcgagcggagtttattgaagaagtcttaggatggaaataataaacttagcggcggacgggtgagtaacacgtgagtaacctgcctttagctggggaataacactgggaaaccagtgctaataccgcataacatctagttgtggcatcacaattagatcaaaggaatttattccggcaaaagatggactcgcgtccgattagatagttggtagggtaatggcctaccaagtcaacgatcggtagccggactgagaggttgaccggccacattgggactgagacacggcccagactcctacgggaggcagcagtggggaatattgggcaatgggggaaaccctgacccagcaacgccgcgtgaaggaaaggtcttcggattgtaaacttctttgatcagggacgaagaaatgactgtacctgaagaacaagtcacggc

SEQ ID NO: 1050 - DNA, 490 bp, Unknown
  Ascusbbf_386203, encodes 16S rRNA
agagtttgatcctggctcaggatgaacgctagcggcaggcctaacacatgcaagtcgaacggcagcggcacttcggtggccggcgagtggcggatgggtgagtaacgcgtatgcaacctacctttcacagtgggatagcccagagaaatttggattaataccgcatagtatgcagggccgtcatcggttttgcattaaacatttatgggtgagagatgggcatgcgttctattagttagttggagtggtaacggcaccccaagaccgcgatagataggggccctgagagggggatcccccacactggtactgagacacggaccagactcctacgggaggcagcagtgaggaatattggacaatgggcgcaagcctgatccagccatgccgcgtgcaggaagacggccctatgggttgtaaactgcttttatacgggaagaaaccccccgacgtgtcggggcttgacggtaccgtatgaataaggatcggc

SEQ ID NO: 1051 - DNA, 490 bp, Unknown
  Ascusbbf_479487, encodes 16S rRNA
agagtttgatcctggctcaggacgaacgctggcggcgtgcctaatgcatgcaagtcgagcgacgcatgctggagacgtaagtctccggtatgacggagcggcgaacgggtgagtaacacgtgagcaacctgccccgaagaccgggatagcccagggaaacctggattaataccggataccctcggatgtcctcctggacgaccgaggaaatgcttttgtgcttcgggatgggctcgcggcctatcagcttgttggtggggtaacggcctaccaaggcgtcgacgggtagctggtctgagaggacgatcagccacactgggactgagacacggcccagactcctacgggaggcagcagcagggaatcttgcgcaatgggcgaaagcctgacgcagcaacgccgcgtgggggatgaaggccttcgggttgtaaacccctttcaggagggaagaaattgacggtacctccaaaagaagccccggccaactacg

SEQ ID NO: 1052 - DNA, 470 bp, Unknown
  Ascusbbf_1810241, encodes 16S rRNA
agagtttgatcatggctcagattgaacgctggcggcatggttaaaacatgcaagtcgaacgatcccttcggggagagtggcgaaagggcgaggaatataatcgaatgtaccccaaggtggaggatagcttctggaaacggaagataatactccatgtgctctacggaggaaaggtttaccgccttgggagcggcgattatcctatcaggtagttggtgaggtaaaggctcaccaagccgaagacgggtagcgggtgtgagagcatgacccgccgcatcgggactgagacactgcccggactcctacgggaggctgcagtaacgaatcttccgcaatgggcgaaagcctgacggagcaatgccgcgtgtgggatgaagcatcttcgatgtgtaaaccactgtcaagatctaggaatactgaccagatctaaaggaagggccggctaattccgtgccagcagccgcggtaat

SEQ ID NO: 1053 - DNA, 490 bp, Unknown
  Ascusbbf_1723370, encodes 16S rRNA
agagttgatcatggctcaggacgaacgctggcggcgggcttaacacatgcaagtcgcgggagagccggaccttcgggtccggggagaccggcggatgggtgagtaaagcgtaggtaatctaccgtaaggacggggataacatcgcgaaagcggtgctaataccggatgatgcagcggggccgcatggccacagttgttaaatctgccttagggcgggccttatgatgaacctgcgtgccattagttagttggtagggtaacggcctaccaagacgatgatggctagggggtctgagaggatgatcccccacactgggactgagacacggcccagactcctacgggaggcagcagtgaggaatcttgcgcaatgggggcaaccctgacgcagccacgccgcgtgctggaagacggccctatgggttgtaaacagcttttggtcgggaagaacctggggatttcgatccccactgacggtaccgattgaata

SEQ ID NO: 1054 - DNA, 490 bp, Unknown
  Ascusbbf_718517, encodes 16S rRNA
agagtttgatcatggctcaggatgaacgctggcggcgtgcctaacacatgcaagtcgaacggaccttttattgttggagattcgtcaaagacgatttaaggttagtggcggacgggtgagtaacgcgtgggtaacctgcctcatagagggggataacagtttgaaaagactgctaataccgcataagcccacaggaccgcatggtccagggggaaaagattcatcgctatgagatggacccgcgtctgattagttagttggcggtgtaacggaccaccaagacgacgatcagtagccggactgagaggttgaacggccacattgggactgagacacggcccaaactcctacgggaggcagcagtggggaatattgcacaatgggggaaaccctgatgcagcgacgccgcgtgggtgaagaagtttttcggaatgtaaagccctatcagcagggaagaaaatgacggtacctgactaagaagccccggcta

SEQ ID NO: 1055 - DNA, 490 bp, Unknown
  Ascusbbf_1154198, encodes 16S rRNA
agagtttgatcctggctcaggatgaacgctagcggcaggcctaatacatgcaagtcgaacgggatccaggggcaagcttgcttgcttctggtgagagtggcgtacgggtgcgtaacgcgtgagcaacctaccgctgtctgggggatagcccggagaaatccggattaataccgcataacatcagtttacagcattgtttactgatcaaacatttatgggacagcgatgggctcgcgtgacattagctagttggggtggtaacggcacaccaaggcgacgatgtctaggggatctgagaggatgaccccccacactgggactgagacacggcccagactcctacgggaggcagcagtaaggaatattggtcaatggaggcaactctgaaccagccatgccgcgtgcaggaagacggccctctgggttgtaaactgcttttgccggggaataaacccctctacgtgtagagggctgaatgtacccggcgaat

SEQ ID NO: 1056 - DNA, 490 bp, Unknown
  Ascusbbf_571452, encodes 16S rRNA
agagtttgatcatggctcaggatgaacgctggcggcgtgcctaacacatgcaagtcgagcgaagttacttacaggaagccttcgggtggaatggatttaactcagcggcggacgggtgagtaacgcgtgggcaacctaccctgtacaggggaataacaatgggaaaccattgctaataccccataacacctttgaggggcatcccttaaaggtcaaagaatttcggtacaggatgggcccgcgtcgcattagctagttggtgaggtaatggctcaccaaggcgacgatgcgtagccggcctgagagggtgaacggccacactggaactgagacacggtccagactcctacgggaggcagcagtggggaatattgcacaatgggggaaaccctgatgcagcaacgccgcgtgagcgatgaaggctttcgggtcgtaaagctctgtcctaagggaagataatgacggtaccttaggaggaagccccggctaa

SEQ ID NO: 1057 - DNA, 490 bp, Unknown
  Ascusbbf_654877, encodes 16S rRNA
agagtttgatcctggctcagattgaacgctggcggcatggttaaaacatgcaagtcgaacgcgaacggggcttcggcccctagtagagtggcgaaagggcgagtaacgtgtttctaacgtgccccaaggtcagggacagcccagggaaacctggattaatacctgatgaccccatgacgtcgtatggcgatatgggcaaaggcttgctgccttgggttcgggaaacatcctatcagcttgttggtaaggtaacggcttaccaaggcgaagacgggtagcgggtgtgagagcacggcccgccgcatcgggactgagacactgcccggactcctacgggaggctgcagtaacgaatattggacaatgcgcgaaagcgtgatccagcaatgccgcgtgcaggatgaagcccctcggggtgtaaactgctgtcaggagctaccaacacaatgaggagctccagaggaagagccggctaactctgtgccagcagc

SEQ ID NO: 1058 - DNA, 490 bp, Unknown
  Ascusbbf_964026, encodes 16S rRNA
agagtttgatcatggctcaggatgaacgctggcggcgtgcttaacacatgcaagtcgagcggagctcaaatgcggatccccttcgggggtgaaacatctgagcttagcggcggacgggtgcgtaacgcgtgggtaatctgcccttgtcaccgggataacacatcgaaaggtgtgctaataccggatgaaatacagacccggcatcggggctgtatcaaagtcatgcggacaaggatgagcctgcgtctgattagcttgttggtggggtaaaagcctaccaaggcaacgatcagtagccgacctgagagggtgatcggccacactggaactgagacacggtccagactcctacgggaggcagcagtggggaatattgcacaatgggcgcaagcctgatgcagcaacgccgcgtgagtgatgaaggccttcgggtcgtaaaactctgtcctaagggaagataatgacggtaccttaggaggaagccccggct

SEQ ID NO: 1059 - DNA, 490 bp, Unknown
  Ascusbbf_1788606, encodes 16S rRNA
agagtttgatcatggctcagattgaacgctggcggcatgcctaacacatgcaagtcgaacggcagcatggtccagcttgctggactgatggcgagtggcgaacgggtgagtaacgcgtaggaatataccttaaagagggggacaacctggggaaactcaggctaataccgcataagctctaaggagtaaagctggggaccttatggcctggcgctttaagattagcctgcgtccgattagcttgttggtggggtaaaggcctaccaaggcgacgatcggtagctggtctgagaggatggtcagccacactgggactgagacacggcccagactcctacgggaggcagcagtggggaatattggacaatgggggcaaccctgatccagcaatgccgcgtgtgtgaagaaggcctatgggttgtaaagcactttcagtggggaggaggatttagagattaagagtcactaaattggacgttacccacagaag

SEQ ID NO: 1060 - DNA, 490 bp, Unknown
  Ascusbbf_599426, encodes 16S rRNA
agagtttgatcctggctcaggatgaacgctagctacaggcttaacacatgcaagtcgaggggcagcatggcggatgcttgcatctgccgatggcgaccggcgcacgggtgagtaacgcgtatccaacctgccccccaccgtggtataccccggcgaaagccggcctaatcccgcatgcactccgaggatgacatctgacttggaggaaaggtattttttccggtggcggatggggatgcgtctgattagcttgtcggcggggtaacggcccaccgaggcatcgatcagtaggggttctgagaggaaggtcccccacattggaactgagacacggtccaaactcctacgggaggcagcagtgaggaatattggtcaatgggtgcaagcctgaaccagccaagtagcgtgcaggacgacggccctatgggttgtaaactgcttttgtatggggataaagtgctccacgtgtggagttttgtaggtaccatac

SEQ ID NO: 1061 - DNA, 207 bp, Unknown
  Ascusbbf_1526195, encodes 16S rRNA
agagttttatcctggctcaggatgaacgctagctacaggcttattggtcaatggacgcaagtctgaaccagccaagtagcgtgaaggacgacggccctacgggttgtaaacttcttttgtacgggaataaagtgaggcacgcgctgcctttttgcatgtaccgtacgaataagcatcggctaattccgtgccagcagccgcggtaat

SEQ ID NO: 1062 - DNA, 490 bp, Unknown
  Ascusbbf_443, encodes 16S rRNA
agagtttgatcctggctcaggacgaacgctggcggtatgcttaatacatgcaagtcgaacggagctcagcggaagcttgcttctgcgaaagcttagtggcggacgggtgagtaacgcgtgagtaacctgccttaaagagggggataacacagagaaatttgtgctaataccgcataatgcagtacagccgcatgactgaactgccaaaggtcagccgctttaagatggactcgcgtccgattaggtagttggagaggtaacggctcaccaagccgacgatcggtagccggactgagaggtcgaacggccacattgggactgagacacggcccagactcctacgggaggcagcagtagggaatattgcgcaatgggggcaaccctgacgcagcaataccgcgtgaaggatgacggttttcggattgtaaacttcagcaagcagggaagaaaaaaatgacggtacctgaacaaaagccacggctaactacgt

SEQ ID NO: 1063 - DNA, 490 bp, Unknown
  Ascusbbf_14194, encodes 16S rRNA
agagtttgatcctggctcaggatgaacgctagctacaggcttaacacatgcaagtcgaggggcatcaggtactgtgcttgcacagtatgctggcgaccggcgcacgggtgagtaacgcgtatccaaccttcccatgactccggttcagcccgccgaaaggcggattactcccggatggtttccgaagagggcctctgatttggaataaagatttatcggtcatggatggggatgcgtctgattaggcagcaggcggggtaacggcccacctggcctacgatcagtaggggttctgagaggaaggtcccccacactggaactgagacacggtccagactcctacgggaggcagcagtgaggaatattggtcaatggacgagagtctgaaccagccaagtagcgtgcaggatgacggccctatgggttgtaaactgcttttatatgaggataaaggacgtcacgtgtgatgttttgcaggtatcatatgaat

SEQ ID NO: 1064 - DNA, 206 bp, Unknown
  Ascusbbf_4332, encodes 16S rRNA
agagtttgatcctggctcaggatgaacgctagctacaggcttattggtcaatgggcgagagcctgaaccagccaagtagcgtgcgggacgaaggccctatgggttgtaaaccgcttttacggggggataaagtgagtgacgtgtcattcattgcaggtaccccgcgaataaggaccggctaattccgtgccagcagccgcggtaat

SEQ ID NO: 1065 - DNA, 490 bp, Unknown
  Ascusbbf_62013, encodes 16S rRNA
agagtttgatcatggctcagaacgaacgctggcggcgcgtcttaagcatgcaagtcgagcgggattaagggagcttgcttccttatgagagcggcggactggtgagtaacacgtgggtgatgcaccctcctgacggggacagcctgtggaaacacagggtaataccggatgagaccggttcattagaggggactggtgaaaggagctacggctccgcagggggagcggcccgcggcccatcagctggatggcggtgtaacggaccaccatggcagtgacgggtatccggcctgagagggtgagcggacacattgggactgagatacggcccagactcctacgggaggcagcagctaagaatattccgcaatggggggaaccctgacggagcgacgccgcgtggacgatgaaggccggaaggttgtaaagtccttttaatggcgaggaataagcgcaggagggaatgcctgcgtggtgacggtagccattg

SEQ ID NO: 1066 - DNA, 490 bp, Unknown
  Ascusbbf_41916, encodes 16S rRNA
agagtttgatcatggctcaggacgaacgctggcggcgtgcctaacacatgcaagtcgaacgaagcactggggaaagagacttcggtcaattgaacctttgacttagtggcggacgggtgagtaacacgtgagcaacctgcctttcagagggggacaacagctggaaacggctgctaataccgcataaagtattcggggggcatcccttggataccaaagatttatcgctgaaagatgggctcgcgtctgattagatagttggtgaggtaacggctcaccaagtcgacgatcagtagccggactgagaggttgaacggccacattgggactgagatacggcccagactcctacgggaggcagcagtggggaatattgggcaatgggggcaaccctgacccagcaacgccgcgtgaaggaagaaggtcttcggattgtaaacttctttgacaagggacgataatgacggtaccttgaaaacaagccacggct

SEQ ID NO: 1067 - DNA, 490 bp, Unknown
  Ascusbbf_75318, encodes 16S rRNA
agagtttgatcctggctcaggacgaacgctggcggcgtgcctaatacatgcaagtagaacgctgaagaaaggagcttgcttcttttggatgagttgcgaacgggtgagtaacgcgtaggtaacctgccttgtagcgggggataactattggaaacgatagctaataccgcataacagcttttgacacatgttagaagcttgaaagatgcaattgcatcactacgagatggacctgcgttgtattagctagtaggtagggtaacggcctacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaatgtgtgtgagagtggaaagttcacacagtgacggtaact

SEQ ID NO: 1068 - DNA, 490 bp, Unknown
  Ascusbbf_21750, encodes 16S rRNA
agagtttgatcatggctcagaacgaacgctggcggtatgctttaaccatgcaagtcgaacgagaaagggtagcaatacctgagtaaagtggcaaacgggtgagtaacacacaggaatctacccagtagaggggaataagcactggaaacggtgtctaatactccatacgccggtatagcaatatatcgggaaagggctagtagcaatattagttcactattggatgagcctatgtcggattagctagttggtggggtaatggcctaccaaggcgatgatccgtagctgatctgagagggtgatcagccacactggaactgcgacacggtccagactcctacgggaggcagcaggtgggaatattggacaatggaggaaactctgatccagcaataccgcgtgaatgatgaaggccttcgggttgtaaagttcttttaatagggaagataatgacggtacctatagaataagcaccggcaaacttcgtgcc

SEQ ID NO: 1069 - DNA, 490 bp, Unknown
  Ascusbbf_471560, encodes 16S rRNA
agagtttgatcctggctcagattgaacgctagcgggatgctttacacatgcaagtcgaacggcagcgcgaggtaagcttgcttaccttggcggcgagtggcgaacgggtgagtaatgtatcggaacgtgcccagtagcgggggataactactcgaaagagtagctaataccgcatacgccctacgggggaaagggggggatcgcaagacctctcactattggagcggccgatatcggattagctagttggtggggtaaaggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcagggaagaaaagccacgagttaataccttgtggtgctgacggtacctgcaga

SEQ ID NO: 1070 - DNA, 490 bp, Unknown
  Ascusbbf_1341556, encodes 16S rRNA
agagtttgatcatggctcaggatgaacgctagctacaggcttaacacatgcaagtcgagtggcatcatgtatctggcttgccaggtatgatggcgaccggcgcacgggtgcgtaacgcgtgttcgacctgccctttactcgggaacagcccatcgaaagatggattaatgcccgatgttctccctatatcgcatggtattcggagcaaagatttatcggtagaggatgggaacgcgtccgattagcttgacggcggggtaacggcccaccgtggcgacgatcggtaggggttctgagaggaaggcccgcacaactggaactgagaaacggtccagacttctacgggaggcagcagtgagtagtattggtcaatggccgagaggctgaaccagccaagtagcgtgaaggatgactgccctatgggttgtaaacttcttttgtacgggaataacccggtccacgtgtggtccgctgcatgtaccgtacgaat

SEQ ID NO: 1071 - DNA, 490 bp, Unknown
  Ascusbbf_205887, encodes 16S rRNA
agagtttgatcatggctcaggatgaacgctggcggcgtgcttaacacatgcaagtcgaacggggaatttttttagtaagagagcttgctcgattacagggaattcctagtggcggacgggtgagtaacgcgtgggcaacctgccctgtacagggggatagcagttagaaatgactgataaaaccgcataagcgcacggaatcgcatgattcagtgtgaaaaactccggtggtacaggatgggcccgcgtccgattagccagttggcggggtaacggcccaccaaagcgacgatcggtagccggcctgagagggcgaccggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagatgatgacggtacctgactaagaagccccg

SEQ ID NO: 1072 - DNA, 490 bp, Unknown
  Ascusbbf_1435172, encodes 16S rRNA
agagtttgatcatggctcaggatgaacgctagcggcaggcttaacacatgcaagtcgaggggcagcgcgagtagcaatacttggcggcgaccggcgcaagggtgcgtaacgcgtgagcaacatgcccgtatcagggggataatccagggaaacttggtctaataccccatagtaattttgtaaggcatcttatggaatttaaagctttggtggatacggattggctcgcgtgacattagctggatggtaagataacggcttaccatggctatgatgtctaggggttctgagaggaaggtccccaacacgggaactgagaaacggtccagactcctacgggaggcagaagtgaggaatattggacaatggatggaaatctgatccagccatgccgcgtgcaggaagacggtcctatggattgtaaactgcttttgtatgggagcaataaggccttcgtgaaggctgatgagagtaccatacgaataagcac

SEQ ID NO: 1073 - DNA, 490 bp, Unknown
  Ascusbbf_1522789, encodes 16S rRNA
agagtttgatcctggctcaggatgaacgttggcggtgtgcctaatacatgcaagtcgaacggagttaatagcaatattgacttagtggcgaacgggtgagtaacgcgttggtgatctgcctcaaagtgtggaataacgttccgaaaggaacgctaataccgcatgtgctctcgatttttagaaagttgagagtaaaggatttattcgctttgagaggagcctgcgtcctatcagctagttggtagggtaaaagcctactaaggctatgacgggtaggggacctgagagggtggccccccaaaatggaactgaaacacggtccatacacctacgggtggcagcagtagggaatattagaaatggacgaaagtctgatctagcgacaccgcgtgtgcgatgaaggccttcgggttgtaaagcactttttggaaggaataggaaggaaggtacttccagaataagtctcggctaactacgtgccagcagccgc

SEQ ID NO: 1074 - DNA, 490 bp, Unknown
  Ascusbbf_1279748, encodes 16S rRNA
agagtttgatcctggctcagagtgaacgctggcggcaggcctaacacatgcaagtcgagcggcagcgcgggggcaaccctggcggcgagcggcggacgggtgaggaatgcgtcggaatctgcctctttgtgggggataacgtagggaaacttacgctaataccgcatacgacctacgggtgaaagcgggggaccttcgggcctcgcgcagagagatgagccgacgccggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgtgtgaagaaggccttcgggttgtaaagcacttttgtccggaaagaaaggcattcgattaatactcgggtgttatgacggtaccggaagaataagcac

SEQ ID NO: 1075 - DNA, 490 bp, Unknown
  Ascusbbf_1840758, encodes 16S rRNA
agagtttgatcctggctcaggatgaacgctagcggcaggcctaatacatgcaagtcgaacgagattccccagcttgctggggatgagagtggcgtacgggtgcgtaacgcgtgagcaacctaccgttgtctgggggatagcccggagaaatccggattaataccgcataacatcattgaacagcattgtttgatgatcaaacatttatgggacagcgatgggctcgcgtgacattagctagttggagtggtaacggcacaccaaggcgacgatgtctaggggatctgagaggatgaccccccacactgggactgagacacggcccagactcctacgggaggcagcagtaaggaatattggtcaatggaggcaactctgaaccagccatgccgcgtgcaggaagaatgccctctgggttgtaaactgcttttatacgggaataaaccccactacgtgtagtgggctgaatgtaccgtaagaataaggatcg

SEQ ID NO: 1076 - DNA, 490 bp, Unknown
  Ascusbbf_50553, encodes 16S rRNA
agagtttgatcatggctcaggattaacgctggcggcgtgcctaacacatgcaagtcgagcgagaagcagtgaagagattcttcggatgaacagatctgtggacagcggcggacgggtgagtaacgcgtgggcaacctgcccctttccggaggatagccaagggaaactttgaataatactccataaagcaagagtatcgcatggtacatttgccaaagatttatcggagagggatgggcccgcgtctgattagccagttggtgaggcagcggctcaccaaagcgacgatcggtagccggcctgagagggtgaacggccacattggaactgagacacggtccagactcctacgggaggcagcagtggggaatattgcacaatgggcggaagcctgatgcagcaacgccgcgtgaaggaagaaggttttcggatcgtaaacttctgtccccggggaagaataaatgacggtacccgaggaggaagccccggc

SEQ ID NO: 1077 - DNA, 490 bp, Unknown
  Ascusbbf_14751, encodes 16S rRNA
agagtttgatcatggctcaggatgaacgctggcggcgtgcataacacattcaagtcgaacggactgatttggtagcttgctaccgaagaaagttagtggcggacgggtgagtaacgcgtgagcaacctacctctgtgtgtgggataccgtctggaaacggacgttaataccgcatgatccatagagatcgcatgatatttatggcaaagatttattgcacagagatgggctcgcgtctgattaggcagttggtgaggtaacggcccaccaaacctacgatcagtagccggactgagaggttgaacggccacattggaactgagatacggtccagactcctacgggaggcagcagtggggaatattgggcaatgggcgaaagcctgacccagcgacgccgcgtgaaggaagacggtcttcggattgtaaacttcttttatatgggacgaaagatgacggtaccatatgaataagccacggctaactacgtg

SEQ ID NO: 1078 - DNA, 490 bp, Unknown
  Ascusbbf_193173, encodes 16S rRNA
agagtttgatcctggctcaggacgaacgctggcggcgtgcctaacacatgcaagtcgagcggagtcagtaagaggaagttttcggatggaatcttattgatttagcggcggacgggtgagtaacgcgtgagcgaccaaccttgcacagggggataacggaccgaaaggttcactaataccgcatgagaccacggtgttgcatgacacaggggtcaaaggagcaatccggtgcaagacgggctcgcgtccgattaggtagttggaggggtaacggcccaccaagcctatgatcggtagccgacctgagagggtgatcggccacattggaactgagatacggtccaaactcctacgggaggcagcagtggggaatattgggcaatgggggaaaccctgacccagcaacgccgcgtgaaggaagaaggttttcggattgtaaacttctgtccttggtgaagagaagaagacggtagccaaggaggaagccccg

SEQ ID NO: 1079 - DNA, 489 bp, Unknown
  Ascusbbf_187731, encodes 16S rRNA
agagtttgatcatggctcaggatgaacgctggcggcgtgcctaacacatgcaagtcgagcgatcttcttcggaagagagcggcggacgggtgagtaacgcgtgggtaacctgcctcatacacatggataacataccgaaaggtatgctaatacaagatgatataagagattcgcatggatttcttatcaaagctccggcggtatgagatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaat

SEQ ID NO: 1080 - DNA, 490 bp, Unknown
  Ascusbbf_86755, encodes 16S rRNA
agagtttgatcctggctcaggacgaacgctggcggcgtgcctaacacatgcaagtcgaacggggtccatgagagcttgctctcggaagacctagtggcgaacgggtgagtaacacgtgagaaacctgcctcggagtggggaataactcggggaaactcgagctaataccgcataccctcagatgatcgcatggtcgactgaggaaagaatttcgctctgagagggtctcgcggcctatcagctagttggtggggtaacggcctaccaaggcagcgacgggtagctggtttgagagaacgatcagccacactgggactgagacacggcccagactcctacgggaggcagcagtggggaatcttgcgcaatgggcgaaagcctgacgcagcaacgccgcgtgcgggatgacggccttcgtggttgtaaaccgctttcagcagggacgaaaatgacggtacctgcagaagaagccccggctaactacgtgcca

SEQ ID NO: 1081 - DNA, 490 bp, Unknown
  Ascusbbf_213514, encodes 16S rRNA
agagtttgatcctggctcagaacgaacgctggcggcgcgtcttaagcatgcaagtcgaacggcaaggatggtagcttgctaccatccctagagtggcggactggtgagtaacacgtgggtgacctacccttgagatggggatagccattagaaatagtggataataccgaatacgctctacggactctggtttgtagaggaaacaggctacggcctggctcgaggatgggcccgcgtcccattagctagttggtgaggtaagagcccaccaaggcgacgatgggtatccggcctgagagggtgtacggacacattgggactgagatacggcccaaactcctacgggaggcagcagctaagaatattccgcaatggacgaaagtctgacggagcgacgccgcgtggatgacgaaggccgaaaggttgtaaaatccttttgctgatgaagaataagcgtggtagggaatgaccgcgtgatgacattagtcgg

SEQ ID NO: 1082 - DNA, 490 bp, Unknown
  Ascusbbf_93237, encodes 16S rRNA
agagtttgatcctggctcaggatgaacgctagctacaggcttaacacatgcaagtcgaggggaaacgattagaggtgcttgcaccactaaggcgtcgaccggcgcacgggtgagtaacgcgtatccaacctgccccatggtaaggaataatccgtagaaatgcggtctaataccttatgtgctccgaagaggacatctgatttggagtaaagatttatcgccatgggatggggatgcgtctgattagattgttggcggggcaacggcccaccaagtcaccgatcagtaggggttctgagaggaaagtcccccacattggaactgagacacggtccaaactcctacgggaggcagcagtgaggaatattggtcaatggatgagaatctgaaccagccaagtagcgtgcaggacgacggccctatgggttgtaaactgcttttgtacggggataaaggagcttacgtgtaagtttttgcaggtaccgtacga

SEQ ID NO: 1083 - DNA, 490 bp, Unknown
  Ascusbbf_102503, encodes 16S rRNA
agagtttgatcctggctcaggacgaacgctggcggcgtgcctaacacatgcaagtcgagcgaggtccattctgtggcaacacagaggaagacctagcggcgaacgggtgagtaacacgtgagaaacctgccccgaacactgggataaccaggggaaaccctggctaataccggataccctcgtctgaccgcatggtcggtcgaggaaagatttatcggtttgggagggtctcgtggcctatcagctagttggtggggtaatggcccaccaaggcatcgacgggtagctggtctgagaggacgatcagccacactgggactgagacacggcccagactcctacgggaggcagcagtggggaatattgcgcaatgggcgaaagcctgacgcagcaacgccgcgtgcgggatgaaggccttagggttgtaaaccgctttcggcagggacgaaattgacggtacctgcagaagaagccccggccaactacgtgc

SEQ ID NO: 1084 - DNA, 490 bp, Unknown
  Ascusbbf_347227, encodes 16S rRNA
agagtttgatcatggctcaggatgaacgctagcgggaggcctaacacatgcaagccgagcgggatttagtagttagcttgctaactactgatgagagcggcgtacgggtgcggaacacgtgtgcaacctgcctttatctgggagatagcctttcgaaaggaagattaataccccataatatattgactggcatcatttgatattgaaaactccggtggataaagatgggcacgcgcaagattagatagttggtgaggtaacggctcaccaagtcgatgatctttagggggcctgagagggtgatcccccacactggtactgagacacggaccagactcctacgggaggcagcagtgaggaatattggacaatgggttagcgcctgatccagccatcccgcgtgaaggattaaggacctatggtttgtaaacttcttttgtacagggataaacctactctcgtgagagtagctgaaggtactgtacgaata

SEQ ID NO: 1085 - DNA, 490 bp, Unknown
  Ascusbbf_1607949, encodes 16S rRNA
agagtttgatcatggctcaggatgaacgctgacagaatgcttaacacatgcaagtcaacttgaacttcggtttgggtggcggacgggtgagtaacgcgtaaagaacttgcctcacagctagggacaacatttggaaacgaatgctaatacctgatattattattttatggcatcataggataatgaaagctataagcgctgcgagagagctttgcgttccattagctagttggagaggtaacggctcaccaaggcgatgatgggtagccgacctgagagggtgaacggccacaaggggactgagacacggcccttactcctacgggaggcagcagtggggaatattggacaatggaccgagagtctgatccagcaattctgtgtgcacgatgaagtttttcggaatgtaaagtgctttcagttgggaagaaaagaatgacggtaccaacagaagaagtgacggctaaatacgtgccagcagccgcggtaa

SEQ ID NO: 1086 - DNA, 490 bp, Unknown
  Ascusbbf_278738, encodes 16S rRNA
agagtttgatcctggctcagaatgaacgctggcggcatggattaggcatgcaagtcgaacgtgctcccttcggggagaaagtggcgaaagggtgagtaacacgtgagcaacctgcctccggatccggaataatccagggaaacttggtctaaaaccggatgaagacattgggccgcatggcctggtgttaaaatatttatagtccggagaggggctcgcggcccattagctagttggcggggtaatggcccaccaaggctacgacgggtaggtggtctgagaggatggtcacccacactgggactgagacactgcccagactcctacgggaggctgcagtcgagaatcttccgcaatgggcgcaagcctgacggagcgatgccgcgtgagggatgacggccttcgggttgtaaacctctgtcatccgggacgaacacaatgacggtaccggaaaaggaagccacggctaaccacgtgccagcagccgcgg

SEQ ID NO: 1087 - DNA, 490 bp, Unknown
  Ascusbbf_938032, encodes 16S rRNA
agagtttgatcatggctcagattgaacgctggcggcatgctttacacatgcaagtcggacggcagcggggaagtgcttgcacttctgccggcgagtggcgaacgggtgagtaatgcatcggaacgtaccgagtagtgggggataactgtccgaaaggacggctaataccgcatacgctttgagaaggaaagcgggggaccgtaaggcctcgcgctattcgagcggccgatgtctgattagctagttggtggggtaaaggcctaccaaggcgacgatcagtagcgggtctgagaggatgatccgccacactgggactgagacacggcccagactcctacgggaggcagcagtggggaattttggacaatgggggcaaccctgatccagccatgccgcgtgtctgaagaaggccttcgggttgtaaaggacttttgtcagggaagaaagggtttgggctaatatcccgaacatatgacggtacctgaagaat

SEQ ID NO: 1088 - DNA, 490 bp, Unknown
  Ascusbbf_10085, encodes 16S rRNA
agagtttgatcatggctcaggatgaacgctagctacaggcttaacacatgcaagtcgaggggcagcatgatcttagcttgctaagattgatggcgaccggcgcacgggtgagtaacgcgtatccaaccttccgcacagtagggaatagcccggcgaaagtcggattaatgccctatgttttcccttgatggcatctgattgggaacaaagatttatcgctgtgcgatggggatgcgtctgattaggtagtcggcggggtaacggcccaccgagccttcgatcagtaggggttctgagaggaaggtcccccacattggaactgagacacggtccaaactcctacgggaggcagcagtgaggaatattggtcaatggaggcaactctgaaccagccaagtagcgtgcaggatgacggccctatgggttgtaaactgcttttgccggggaataactgccattacgtgtaatggtttgcatgtacccggagaat

SEQ ID NO: 1089 - DNA, 486 bp, Unknown
  Ascusbbf_6275, encodes 16S rRNA
agagtttgatcatggctcagaacgaacgctggcggcaggtcttaggcatgcaagtcgaacggatgacaagggagcttgcttccttgaagtcagtggcgcacgagtgagtaacgcgtgggaaactgcccttcactggggaataacgtttggaaacgaacgctaataccgcatacgcccgcaaggggaaagatttatcggtgatggatgtgcccgcgttggattagctagttggtggggtaatggcctaccaaggcgatgatccatagctggtctgagaggacgatcagccacgctggaactgagacacggtccagactcctacgggaggcagcagctaagaatattgggcaatggaggaaactctgacccagccatgccgcgtgaatgaagaaggccttcgggttgtaaagttcttttagtcatgaagatgatgacagtagtgacagaaaaagcaccggctaacttcgtgccagcagccgcggtaat

SEQ ID NO: 1090 - DNA, 490 bp, Unknown
  Ascusbbf_1432, encodes 16S rRNA
agagtttgatcatggctcaggatgaacgctagcggcaggcttaacacatgcaagtcgaggggcagcggagagtagcaatactctgccggcgaccggcgaaagggtgcgtaacgcgtgagcaacttgcccgtatccgggacataagcggtggaaacgccgtctaatttcccataacaacgagggccgcatgacccatgtttgaaagatccgtcggatacggatgggctcgcgagacattagctagtcggcgtggtaacggcacaccgaggcgacgatgtctaggggttctgagaggaaggtcccccacactggaactgagacacggtccagactcctacgggaggcagcagtgaggaatattggtcaatgggcgcaagcctgaaccagccatgccgcgtgaaggaatgaggccctatgggtcgtaaacttcttttgtggtggagcaataaggtgcacgtgtgcatcgatgagagtacatcacgaataagca

SEQ ID NO: 1091 - DNA, 490 bp, Unknown
  Ascusbbf_50685, encodes 16S rRNA
agagtttgatcctggctcaggatgaacgctggcggcgtgcctaacacatgcaagtcgagcgagaaatcaggtgttgaaacttcggtagatacatctggtggacagcggcggacgggtgagtaacgcgtgggaaacctgcccttatctgagggatagccgagagaaatttcgagtaatacctcataatgcatcgagaccgcatggccatgatgccaaagatttatcggataaggatggtcccgcgtctgattagctggttggtgaggtagcggctcaccaaggcgacgatcagtagccggcctgagagggtgaacggccacattggaactgagacacggtccagactcctacgggaggcagcagtggggaatattgcacaatgggcggaagcctgatgcagcaacgccgcgtgagggatgaaggctttcgagtcgtaaacctctgtccttggggaagaagaactgacggtacccttggaggaagccccggc

SEQ ID NO: 1092 - DNA, 490 bp, Unknown
  Ascusbbf_101230, encodes 16S rRNA
agagtttgatcctggctcaggatgaacgctagcgataggcttaacacatgcaagtcgaggggcagcatggtcttagcttgctaaggctgatggcgaccggcgtaagggtgcgtaacgcgtatgtaacttgcctttgagagggggataacccggagaaatccggcctaataccgcgtattctcaagttgctgcatggcagtttgaggaaagatttattgctcagagataggcatgcgttccattaggtagttggtgaggtaacggctcaccaagccgacgatggataggggagctgagaggctgaccccccacactgggactgagacacggcccagactcctacgggaggcagcagtgaggaatattggtcaatggaggcaactctgaaccagccaagtcgcgtgaaggaagactgtcctatggattgtaaacttctttagtaggtgaatagagtcgggcacgtgtgcccgtaggcatgtaacctaagaat

SEQ ID NO: 1093 - DNA, 490 bp, Unknown
  Ascusbbf_372725, encodes 16S rRNA
agagtttgatcctggctcaggatgaacgctggcggcgtgcctaatacatgcaagtcgaacgaggtggatgggagcttgctccttgatgcctagtggcgaacgggtgagtaacacgtaggtaacctgcctttaagcttgggatacccagaggaaactttggttaataccggataacaacagaggaggcatctcttttgcttgaaaggccctgcaaggggtcacttaaagatggacctgcggcgcattagctagttggtgagataacagcccaccaaggcaaggatgcgtagccgacctgagagggtgatcggccacattggaactgagacacggtccaaactcctacgggaggcagcagtaaggagtattcgtcaatgggggaaaccctgaacgagcaacgccgcgtgagtgatgacggccctatgggttgtaaagctctgttgtaggggacgaatgattagcttaggaaatgaagctaatttgacggtac

SEQ ID NO: 1094 - DNA, 490 bp, Unknown
  Ascusbbf_55939, encodes 16S rRNA
agagtttgatcatggctcaggacgaacgctggcggcgtgcttaacacatgcaagtcgaacgatgaagcccagcttgctgggtggattagtggcgaacgggtgagtaacacgtgagtaacctgccctccactctgggataactccgggaaaccggtgctaatactggatatgactccaacctgcatgggtatggggtggaaagatttatcggtggtggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgaaagcctgatgcagcgacgccgcgtgcgggatgacggccttcgggttgtaaaccgctttcagctctgacgaagcttttgtgacggtaggagcagaagaagcaccggctaactacgtgcca

SEQ ID NO: 1095 - DNA, 490 bp, Unknown
  Ascusbbf_284173, encodes 16S rRNA
agagtttgatcatggctcaggatgaacgctggcggcgtgcttaacacatgcaagtcgaacggagagctaatgattgaggattcgtccaaatgatttagtttcttagtggcggacgggtgagtaacgcgtgaggaacctgcctcggagtggggaataacacagtgaaaattgtgctaataccgcataatgcagttgagtcgcatggctctgactgccaaagatttatcgctctgagatggcctcgcgtctgattagatagttggcggggtaacggcccaccaagtcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcagggacgaataaatgacggtacttgacgaataagccacg

SEQ ID NO: 1096 - DNA, 490 bp, Unknown
  Ascusbbf_9908, encodes 16S rRNA
agagtttgatcatggctcaggacgaacgctggcggcatgcctaacacatgcaagtcgaacggagtttaaggggcttgctccttaaacttagtggcggacgggtgagtaacgcgtgagcaacctgcctctcagtggggaataatgtactgaaaaggacactaataccgcatgacgtaccggagtcgcatggcactggtaccaaagatttatcgctgagagatgggctcgcgtccgattagctggttggtgaggtaacggctcaccaaggcgacgatcggtagccggactgagaggttgaacggccacattgggactgagacacggcccagactcctacgggaggcagcagtgggggatattgcgcaatgggggcaaccctgacgcagcaatgccgcgtgaaggatgaaggtcttcggattgtaaacttcttttgtcagggacgataatgacggtacctgacgaataagctccggctaactacgtgccagca

SEQ ID NO: 1097 - DNA, 490 bp, Unknown
  Ascusbbf_141516, encodes 16S rRNA
agagtttgatcatggctcaggatgaacgctggcggcgcatttaagacatgcaagtcgaacgaaaatttatgcttaaagagttgattagtttactaagatacaatttattataaattttagtggcggactggtgagtaatacataggtaatctgccttttagtgggggataactaggagaaattctagctaataccgcgtaagaccacatctaggcatctagaagaggtcaaagaagtaattcgctaaaagatgagcctgtggctgattagttagttggtgaggtaagggcttaccaagacgatgatcagtagccgagctgagaggctggccggccacattgggactgagatacggcccagactcctacgggaggcagcagttgggaatattggacaatggaggaaactctgatccagtgacgccgcgtgaaggaagaaggtcttcggattgtaaacttattttatcagggaagaagaaagtgacagtacc

SEQ ID NO: 1098 - DNA, 486 bp, Unknown
  Ascusbbf_52573, encodes 16S rRNA
agagtttgatcatggctcagaacgaacgctggcggcaggtcttaggcatgcaagtcgaacggacgaagcggaagcttgctttcgcctagttagtggcgcacgagtgagtaacgcgtgggaaactgcccatcactggggaataacgtttggaaacgaacgctaataccgcatacgccggaaacgggaaagatttatcggtgatggatgtgcccgcgttggattagcttgttggtggggtaatggcctaccaaggcaatgatccatagctggtctgagaggacgatcagccacgttggaactgagacacggtccaaactcctacgggaggcagcagctaagaatattgggcaatggaggaaactctgacccagccatgccgcgtgaatgaagaaggccttcgggttgtaaagttcttttagtcgtgaagatgatgacagtagcgacagaaaaagcaccggctaacttcgtgccagcagccgcggtaat

SEQ ID NO: 1099 - DNA, 490 bp, Unknown
  Ascusbbf_1513270, encodes 16S rRNA
agatttgatcatggctcaggacgaacgctggcggcgtgcctaacacatgcaagtcgaacggacgagaggagcttgctcctcaagttagtggcggacgggtgagtaacacgtgagcaacctgcccttcggagggggacaacagctggaaacggctgctaataccgcatgatgtatcctggaggcatctccgggataccaaagattttatcgccgaaggatgggctcgcgtctgattagatagttggcggggtaacggcccaccaagtctgcgatcagtagccggactgagaggttgaacggccacattgggactgagatacggcccagactcctacgggaggcagcagtggggaatattgggcaatgggggcaaccctgacccagcaacgccgcgtgaaggaagaaggctttcgggttgtaaacttctttgacgagggacgatagtgacggtacctcgaaaacaagccacggctaactacgtgccagcagc

SEQ ID NO: 1100 - DNA, 490 bp, Unknown
  Ascusbbf_85260, encodes 16S rRNA
agagtttgatcctggctcaggatgaacgctagctacaggcttaacacatgcaagtcgaggggtaacgcgaggtagcaatactttggcgacgaccggcgcacgggtgcgtaacgcgtatgcaacctacctgtaacagggggataacggagagaaatttccactaataccccatattgttggagattcgcatgtttctccaacgaaagcttcggtggttacggatgggcatgcgtgacattagctagttggtaaggtaacggcttaccaaggcgacgatgtctaggggagctgagaggcttatcccccacactggtactgagacacggaccagactcctacgggaggcagcagtgaggaatattggtcaatggacggaagtctgaaccagccatgccgcgtggaggaagaaggtcctatgggttgtaaactccttttgttcgagagtaataaggtccttgcgaggaccgatgagagtatcggacgaataagc

SEQ ID NO: 1101 - DNA, 490 bp, Unknown
  Ascusbbf_4601, encodes 16S rRNA
agagtttgatcctggctcagattgaacgctggcggcaggcttaatacatgcaagtcgaacggtagcagcaggaaggcttgcctttctggctgacgagtggcggacgggtgagtaatacctgggaaactgcctacaagagggggacaacacctggaaacgggtgctaataccgcataagccccgaggggaaaaggatgggaaaccatgcgcttgtagatgtgcccaggagggattagctagttggggaggcaaaggctcaccaaggcgacgatctctagctggtctgagaggatgatcagccacattgggactgagacacggcccaaactcctacgggaggcagcagtagggaatattgcacaatggggggaaccctgatgcagccatgccgcgtgtgtgaagaaggccttcgggttgtaaagcactttcagcggggaggaaggctgaggctccaacagggcctgagtcggacgttacccgcagaagaagc

SEQ ID NO: 1102 - DNA, 490 bp, Unknown
  Ascusbbf_1638, encodes 16S rRNA
agagtttgatcatggctcaggatgaacgctagcggcaggcttaacacatgcaagtcgaggggcagcgggttgtagcaatacaatgccggcgaccggcgaaagggtgagtaacgcgtgagcaacatgcccgatagtggaggatagtcgatggaaacgtcgcgtaatactccgtaacaacagagaccgcatgatctttgtttaatagatttattgctatcggattggctcgcgtaccattagctagttggcggggtaacggcccaccaaggcgacgatggttaggggttctgagaggaaggtcccccacattggaactgagacacggtccagactcctacgggaggcagcagtgaggaatattggacaatggccggaaggctgatccagccatgccgcgtgcgggaagacggccctatgggttgtaaaccgcttttgttggggagcaataagggtcacgtgtggcctgatgagagtacccagcgaataagca

SEQ ID NO: 1103 - DNA, 490 bp, Unknown
  Ascusbbf_1143, encodes 16S rRNA
agagtttgatcatggctcaggacgaacgctggcggcgtgcctaacacatgcaagtcgagcgagaatttatcgaaggagaccttcgggtcgaatttgatgaaggaaagcggcggacgggtgagtaacgcgtgagtaacctgccttacagagagggataacgttccgaaaggggcgctaataccgcataacgtatgtttgccgcatgacagacataccaaagatttatcgctgtaagatggactcgcgtctgattagctggttggtggggtaacggctcaccaaggcgacgatcagtagccgaactgagaggttgatcggccacattgggactgagacacggcccagactcctacgggaggcagcagtgggggatattgcgcaatgggggcaaccctgacgcagcaacgccgcgtgaaggatgaaggtcttcggatcgtaaacttttgtctttggggacgataatgacggtacccaaggaggaagccacggc

SEQ ID NO: 1104 - DNA, 482 bp, Unknown
  Ascusbbf_213, encodes 16S rRNA
agagtttgatcatggctcagaacgaacgctggcggcacgcttaacacatgcaagtcggacggagtatgggagcttgctcttatacttagtggcggacgggtgagtaacacgtgggaacatgtcctgtagtggtggatagctccgggaaactggaggtaatacagcataagctcgagagaggaaagagaaatcgctataggggtggcccgcggctgattaggtagttggtggggtaaaggcctaccaagccgaggatcagtagctggtctgagaggatggacagccacactgaaactgagatacggttcagactcctacgggaggcagcagtggggaatattggacaatgggggcaaccctgatccagcgatgccgcgtgagtgaagaaggtcttaggattgtaaagctcttttgacagggaagatgatgacggtacctgtagaataagcaccggctaactctgtgccagcagccgcggtaat

SEQ ID NO: 1105 - DNA, 490 bp, Unknown
  Ascusbbf_494215, encodes 16S rRNA
agagtttgatcctggctcaggacgaacgctggcggcgtgcctaatacatgcaagtcgaacgctgcttaagaagaaacttcggttttttcttaagcggagtggcggacgggtgagtaacacgtggggaacctatccatcagcgggggataacacttggaaacaggtgctaataccgcatacggctttttttcacctgaaagaaagctcaaaggcgctttacagcgtcactgatggctggccccgcggtgcattagccagttggtgaggtaacggctcaccaaagcaacgatgcatagccgacctgagagggtgatcggccacactgggactgagacacggcccagactcctacgggaggcagcagtagggaatcttcggcaatggacgcaagtctgaccgagcaacgccgcgtgagtgaagaaggttttcggatcgtaaagctctgttgtcagcaaagaacaggagaaagaggcaatgctttttctatgac

SEQ ID NO: 1106 - DNA, 490 bp, Unknown
  Ascusbbf_408876, encodes 16S rRNA
agagtttgatcatggctcaggatgaacgctggcggcgtgcctaacacatgcaagtcgaacgaggtattgcaatcgagatggaggagcttgctccgaagtctcactcgtgataccgagtggcggacgggtgagtaacgcgtggagaacctgccccgtacagggggataccaattagaaatgattgttaataccgcataagcgcacatgaccgcatggtcgagtgtgaaaagctccggcggtacgggagggctccgcgtctgattagccagttggcggggtaacggcccaccaaagcgatgatcagtagccgacctgagagggtgaccggccacattgggactgagacacggcccaaactcctacgggaggcagcagtgggggatattgcacaatgggggaaaccctgatgcagcgacgccgcgtgagtgaagaagtatttcggtatgtaaagctctatcagcagggaagaaaatgacggtacctgactaag

SEQ ID NO: 1107 - DNA, 490 bp, Unknown
  Ascusbbf_48167, encodes 16S rRNA
agagtttgatcctggctcaggatgaacgctggcggcatgcctaagacatgcaagtcgaacgaagtggcccattgagtatggagtacttgtacaaaatatgatttggaatttccacttagtggcagacgggtgagtaacacgtaagtaacctaccttaaagactgggataacgtttggaaacgaacgctaataccggatgattcattactagataactagaaatgctaaaagaagcgtttgcttcactttaagatgggcttgcggcgtattaactagttggtggggtaatggcctaccaaggtgacgatgcgtagccgggctgagaggctaatcggccacattgggactgagacacggcccaaactcctacgggaggcagcagttaggaatattcgtcaatgggggaaaccctgaacgagcaatgccgcgtgagtgatgacggtcttatagattgtaaaactctgttgtaaaggaagaacccttactatag

SEQ ID NO: 1108 - DNA, 490 bp, Unknown
  Ascusbbf_20569, encodes 16S rRNA
agagtttgatcatggctcagattgaacgctagcgggatgctttacacatgcaagtcgaacggcagcacgaggagcttgctccttggtggcgagtggcgaacgggtgagtaatatatcggaacatgcccagtagcgggggataactactcgaaagagtggctaataccgcatacgtcctacgggagaaagcaggggaccttcgggccttgcactattggagtggccgatatcggattagctagttggtggggtaaaggcctaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttgtcaggaaagaaatcgcccgggataatacctcgggtggatgacggtacctgaagaataa

SEQ ID NO: 1109 - DNA, 490 bp, Unknown
  Ascusbbf_70496, encodes 16S rRNA
agagtttgatcctggctcaggatgaacgctggcggcgtgcctaacacattcaagtcgaacggagatatacggaagcttgcttttgtatattttagtggcggacgggtgagtaatgcatgagcaacctgccttaaagagggggataacacagagaaatttgtgctaataccgcataagctgcgaaggaggcatctcccatgcagaaaaggagcaatccgctttaagatgggctcatgtctgattagatagttggtagggtaacggcctaccaagtctgcgatcagtagccggactgagaggttgaacggccacattggaactgagatacggtccagactcctacgggaggcagcagtggggaatattgggcaatgggcgaaagcctgacccagcaacgccgcgtgaaggaagaaggtcttcggattgtaaacttctttgacaggggacgaagcatgacggtaccctgaaaacaagccacgactaactacgt

SEQ ID NO: 1110 - DNA, 490 bp, Unknown
  Ascusbbf_57, encodes 16S rRNA
agagtttgatcatggctcaggacgaacgctggcggcgtgcctaacacatgcaagtcgaacggagcgaaagcagcttgctgctggagcttagtggcggacgggtgagtaacacgtgagcaacctgcctttcagaggggaataatgtctggaaacggacactaataccgcataatatctttttactgcatggtagagagatcaaaggagcaatccgctgaaagatgggctcgcgtctgattagccagttggcggggtaacggcccaccaaagcgacgatcagtagccggactgagaggttgaacggccacattgggactgagacacggcccagactcctacgggaggcagcagtgggggatattgcacaatgggggaaaccctgatgcagcaacgccgcgtgcaggaagaaggtcttcggattgtaaactgttgtcctctgtgacgataatgacggtagcagaggaggaagccacggctaactacgtgccag

SEQ ID NO: 1111 - DNA, 490 bp, Unknown
  Ascusbbf_2466, encodes 16S rRNA
agagtttgatcatggctcaggacgaacgctggcggcatgcctaacacatgcaagtcgaacggagcttaagaagcttgctttttaagcttagtggcggacgggtgagtaacgcgtgagcaacctgcctttcagtggggaataatactctgaaaagggtactaataccgcataatgtacagagatcgcatggtttatgtaccaaagatttatcgctgagagatgggctcgcgtccgattagctggttggtgaggtaacggctcaccaaggcgacgatcggtagccggactgagaggttgaacggccacattgggactgagacacggcccagactcctacgggaggcagcagtgggggatattgcgcaatgggggaaaccctgacgcagcaatgccgcgtggaggattgaaggtcttcggattgtaaactccttttgtcagggacgaaaaatgacggtacctgacgaataagctccggctaactacgtgccag

SEQ ID NO: 1112 - DNA, 490 bp, Unknown
  Ascusbbf_119324, encodes 16S rRNA
agagtttgatcatggctcaggatgaacgctggcggcgtgcctaacacatgcaagtcgaacggggtacagacgctgcgagaggaagtgcttgcacggaatcaaacttgtctgtacttagtggcggacgggtgagtaacgcgtggaaaacctgcctcatacagggggataacaggaagaaattcctgctaataccgcatgagcgcacattaccgcatggtagagtgtgaaaagatttatcggtatgagatggttccgcgtctgattagccagttggcggggtaacggcccaccaaagcgacgatcagtagccggcctgagagggcggacggccacattgggactgagacacggcccagactcctacgggaggcagcagtgggggatattgcacaatgggggaaaccctgatgcagcgacgccgcgtgggtgaagaagttattcgtaatgtaaagccctatcagcagggaagataatgacggtacctgactaa

SEQ ID NO: 1113 - DNA, 490 bp, Unknown
  Ascusbbf_243311, encodes 16S rRNA
agagtttgatcatggctcaggacgaacgctggcggcgtgcctaatacatgcaagtcgaacgcttctttttcaccgaacttcggttcatcgaaaaagaggagtggcgaacgggtgagtaacacgtgggtaacctgcccatcagaaggggataacacttggaaacaggtgctaataccgtataatgctttttctcgcatgagagcaagctgaaaggcgcttttgcgtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtaaaatgttcatcccttga

SEQ ID NO: 1114 - DNA, 490 bp, Unknown
  Ascusbbf_3307, encodes 16S rRNA
agagtttgatcatggctcaggatgaacgctggcggcgtgcctaacacatgcaagtcgaacgggaactctcaaatgaaggttcgctggattttgagaaattctagtggcggacgggtgagtaacgcgtgggtaacctgcccttaagaggggaataacaccgagaaatcggtgctaatacaccatatgcttacagtatcgcatgatacagtgaggaaatgaatttcgcttaaggatggacccgcgtttgattagccagttggcagggtaacggcctaccaaagcaacgatcaatagccggcctgagagggtgaacggccacattggaactgagacacggtccaaactcctacgggaggcagcagtggggagtattgcacaatgggcgaaagcctgatgcagcaacgccgcgtgagtgaagaagtatttcggtatgtaaagctctatcgatggggaataaaatgaaggtacccaagtaagaagccccggctaa

SEQ ID NO: 1115 - DNA, 490 bp, Unknown
  Ascusbbf_38595, encodes 16S rRNA
agagtttgatcctggctcagaacgaacgctggcggcgcgtcttaagcatgcaagtcgaacggcaagattggtgcttgcaccgatcctagagtggcggactggtgagtaacgcgtgggtgacgtaccctatggatggggatagccggtagaaataccggataataccgaataagcttggctttttaatgtaagttaaggaaaggagctccggctccgccaaaggaacggcccgcgtactattagctagttggtgaggtaacggcccaccaaggcgacgatagttatccggcctaagagggtgaacggacacattgggactgagatacggcccagactcctacgggaggcagcagctaagaatattccgcaatggaggaaactctgacggagcgacgccgcgtggatgatgaaggtcggaagattgtaaaatccttttaagtgtgatgaataaagtttacaggaaatggtagacagatgaccgtagcacttg

SEQ ID NO: 1116 - DNA, 490 bp, Unknown
  Ascusbbf_324, encodes 16S rRNA
agagtttgatcctggctcaggacgaacgctggcggcgtgcttcatacatgcaagtcgaacgataaggccccttcgggggtacataagtggcggacgggtgagtaatatgtagagaatctgccttcaagcgggggacaacagagggaaacttctgctaataccccatatgagcgtacctgcgatggtattcttgaaagctccggcgcttggagatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgatcgtagaagcccttcggggtgtaaagatctgtcagtagggacgaacaatgactgtacctacagaggaagcaccggctaactccgtgccagcagccgcg

SEQ ID NO: 1117 - DNA, 490 bp, Unknown
  Ascusbbf_1065, encodes 16S rRNA
agagtttgatcatggctcaggacgaacgctggcggcatgcctaacacatgcaagtcgaacggaactaaggggcttgccctttagtttagtggcggacgggtgagtaacgcgtgagcaacctgcctttcagtggggaataatatcctgaaaagggtactaataccgcataacgtaacgagatcgcatggttttgttaccaaagatttatcgctgagagatgggctcgcgtccgattagccagttggtggggtaacggcctaccaaagctacgatcggtagccggactgagaggttgaacggccacattgggactgagacacggcccagactcctacgggaggcagcagtgggggatattgcgcaatgggggaaaccctgacgcagcaatgccgcgtgaaggatgaaggtcttcggattgtaaacttcttttgtcagggacgaaaattgacggtacctgacgaataagctccggctaactacgtgccagcag

SEQ ID NO: 1118 - DNA, 490 bp, Unknown
  Ascusbbf_4224, encodes 16S rRNA
agagtttgatcatggctcaggacgaacgctggcggcgtgcttcatacatgcaagtcgaacgagaagctcacttcggtgagtggaaagtggcggacgggtgagtaatatgtagagaatctgccctagagagagggacaacagttggaaacgactgctaatacctcatatgcgcgtagttgagatactattcgtgaaaactccggtgctctaggatgagtctgcatctgattagctagttggcggtgtaatggaccaccaaggcgacgatcagtagctggtttgagaggatgatcagccacaatgggactgagacacggcccatactcctacgggaggcagcagtagggaattttgcgcaatgggggaaaccctgacgcagcaacgccgcgtgaacgaataagcccttcggggtgtaaagttctgtcagcagggacgaaacttgacggtacctgcagaggaagcatcggctaactccgtgccagcagccgcg

SEQ ID NO: 1119 - DNA, 490 bp, Unknown
  Ascusbbf_2018, encodes 16S rRNA
agagtttgatcatggctcaggacgaacgctggcggcgtgcctaacacatgcaagtcgagcgagaatcttacgacggattccttcgggatgaagacgtaagaggaaagcggcggacgggtgagtaacgcgtgagtaacctgccttcaggagggggacaacagctggaaacggctgctaataccgcatgacattgctttatcgcatggtagagtaatcaaagatttatcgcctgaagatggactcgcgtctgattagctagttggtggggtaaaggcctaccaaggcgacgatcagtagccgaactgagaggttgatcggccacattgggactgagacacggcccagactcctacgggaggcagcagtgggggatattgcgcaatgggggcaaccctgacgcagcaacgccgcgtgaaggaagaaggttttcggatcgtaaacttctttaagtgtggaagaagatgacggtacacacagaataagccacggc

SEQ ID NO: 1120 - DNA, 490 bp, Unknown
  Ascusbbf_16608, encodes 16S rRNA
agagtttgatcatggctcagaacgaacgctggtggcgtgtcttatacatgcaagtcgagcggtgcagcaatgcatagcggcgaacgggtgagtaacgcgtaagcaatctgccccctgttcgggaatagccgtgccaacgcgcgggtaataccggatatcgtggctccccacatggggagttgacaaaagatttatcgacaggggatgagcttgcgtccgattagctagttggcggggcaacggcccaccaaggcgacgatcggtagccggcctgagagggtgatcggccacattgggactgagatacggcccagactcctacgggaggcagcagtagggaatattgcacaatgggggaaaccctgatgcagcaacgccacgtgtgggaagaagcatttcggtgtgtaaaccactgtcgtgagggaataaggcttgctttcgggcaagttgaatgtacctcgagaggaagcaccggcaaacttcgtgccag

SEQ ID NO: 1121 - DNA, 490 bp, Unknown
  Ascusbbf_18776, encodes 16S rRNA
agagtttgatcctggctcaggacgaacgctggcggcatgcctaacacatgcaagtcgaacggagtttgaggagcttgctccttgaacttagtggcggacgggtgagtaacgcgtgagtaacctgcctttcagtggggaataatattctgaaaagagtactaataccgcataacatacagaagtcgcatggcttttgtatcaaagatttatcgctgagagatggactcgcgtccgattagccagttggcggggtaacggcccaccaaagcaacgatcggtagccggactgagaggttgaacggccacattgggactgagacacggcccagactcctacgggaggcagcagtgggggatattgtgcaatggggggaaccctgacacagcaatgccgcgtgaaggatgaaggtcttcggattgtaaacttcttttgtcaaggaagataatgacggtacttgacgaataagctccggctaactatgtgccagca

SEQ ID NO: 1122 - DNA, 490 bp, Unknown
  Ascusbbf_7654, encodes 16S rRNA
agagtttgatcatggctcaggatgaacgctagcggcaggcttaatacatgcaagtcgaacggtaacatagagtagcaatactctgatgacgagtggcggatgggtgcgtaacgcgtatgtgacctacccatattcgggacaaaacatcgagaaattggtgctaatatcctatatgtctacgagctgcatggtttgtagatgaaagtcgcgagatgaatatggatgggcatgcgtgccattagctagttggtaaggtaacggcttaccaaggcgacgatggctaggggctctgagaggattaccccccacattggaactgagacacggtccaaactcctacgggaggcagcagtaaggaatattggtcaatgggcggaagcctgaaccagccatgccgcgtgcaggaagacggtcctatggattgtaaactgcttttatacaggagtaatagcaggtacgtgtacctgtttgcaagtactgtaggaataag

SEQ ID NO: 1123 - DNA, 490 bp, Unknown
  Ascusbbf_9793, encodes 16S rRNA
agagtttgatcatggctcaggacgaacgctggcggcgtgcctaacacatgcaagtcgaacggagttattcgagatgaagttttcggatggaattttggataacttagtggcggacgggtgagtaacgcgtgagtaacctgcccataagagggggataacgttctgaaaagaacgctaataccgcatgacatatttggttcgcatgaaccgaatatcaaaggagcaatccgcttatggatggactcgcgtccgattagctagttggcgggataacagcccaccaaggcgacgatcggtagccggactgagaggttgaacggccacattgggactgagacacggcccagactcctacgggaggcagcagtgggggatattgcgcaatgggggaaaccctgacgcagcaacgccgcgtgaaggacgaaggtcttcggattgtaaacttcttttgttgaggacgaagaaagtgacggtactcaacgaataagct

SEQ ID NO: 1124 - DNA, 490 bp, Unknown
  Ascusbbf_592595, encodes 16S rRNA
agagtttgatcctggctcagattgaacgctggcggcaggcttaacacatgcaagtcgaggggtaacatgattggagcttgctccgattgatgacgaccggcacacgggtgagtaacgcgtatccaacctgccccatgctcagggataaccttccgaaagggagcctaatacctgatgttgtgctttgatggcatcagacgagcacgaaagattcatcggcatgggatggggatgcgtctgattagcttgttggcggggtaacggcccaccaaggctacgatcagtaggggttctgagaggaaggtcccccacactggtactgagacacggaccagactcctacgggaggcagcagtgaggaatattggtcaatgggcgggagcctgaaccagccaagtagcgtgcaggaagacggccctacgggttgtaaactgcttttatgaggggataaagtgggctacgtgtagcttattgcaggtacctcatgaat

SEQ ID NO: 1125 - DNA, 490 bp, Unknown
  Ascusbbf_13385, encodes 16S rRNA
agagtttgatcatggctcaggacgaacgctggcggcgtgcctaacacatgcaagtcgaacggagctgctatggaagaccttcgggtcggaagtttcagcttagtggcgaacgggtgagtaacgcgtgagcaacctgcctttcagagggggacaacggttggaaacgaccgctaataccgcatgaagcaatttgaccgcatgatcgaattgccaaagatttatcgctgaaagatgggctcgcgtctgattagatagttggtggggtaacggcctaccaagtcaacgatcagtagccggactgagaggttgaacggccacattgggactgagatacggcccagactcctacgggaggcagcagtggggaatattgggcaatgggggaaaccctgacccagcaacgccgcgtgaaggaagaaggctttcgggttgtaaacttcttttaccgaggacgaagaacgtgacggtactcggagaaaaagccacggct

SEQ ID NO: 1126 - DNA, 490 bp, Unknown
  Ascusbbf_50295, encodes 16S rRNA
agagtttgatcctggctcaggatgaacgctagctacaggcttaacacatgcaagtcgaggggcatcaggacggcagcttgctgccgttgctggcgaccggcgcacgggtgcgtaacgcgtgtccaacctaccccgggctcagggacagcccatcgaaagatggattaatacctgatgatgtgtctgcgccgcctggcgcagtcacgaaagattcatcggcccgggatggggacgcgtccgattagctagacggcggggtaacggcccaccgtggcgacgatcggtaggggttctgagaggaaggtcccccacactggaactgagacacggtccagactcctacgggaggcagcagtgaggaatattggtcaatggtcgtaagactgaaccagccaagtagcgtgagggaagactgccctatgggttgtaaacctcttttgttcgggaataaccggtcccacgcgtggggccctgcatgtaccgttcgaat

SEQ ID NO: 1127 - DNA, 490 bp, Unknown
  Ascusbbf_16928, encodes 16S rRNA
agagtttgatcctggctcaggatcaacgctggcggcgtgcctaatgcatgcaagtcgaacggggttcacttcggtggacttacgtggcggacgggtgaggagcacgtgggcaacctgccctttggtggaggataaccgctggaaacagtgggtaatactgcatgagacattctgacgagtgggttggaatgggaaagccgagaggcgccgaaggaggggcctgcgtccgattagctagacggtggggtaacggcctaccgtggcagtgatcggtagctggtttgagaggatgatcagccacacggggactgagacacggccccgactcctacgggaggcagcagcaaggaattttccgcaatgggcgaaagcctgacggagcaacgccgcgtgtgggatgacgcttttcggagtgtaaaccactgttcgtggggacgaagcactgacggtacccacggaggaaggcccggctaactacgtgccagcagcc

SEQ ID NO: 1128 - DNA, 488 bp, Unknown
  Ascusbbf_18672, encodes 16S rRNA
agagtttgatcatggctcagaacgaacgctggcggcatggattaggcatgcaagtcgaacgaggcagcaatgccgagtggcggaagggtgaggaacgcgtgagtaatctgccctcaagttgggaataacagctggaaacggctgctaataccgaatgtggctgttgtaccgcatggtgtgacagttaaagatttattgcttgaggatgagctcgcgtcccattagttagttggcggggcaacggcccaccaagacgatgatgggtagctggtctgagaggatggtcagccacactgggactgagacactgcccagactcctacgggaggctgcagtcgagaatcttgggcaatgcgcgaaagcgtgacccagcaatgccgcgtgtgtgatgaaggtcttcggattgtaaagcactgtctcccgggacgaaagatgacggtaccggggaaggaagccacggctaactacgtgccagcagccgcggtaat

SEQ ID NO: 1129 - DNA, 490 bp, Unknown
  Ascusbbf_21588, encodes 16S rRNA
agagtttgatcatggctcagagttaacgctggctgcgtgcataacacatgcaagtcgaacggggattattggtgtagcaatacattgataattctagtggcagacgggtgagtaatacataaggaatccacctgggagcggggaataactggccgaaaggttagctaataccccataatataaggagatagcattatctctttcttaaaggtttttcacttccagacgatcttatggtctatcagctagttggtagggtaacggcctaccaaggctacgacggatagccggcctgaaagggcgaccggccacaggggcactgagacacgggccccactcctacgggaggcagcagtggggaattttggacaatggacgaaagtctgatccagcaacgcagcgtgaaggacgaaggttctcggattgtaaacttcttttgcaggggaagaaaaaaatgacggtaccctgtgaataagccacggctaactac

SEQ ID NO: 1130 - DNA, 490 bp, Unknown
  Ascusbbf_51570, encodes 16S rRNA
agagtttgatcctggctcaggatgaacgctagctacaggcttaacacatgcaagtcgaggggcagcggtagggaagcttgctttcctagccggcgaccggcgcacgggtgcgtaacgcgtatcgaacctggcccatacacggggatagtctcctgaaagggaggttaatacccggcggtcccattatgtcgcatgatgtggtgggtgaagattcatcggtatgggatggcggtgcgtaggattagctagtcggcggggtaacggcccaccgaggcgacgatccttaggggttctgagaggaaggtcccccacactggtactgagacacggaccagactcctacgggaggcagcagtgaggaatattggtcaatggccgagaggctgaaccagccaagtagcgtgcaggaagacggccctctgggttgtaaactgcttttacagcggaataaagtgtcctacgtgtaggattttgtatgtacgctgtgaat

SEQ ID NO: 1131 - DNA, 490 bp, Unknown
  Ascusbbf_76388, encodes 16S rRNA
agagtttgatcatggctcagaacgaacgctggcggcaggcctaacacatgcaagtcgagcgtgaaaggggacttcggttcccgagtaaagcggcgcacgggtgagtaacacgtgaataatctgcccttgtgaccgggataacagatcgaaagaactgctaataccggataagcttccacatcaaccgggtgcgggggaaaagtgcgggaccttcgggccgcacgcatgaggatgagttcgcgtcccattagatagttggtgaggtaatggctcaccaagtcgacgatgggtagctggtctaagaggatgatcagccacactggaactgagacacggtccagactcctacgggaggcagcagtggggaatcttgcgcaatggaggaaactctgacgcagccatgccgcgtgagtgatgaaggccctcgggttgtaaagctctgtctaaggggacgaacggctctgtaaacaagagatgcagagattgacgg

SEQ ID NO: 1132 - DNA, 490 bp, Unknown
  Ascusbbf_79836, encodes 16S rRNA
agagtttgatcatggctcaggacgaacgctggcggcgtgcttaacacatgcaagtcgaacgaggttaatttgaggaagtcttcggatggaatcggattaaccgagtggcggacgggtgagtaacgcgtgagcaacctgtcttctacagggggataacactccgaaaggagcgctaataccgcataggaccacagcatcacatggtgcaggggtgaaaggagtaatccggtagaaggtgggctcgcgtcccattagatagttggtgaggtaacggctcaccaagtcgacgatgggtagccgacctgagagggtgatcggccacattggaactgagatacggtccagactcctacgggaggcagcagtggggaatattgggcaatgggcgcaagcctgacccagcaacgccgcgtgagggaagaaggtcttcgggttgtaaacctctgtccttggtgaaaaggaaggatggtagccaaggaggaagccccgg

SEQ ID NO: 1133 - DNA, 490 bp, Unknown
  Ascusbbf_22541, encodes 16S rRNA
agagtttgatcatggctcaggattaacgctggcggcatgcctaatacatgcaagtcgaacggagtaattgagtagcttgctacgagattacttagtggcggacgggtgagtaacgcgtgaacaatctgcccataagaggggtataacacttagaaataggtgctaataccgcataatactacgaggtggcatcattttgtagtcaaaggagcaatccgcttatggatgagtttgcgtatcattagctagttggtagggtaacggcctaccaaggccacgatggttagccggcctgagagggtgaacggccacattggaactgagatacggtccagactcctacgggaggcagcagtaaggaatattgggcaatgggcgaaagcctgacccagcaatgccgcgtgaaggatgaaggtcttcggattgtaaacttctaaaaacagggaaaaaaacaatgatggtacctgtagataagtcacggcaaactatg

SEQ ID NO: 1134 - DNA, 490 bp, Unknown
  Ascusbbf_61006, encodes 16S rRNA
agagtttgatcatggctcaggatgaacgctggcggcaggcttaatacatgcaagtcgaacggtaaggcccgaggtggcaacactgagggtacacgagtggcgcacgggtgcgtaacgcgtatgcaatctgcccggcacagggacaaaacaccgggaaactggtgctaatattccatggtcaccggagggggcatcccttttggtgtaaagattcatcggtgccggatgagcatgcgtattattaggtagttggtggggtaacggcccaccaagccgacgatgattaggggtcctgagagggttaacccccacactggaactgagacacggtccagactcctacgggaggcagcagtagggaatattgggcaatggaggcaactctgacccagccatgccgcgtgaaggaagacggccctatgggttgtaaacttcttttgccgcagagtaagcccggtcacgcgtggtcggttgagagtatgcggcgaat

SEQ ID NO: 1135 - DNA, 490 bp, Unknown
  Ascusbbf_783800, encodes 16S rRNA
agagtttgatcctggctcaggacgaacgctggcggcgtgcctaacacatgcaagtcgaacgagaatttattaattgatttcttcggaatgattttgataaaggaaagtggaggacgggcgagtaacgcgtgaataacctgcccataagagggggataatccatggaaacgtggactaataccgcatattgaagttttatcgcatggtgagactttgaaagattttatcgcttatggatggattcgcgtcagattagctagttggtgaggtaacggctcaccaaggcgacgatctgtagccgaactgagaggttgatcggccgcattgggactgagacacggcccagactcctacgggaggcagcagtggggaatattgcgcaatgggggcaaccctgacgcagcaacgccgcgtgcaggaagaaggtcttcggattgtaaactgttgtcgcaagggaagaagaaaatgacggtacctgactaagaagccc

SEQ ID NO: 1136 - DNA, 490 bp, Unknown
  Ascusbbf_210563, encodes 16S rRNA
agagtttgatcctggctcaggatgaacgctggcggcatgcctaagacatgcaagtcgaacgaggtggcccattgaaggatgcgtgcttgcacaaatttggatttggattaccacctagtggcagacgggtgagtaacacgtgggtgacctacctttaagctggggataacagttggaaacgattgctaataccgaataatgtataactgtcatggttatactgaaaggagcctttaaagcttcacttagagatgggcctgcggcgtattaactagttggtggggtaacggcctaccaaggtgacgatgcgtagccgaactgagaggttgatcggccacactgggactgagacacggcccagactcctacgggagacagcagttagggatattcgtcaatgggggaaaccctgaacgagcaatgccgcgtgagtgatgaaggtctttggattgtaaaactctgttgtatggaaaaaacggctaggttagga

SEQ ID NO: 1137 - DNA, 490 bp, Unknown
  Ascusbbf_1870650, encodes 16S rRNA
agagtttgatcctggctcaggatgaacgctggcggcgtgcttaacacatgcaagtcgaacgaagcacacctgcggaagttttcggatggaagcgggtatgacttagtggcggacgggtgagtaacgcgtgggcaacctgccgtatgcagggggacaacagctggaaacggctgctaataccgcataagcgcacggtaccgcatggtgcagtgtgaaaagatttatcggcatacgatgggcccgcgttggattaggcagttggcgaggtaacggcccaccaaaccgacgatccatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaagatgacggtacctgcacaagaagccccggct

SEQ ID NO: 1138 - DNA, 490 bp, Unknown
  Ascusbbf_52519, encodes 16S rRNA
agagtttgatcatggctcagagtgaacgctggcggcgtggctaagacatgcaagtcgagcgagaaggtgccttcgggtaccggaaagcggcaaacgggtgcgtaacacgtaagtaacctgcccttaagacgggaacagcttgatgaaaattaagataatgcccgatatccgcttctttcgcatgagagaggtcggaaaggtttgtgatgacgcttaaggaggggcttgcggcctatcagcttgttggcggtgtgaaagaccaccaaggcaaagacgggtagccggtctgagaggatggacggccacattggaactgagatacggtccaaacacctacgggtggcagcagtttcgaatcattcacaatgggcgaaagcctgatggtgcgacgccgcgtggaggatgaaggtcttcggattgtaaactcctgtcgtcagggagcaaaaagtcggtgaagaatcgaccttgagttaacttgaagaggaagcag

SEQ ID NO: 1139 - DNA, 490 bp, Unknown
  Ascusbbf_15917, encodes 16S rRNA
agagtttgatcatggctcaggacgaacgctggcggcgtgcctaacacatgcaagtcgaacggactgattcgcttcggtgatgaaagtcagtggcggacgggtgagtaacgcgtgagtaacctgcctttcagagggggataacgttttgaaaagaacgctaataccgcataacgcaaagttgtcgcatggcagttttgccaaaggagcaatccgctgagagatggactcgcgtccgattagatagttggcggggtaacggcccaccaagtcgacgatcggtagccggactgagaggttgatcggccacattgggactgagacacggcccagactcctacgggaggcagcagtgagggatattgcacaatgggcgaaagcctgatgcagcaacgccgcgtgagggatgacggtcttcggattgtaaacctctgtcttcagtgaagaaacatgacattagctgaggaggaagccacggctaactacgtgccag

SEQ ID NO: 1140 - DNA, 490 bp, Unknown
  Ascusbbf_102031, encodes 16S rRNA
agagtttgatcatggctcaggatgaacgctggcggcaggcttaatacatgcaagtcgaacggtaaggccgagcgtagcaatacgtgaggtacacgagtggcgcacgggtgcgtaacgcgtatgcaacctgcccccaaccgggacaaaacagctggaaacggctgctaatatcccatggtcactcgaggtggcatcaccatgagtgtaaagattcattggttggggatgggcatgcgtattattaggtagttggcggggtaacggcccaccaagccgacgatgattaggggttctgagaggattaacccccacactggaactgagacacggtccagactcctacgggaggcagcagtagggaatattgggcaatggaggcaactctgacccagccatgccgcgtgaaggaagacggccctatgggttgtaaacttcttttgccgcagagtaaacgcggggacgtgtccccgtttgagagtatgcggcgaat

SEQ ID NO: 1141 - DNA, 490 bp, Unknown
  Ascusbbf_71511, encodes 16S rRNA
agagtttgatcatggctcagaacgaacgctggcggcgcgtcttaagcatgcaagtcgagcggtaagatagtagcttgctattatcctagagcggcggactggtgagtaacgcgtgggtgacgtaccctttggacggggatagcctgtggaaacacagggtaataccggatacggtcgcatatgtcagaggtatgcgaggaaaggttcttttgaaccgccgaaggagcggcccgcgtgctattagttagttggcggggtaacggcccaccaagacgacgatagctacccggcctaagagggtgaacgggcacattgggactgagatacggcccagactcctacgggaggcagcagctaagaatattccgcaatggacgaaagtctgacggagcgacgccgcgtggatgatgaaggccggaaggttgtaaaatccttttggaagcgaggaataattaaagtgagagaaacgctttgaggtgacggtagcttc

SEQ ID NO: 1142 - DNA, 490 bp, Unknown
  Ascusbbf_195990, encodes 16S rRNA
agagtttgatcctggctcaggacgaacgctggcggcgtgcttaacacatgcaagtcgagcggagatgtgatcacagagggcttcggtccaaagcgatcatatttcagcggcggacgggtgagtaacgcgtgaatgatctgtctcttacagggggataacacttggaaacaggtgctaataccgcataagaccacactgctgcatggcagaggggtaaaaggagcgatccggtaagaggtgagttcgcgtccgattagctggttggtgaggtaacggcccaccaaggcgacgatcggtagccgacctgagagggtgatcggccacattggaactgagagacggtccaaactcctacgggaggcagcagtgggaatattgggcaatgggcgaaagcctgacccagcaacgccgcgtgagtgaagaaggttttcggattgtaaagctctgtccttggggacgaaggaagtgacggtacccgaggaggaagccc

SEQ ID NO: 1143 - DNA, 490 bp, Unknown
  Ascusbbf_140516, encodes 16S rRNA
agagtttgatcatggctcaggacgaacgctggcggcgtgcttaacacatgcaagtcgaacgaggatatatcgcggaagtcttcggacggaagggacatattcgagtggcggacgggtgagtaacgcgtgagcaacctgtcttacacagggggataacactccgaaaggagcgctaataccgcataagaccacgatatcgcatggtattgaggtaaaaggaggaatccggtgtaaggtgggctcgcgtcccattagatagttggcagggtaaaggcctaccaagtcgacgatgggtagccgacctgagagggtgatcggccacattggaactgagatacggtccagactcctacgggaggcagcagtggggaatattgggcaatgggcgaaagcctgacccagcaacgccgcgtgagggatgaaggtcttcgggttgtaaacctctgtcctaagtgaaaaggaaggatggtagcttaggaggaagctccgg

SEQ ID NO: 1144 - DNA, 490 bp, Unknown
  Ascusbbf_727601, encodes 16S rRNA
agagtttgatcatggctcaggatgaacgctggcggcgtgcctaacacatgcaagtcgaacggggttaagcagaaattttcggatggaagcttaacttagtggcggacgggtgagtaacgcgtggataacctgcctcacacagggggatagcagctggaaacggctggtaataccgcataagaccacggcatcgcatgatgcagcggtaaaagatttatcggtgtgagatggatccgcgtctgattagccagttggcggggtaacggcccaccaaggcgacgatcagtagccggcctgagagggtgaacggccacattgggactgagacacggcccaaactcctacgggaggcagcagtggggaatattgcacaatgggcgcaagcctgatgcagcaacgccgcgtgagtgaagaagtatttcggtatgtaaagctctatcggcagggaagaaaggcccattaagggagatgacggtacctgactaagaag

SEQ ID NO: 1145 - DNA, 490 bp, Unknown
  Ascusbbf_56797, encodes 16S rRNA
agagtttgatcatggctcaggatgaacgctagcggcaggcttaacacatgcaagtcgaggggcagcgggtccagcaatggatgccggcgaccggcgaaagggtgagtaacgcgtgagcaacatgcccgacactgggggatagtcattggaaacgatgcgtaataccccgtaacacaagggaccgcatgatcctttgttgaaagattcattggtgtcggattggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggatgacggccctatgggttgtaaaccgcttttgccggggagcaataaggcccacgcgtgggccgacgagagtacccggcgaataagcatc

SEQ ID NO: 1146 - DNA, 490 bp, Unknown
  Ascusbbf_94410, encodes 16S rRNA
agagtttgatcctggctcaggatgaacgctggcggcgtgcttaacacatgcaagtcgaacggagctttttttgaaggagacttcggtcaacggaagctaaagcttagtggcggacgggtgagtaacgcgtgagtaacctgcctttcagagggggataacatccggaaacggatgctaataccgcataaaacagcagcaccgcatgatgcaactgtcaaagattttatcgctgaaagatggactcgcgtccgattaggtagttggtgaggtaacggcccaccaagccgacgatcggtagccggactgagaggttgaacggccacattgggactgagacacggcccagactcctacgggaggcagcagtggggaatattgcacaatgggcgcaagcctgatgcagcaacgccgcgtgagggaagacggttttcggattgtaaacctctgttcttagtgacgaagaagtgacggtagctaaggagcaagccac

SEQ ID NO: 1147 - DNA, 490 bp, Unknown
  Ascusbbf_139627, encodes 16S rRNA
agagtttgatcatggctcaggatgaacgctggcggcgtgcctaatacatgcaagtcgaacgagagtgcttgcactcgagtggcgaacgggtgagtaacacgtaggtaacctgccttacagtttgggatacccgagggaaaccttggctaataccgaataattcttttggaggcatctccgaaagctaaaaggggcctttaaagcctcgctgaaagatggacctgcggcgcattagctagttggtgagataacagcccaccaaggcgaggatgcgtagccgacctaagagggtgaacggccacactggaactgagacacggtccagactcctacgggaggcagcagtagggagttttcggcaatgggggaaaccctgaccgagcaacgccgcgtgaacgatgaaggtcttcggattgtaaagttctgttataagggaagaatgatagcttgaggaaatgctagttatttgacggtaccttattagaaagcc

SEQ ID NO: 1148 - DNA, 470 bp, Unknown
  Ascusbbf_53234, encodes 16S rRNA
agagtttgatcctggctcagaacgaacgctggcggaatgcctaacacatgcaagtcgaacgagaccttcgggtctagtggcgcacgggtgagtaacgcgtgggaatctgccttggggtacggaataactcagggaaacttgagctaataccgtatgatgtcgagagaccaaagatttatcgccctgagaggagcccgcgtcggattagcttgttggtggggtaacggcctaccaaggcgacgatccgtagctggtctgagaggatgatcagccacactgggactgagacacggcccagactcctacgggaggcagcagtggggaatattggacaatgggcgcaagcctgatccagcaattccgcgtgagcgaagaaggccttcgggttgtaaagctctttcggcggggacgataatgacggtacccgcagaagaagccccggctaactccgtgccagcagccgcggtaat

SEQ ID NO: 1149 - DNA, 490 bp, Unknown
  Ascusbbf_324435, encodes 16S rRNA
agagtttgatcatggctcaggatgaacgctggcggcgtgcctaacacatgcaagtcgaacggggatatgtcggaatgagacttcggttgaaggaagacacatcttagtggcggacgggtgagtaacgcgtggagaacctgcctcatactgggggataccagtgagaaatcactgctaaaaccgcataagcgcacggtaccgcatggtacagtgtgaaaaactccggtggtatgggatggctccgcgttggattagccagttggcggggtaacggcccaccaaagcgacgatccatagccggcctgagagggtggacggccacattgggactgagacacggcccagactcctacgggaggcagcagtggggaatattgcacaatggggggaaccctgatgcagcgacgccgcgtgaaggaagaagtatttcggtatgtaaacttctatcgacagggaagatgatgacggtacctgagtaagaagccccggc

SEQ ID NO: 1150 - DNA, 490 bp, Unknown
  Ascusbbf_249930, encodes 16S rRNA
agagtttgatcatggctcaggacgaacgctggcggcgtgcctaatacatgcaagtggaacgcaacttttcatccgtttcttcggaaacatctgagaagttgagtcgcgaacgggtgagtaacgcgtaggtaacctgcctgatagcgggggataactattggaaacgatagctaataccgcataagagctttagtggcatcattggagcttaaaaggagcaactgcttcactatcagatggacctgcgttgtattagctagttggtggggtaaaggcctaccaaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgtgtgagagagtggaaagttctcacagt

SEQ ID NO: 1151 - DNA, 490 bp, Unknown
  Ascusbbf_174834, encodes 16S rRNA
agagtttgatcctggctcaggatgaacgctagctacaggcttaacacatgcaagtcgaggggcagcatgatttgtgcttgcacagattgatggcgaccggcgcacgggtgagtaacgcgtatccaacctgccccatggtcggggacagcccggcgaaagtcggattaacccccgatgttgtccgaagaaggcatctgatttggacgaaaggtgacgccatgggatggggatgcgtaggattaggcaggcggcggggcgacggcccaccgcgccgacgatccttaggggttctgagaggaaggtcccccacactggtactgagacacggaccagactcctacgggaggcagcagtgaggaatattggtcaatgggcggaagcctgaaccagccaagtagcgtgcaggaggacggccctacgggttgtaaactgcttttatgcggggataaaggagggcacgcgtgcccttttgcaggtaccgcatgaataa

SEQ ID NO: 1152 - DNA, 490 bp, Unknown
  Ascusbbf_289009, encodes 16S rRNA
agagtttgatcatggctcaggatgaacgctggcggcgtgcataacacattcaagtcgaacgaagcatacggaatgaagttttcggatggaatgaagtatgacttagtggcggacgggtgagtaacgcgtgagcaaccttcctgcctgtgagggataacacagggaaacttgtgctaataccgcatgaagcataattatcgcatggtagatatgccaaagatatattgcaggcagatgggctcgcgtctgattagatagttggcagggtaacggcctaccaagtcgacgatcagtagccggactgagaggttgaacggccacattggaactgagagacggtccagactcctacgggaggcagcagtggggaatattgggcaatgggcgaaagcctgacccagcgacgccgcgtgagggaagaaggtcttcggattgtaaacctctttcagcaaggaagaagaaagtgacggtacttgcagaagaagccacg

SEQ ID NO: 1153 - DNA, 358 bp, Unknown
  Ascusbbf_689583, encodes 16S rRNA
agagtttgatcctggctcaggatgaacgctagctacaggcctaacacatgcaagtcgaggggcagcatggagcttgcttgcaagctctgatggcgaccggcaaatgggtgagtcacgcgtgtccaacctgccccgcgcccggggatagcccttggaaatgaggattaagacccgatacgtgcgttgtccgcatggacgtcgcatgaaaccaggcacgggatggggacgcgtcggattagcttgacggcggggcaacggcccaccgtggcgacgatccgcaggggttctgagaggaaggtcccccacactggcactgagacacgggccagactcctacgggagccagcagccgcggtat

SEQ ID NO: 1154 - DNA, 490 bp, Unknown
  Ascusbbf_204435, encodes 16S rRNA
agagtttgatcctggctcaggataaacgctggcggcgcacataagacatgcaagtcgaacgaacttaatcttttagtttactattagaagcggttagtggcggactggtgagtaacgcgtaagcaatctgcctatcagaggggaacaacagtgagaaatcactgctaataccgcatatgctgtgagtacggcatcgtacaaacaggaaaggagcaatccgctgatagatgagcttgcgtctgattaacttgttggtgaggtaacggcccaccaaggtgatgatcagtagccggactgagaggttaaacggccacattgggactgagatacggcccagactcctacgggaggcagcagtcgggaatattgcgcaatggaggaaactctgacgcagtgacgccgcgtgcaggatgaaggttttcggattgtaaactgctttagatagggaagaaaaaaatgacggtacctatagaataagctccggctaact

SEQ ID NO: 1155 - DNA, 490 bp, Unknown
  Ascusbbf_66361, encodes 16S rRNA
agagtttgatcatggctcaggatgaacgctggcggcgtgcctaatacatgcaagtcgagcgagaatctctgacatgacacttcggttgattgaaggggaggacagcggcggacgggtgagtaacgcgtaggcaacctgcccccggcagagggatagccattggaaacgatgattaaaacctcataacgcttttatgacacatgtcatgaaagccaaagatttatcggctggggatgggcctgcgtctgattaactagttggtgaggtaacggctcaccaaggtgacgatcagtagccgacctgagagggtgatcggccacattggaactgagacacggtccaaacttctacggaaggcagcagtagggaattttgcacaatgggggaaaccctgatgcagcaacgccgcgtgaaggatgaaggccttcgggttgtaaacttcttttctcggggaagaagatctgacggtacctgaggaacaagccccggc

SEQ ID NO: 1156 - DNA, 490 bp, Unknown
  Ascusbbf_109626, encodes 16S rRNA
agagtttgatcatggctcaggacgaacgctggcggcgtgcttaacacatgcaagtcgaacggaaaggccccttcgggggtactcgagtggcgaacgggtgagtaacacgtgggtgatctgccctgcactttgggataagcctgggaaactgggtctaataccgaataggaccacgcgcctcatggtgtgtggtggaaagcttttgcggtgtgggatgggcccgcggcctatcagcttgttggtggggtaatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagtatcggcgaagctccagagttttctttggggtgacggtaggtacagaagaagcaccggcca

SEQ ID NO: 1157 - DNA, 490 bp, Unknown
  Ascusbbf_105285, encodes 16S rRNA
agagtttgatcatggctcaggatgaacgctggcggcgtgcctaatacatgcaagtcgaacgagggtgcttgcaccctagtggcgaacgggtgagtaacacgtaggtaacctgccctttagcttgggatacccagaggaaactttggctaataccggataacaacagatgaggcatctcaactgtttgaaaggccctttcgggtcactaaaggatggacctgcggcgcattagctagttggtgagataacagcccaccaaggcgaggatgcgtagccgaactgagaggttgatcggccacatggaaactgagacacggttccaactcctacgggaggcagcagtaaggagttttcggcaatgggggaaaccctgaccgagcaacgccgcgtgagtgatgacggccctatgggttgtaaagctcttttattagagacgaatggcgggattaggaaatgaatcccgtttgacggtatcttttgaataagccac

SEQ ID NO: 1158 - DNA, 490 bp, Unknown
  Ascusbbf_485682, encodes 16S rRNA
agagtttgatcatggctcaggacgaacgctggcggcgtgcctaacacatgcaagtggagcgacgaaccggggcttgccccggggcagagccgcgaacgggtgagtaacacgtgggttacctgccccgatgaccgggacaacccgtcgaaagacgggctaataccggatgtgccccttgggggaaaggaagcttcggcctccgcatcgggatgggcccgcggcgcattagctagttggtgaggtaatggcttaccaaggcgacgatgcgtagctggtctgagaggacgatcagccacactgggactgagacacggcccagactcctacgggaggcagcagtggggaatcttgcacaatgcgcgaaagcgtgatgcagcaacgccgcgtgcgggaagaaggccttagggttgtaaaccgctttcagttgggacgaagcttcgtgagttaatagctctttgaagtgacggtaccttcagaagaagcgccggct

SEQ ID NO: 1159 - DNA, 490 bp, Unknown
  Ascusbbf_136220, encodes 16S rRNA
agagtttgatcatggctcaggatgaacgctagctacaggcttaacacatgcaagtcgaggggcagcatgacgagagcttgctcttgttgatggcgaccggcgcacgggtgcgtaacgcgtatccaacctgccgtttacccggggacagccttgcgaaagtaagattaatacccgatgttgtgcggaatccgcatggtttttgcaccaaaggttcattccggtaagcgatggggatgcgtacgattagctagtcggcggggtgacggcccaccgaggcgacgatcgttaggggttctgagaggatggccccccacactggtactgagacacggaccagactcctacgggaggcagcagtgaggaatattggtcaatgggcgcgagcctgaaccagccaagtagcgtgcaggaggactgccttacaggttgtaaactgcttttatgcgggggtaaagtttggcacgtgtgccattttgcaagtaccgcatga

SEQ ID NO: 1160 - DNA, 490 bp, Unknown
  Ascusbbf_102404, encodes 16S rRNA
agagtttgatcatggctcaggacgaacgctggcggcacgcttaacacatgcaagtcgaacggagtttatcattaagcttgcttagagataaacttagtggcggacgggtgagtaacacgtgagcaatctgcctttcagagggggatagcagttggaaacgactgataataccgcataacataacgaagccgcatgactttgttatcaaagattttatcgctgaaagatgagctcgcgtctgattagctagttggtgaggtaacggctcaccaaggcgacgatcagtagccggactgagaggttgaacggccacattgggactgagacacggcccagactcctacgggaggcagcagtggggaatattgcacaatggaggaaactctgatgcagcgatgccgcgtgagggaagaaggttttcggattgtaaacctctgtcttaggggacgagaaaggacggtaccctaggaggaagctccggctaactacg

SEQ ID NO: 1161 - DNA, 488 bp, Unknown
  Ascusbbf_132971, encodes 16S rRNA
agagtttgatcatggctcaggattaacgctggcggcgtgcctaatacatgcaagtcggatggtagcaataccatggcgaacgggtgagtaacacgtaggtaacctgtcattaagacgagaataaccattggaaacgatggataatgctggataggatatttaagggcatcctagaatatttaaagatttatcacttaatgaggggcctgcggcgcattagctagttggaaaggtaaaagcttaccaaggcgatgatgcgtagccggactgagaggttgaacggccacaatggaactgagaacggtccatactcctacgggaggcagcagtagggaattttcggcaatgggcggaagcctgaccgagcaacgccgcgtgatcgatgaagtatttcggtatgtaaagatcttttattagggaagaaaagacagattgacggtacctaatgaataagctccggctaactacgtgccagcagccgcggtaat

SEQ ID NO: 1162 - DNA, 490 bp, Unknown
  Ascusbbf_154354, encodes 16S rRNA
agagtttgatcctggctcaggatgaacgctagcggcaggcctaacacatgcaagtcgaggggtatttggagcttgctccaaagagaccggcgcacgggtgcgtaacgcgtatgcaatctgccttgtactgagggatagcccggagaaatccggattaatacctcatgtgatatatagatagccttatttatatattaaagatttatcggtacaagatgagcatgcgtcccattagctagttggtatggtaacggcataccaaggcaatgatgggtaggggtcctgagagggagatcccccacactggtactgagacacggaccagactcctacgggaggcagcagtgaggaatattggtcaatggacggaagtctgaaccagccatgccgcgtgcaggacgacgcatctatggtgtgtaaactgcttttatacgggaagaaacctctctacgcgtagagacttgacggtaccgtaagaataaggatcggc

SEQ ID NO: 1163 - DNA, 490 bp, Unknown
  Ascusbbf_182999, encodes 16S rRNA
agagtttgatcatggctcaggacgaacgctggcggcgtgcctaacacatgcaagtcgagcgaagcaatttggaagggagacttcggtcgaacggaaggattgactgagcggcggacgggtgagtaacgcgtgagcaacctggcctttacagggggataacagttggaaacgactgctaataccgcataagaccacgatacggcatcgtaaagaggtcaaagatttatcggtaaaggatgggctcgcgtcccattagcttgttggcggggtaacggcccaccaaggcaacgatgggtagccgacctgagagggtgatcggccacattggaactgagacacggtccaaactcctacgggaggcagcagtggggaatattgggcaatgggcgaaagcctgacccagcaacgccgcgtgaaggaagaaggtcttcggattgtaaacttttgttgtcagtgaagaggaaggacagtagctgacgaggaagccccg

SEQ ID NO: 1164 - DNA, 490 bp, Unknown
  Ascusbbf_483690, encodes 16S rRNA
agagtttgatcatggctcagaacgaacgctggcggcgcgtcttaagcatgcaagtcgagcgtgattgaatagcttgctattcatgaaagcggcggactggtgagtaacgcgtgggtgacgtaccctttggatggggatagctcctagaaataggagataataccgaataagctgcatgttgtcagaggacatgcaggaaaggaacatatgttccgccgaaggagcggcccgcgagctattagctagttggtgaggtaacggcccaccaaggcgacgatagctacccggcctaagagggtgaacgggcacattgggactgagatacggcccagactcctacgggaggcagcagctaagaatattccgcaatggacgaaagtctgacggagcgacgccgcgtggacgaggaaggccggaaggttgtaaagtccttttatatgtggagaataagcaggggagtggaaagcccctgtggtgactgtagcatatg

SEQ ID NO: 1165 - DNA, 490 bp, Unknown
  Ascusbbf_143387, encodes 16S rRNA
agagtttgatcctggctcaggatgaacgctggcggcgcgcctaacacatgcaagtcgaacgatgaaaatatcttcggatattggattagtggcgaacgggtgagtaacgcgtgggcaacctaccctcaactcagggatagcaaagggaaacttttggtaatacctgataacctcaaaataagacatctttttttgagcaaagatttatcggttgaggatgggcccgcgtcccatcagctagatggcggggttaaagcccaccatggcaattacgggtagccggactgagaggtcgatcggccacattgggactgagacacggcccagactcctacgggaggcagcagtggggaatattgcgcaatgggggaaaccctgacgcagcgacgccgcgtgcgggatggaggccttcgggctgtgaaccgctttcggtggggaggatacaagaccgtacccacataagaagccccggctaactacgtgccagcag

SEQ ID NO: 1166 - DNA, 490 bp, Unknown
  Ascusbbf_307259, encodes 16S rRNA
agagtttgatcatggctcaggatgaacgctggcggcgtgcttaacacatgcaagtcgaacgaggcttgtcatcggaagttttcggatggaagaaggcaagaccgagtggcggacgggtgagtaacgcgtggggaacctgccccattccgggggataccagttggaaacgactgttaataccgcataagcgcacggcatcgcatgatgcagtgtgaaaaaccacggtggaatgggatggccccgcgtctgattagccagttggcagggtaacggcctaccaaagcgacgatcagtagccggcctgagagggcgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaagatgacggtacctgcacaagaagccccggct

SEQ ID NO: 1167 - DNA, 490 bp, Unknown
  Ascusbbf_439900, encodes 16S rRNA
agagtttgatcatggctcaggacgaacgctggcggcgtgcctaacacatgcaagtcgaacgaagcatcttgcccgacaaagaggagagcttgctcaaatcggagtcaattaagatgacttagtggcggacgggtgagtaacgcgtgggtaacctgcctcacacagggggataacagttagaaatgactgctaataccgcataagcgcacactatcgcatgatagagtgtgaaaaactctggtggtgtgagatggacccgcgtctgattagccggttggcagggtaacggcctaccaaagcaacgatcagtagccggcctgagagggtgaacggccacattgggactgagacacggcccaaactcctacgggaggcagcagtgggggatattgcacaatgggggaaaccctgatgcagcgacgccgcgtgagtgatgaagtatctcggtatgtaaagctctatcagcagggaagaaaatgacggtacctga

SEQ ID NO: 1168 - DNA, 490 bp, Unknown
  Ascusbbf_913692, encodes 16S rRNA
agagtttgatcatggctcaggatgaacgctggcggcgtgcttaacacatgcaagtcgaacgggcttaagactgaagcttgctttggtcttaagttagtggcggacgggtgagtaacgcgtgggtaacctaccctgtgcagggggatagcagctggaaacggctgataaaaccgcataacacggtagcaccgcatggtgcagccgtcaaatatttataggcacaggatgggcccgcgtctgattagctagttggcggggcaacggcccaccaaggcgacgatcagtagccggcctgagagggtgaacggccacattgggactgagacacggcccaaactcctacgggaggcagcagtggggaatattggacaatgggggaaaccctgatccagcgacgccgcgtgagtgaagaagtatttcggtatgtaaagctctatcagcagggaagatgatgacggtacctgactaagaagcaccggctaaatacgtg

SEQ ID NO: 1169 - DNA, 490 bp, Unknown
  Ascusbbf_1185816, encodes 16S rRNA
agagtttgatcatggctcaggatgagcgctggcggcgtgcctaatacatgcgagtcgaacgagggtgcttgcaccctagtggcgaacgggtgagtaacacgtaggtaacctgccctttagtttgggatacccagaggaaactttggctaataccgggtaacaacagacgaggcatctcgactgtttgaaaggccctttcaagggtcgcttaaggatggacctgcggcgcattagctagttggtgagataacagcccaccaaggcgaggatgcgtatccgatctgagaggatgaccggacacattggaactgagacacggtccaaactcctacgggaggcagcagtaaggagttttcggcaatgggggaaaccctgaccgagcaacgccgcgtgagtgatgacggccctatgggttgtaaagctcttttataagggacgaatgatctgcttaggaaatgaggcggatttgacggtaccttttgaataagcc

SEQ ID NO: 1170 - DNA, 159 bp, Unknown
  Ascusbbf_149490, encodes 16S rRNA
agagtttgatcctggctcagcagccgcggtaatgccagcagccgcggtaatgccagcagccgcggtaatgccagcagccgcggtaatgccagcagccgcggtaatgccagcagccgcggtaatgccagcagccgcggtaatgccagcagccgcggtaat

SEQ ID NO: 1171 - DNA, 490 bp, Unknown
  Ascusbbf_138483, encodes 16S rRNA
agagtttgatcatggctcaggatgaacgctggcggcgtgcctaacacattcaagtcgaacggtgaagggacttcggtcccggatcagtggcggacgggtgagtaacgcgtgagcaacctgcctctgactgggggataacagccggaaacggctgctaataccgcataacgtgcgaccttcgcatgaaggacgcaccaaagatttatcggtcagagatgggctcgcgtctgattagatagttggtgaggtaacggcttaccaagtctgcgatcagtagccggactgagaggttgaacggccacattggaactgagatacggtccagactcctacgggaggcagcagtggggaatattgggcaatgggcgcaagcctgacccagcgacgtcgcgtgaaggaagaaggccctcgggttgtaaacttcagtcaacagggaagaataaatgacggtacctgtggaggaagccacggctaactacgtgccagcagc

SEQ ID NO: 1172 - DNA, 490 bp, Unknown
  Ascusbbf_240938, encodes 16S rRNA
agagtttgatcctggctcaggacgaacgctggcggcgtgctttaaacatgcaagtcgaacggagattgattgggggcttgcccttgattgatcttagtggcggacgggtgagtaacgcgtgagcaatctgcctatcacagggggacaacagttggaaacgactgctaataccgcatgaggctacaaccaggcatctggaaggagtaaaaggagttaaatctggtgatagaggagcttgcgtctcattagctagttggtgaggtaacggcccaccaaggcgacgatgagtagccgatctgagaggatgaccggccacactggaactgagaaacggtccagactcctacgggaggcagcagttaggaatattgggcaatggagggaactctgacccagcaacgccgcgtgaaggaagaaggttttcggattgtaaacttctgatctaggggaaaaagaaagtgatggtaccctaggagaaagccacggctaa

SEQ ID NO: 1173 - DNA, 490 bp, Unknown
  Ascusbbf_235794, encodes 16S rRNA
agagtttgatcctggctcaggatgaacgctggcggcgtgcttaacacatgcaagtcgaacgaatttctttcggaacgaagcttcggccaagggaagagagaagtgagtggcggacgggtgagtaacgcgtgggtaacctgcctcacattgggggataccagtcggaaacgactgctaaaaccgcataagaccacggtatcgcatgatactgaggccaaaactccggtgatgtgagatggacccgcgtctgattagccagttggcggggtaacggcccaccaaagcgacgatcagtagccgacctgagagggtgatcggccacattgggactgagacacggcccaaactcctacgggaggcagcagtggggaatattgcacaatgggggaaaccctgatgcagcgacgccgcgtgagtgatgaagtatttcggtacgtaaagctctatcagcaggaacgatcatgacggtacctgactaagaagcaccggc

SEQ ID NO: 1174 - DNA, 490 bp, Unknown
  Ascusbbf_433933, encodes 16S rRNA
agagtttgatcctggctcaggatgaacgctggcggcgtgcctaacacatgcaagtcgagcgagaagtgagtcagctgatgcttcggttgacgcagactcatggacagcggcggacgggtgagtaacgcgtgggcaacctgcccctttccggaggatagccaagggaaactttgaataatactccatgatgcgttcggatcacatggtctgaatgccaaagatttatcggagagggatgggcccgcgtctgattagccagttggtgaggtagcggctcaccaaagcgacgatcggtagccggcctgagagggtgaacggccacattggaactgagacacggtccagactcctacgggaggcagcagtggggagtattgcacaatgggcggaagcctgatgcagcaacgccgcgtgaaggaagaaggttttcggatcgtaaacttctgtccctggggaagaaacaaatgacggtacccaaggaggaagcccc

SEQ ID NO: 1175 - DNA, 490 bp, Unknown
  Ascusbbf_246657, encodes 16S rRNA
agagtttgatcatggctcaggataaacgctggcggcatgcctaatacatgcaagtcaaacgggaagtagcaatacttctagtggcgaacgggtgagtaacacgtgggcaacctgccttgaagacgaggataacagttggaaacgactgataatactggatagtatacattaccgcatggttttgtatttaaagatgcgtttgcatcacttcaagaggggcctgcggagcattagctagttggtgaggtaacggcccaccaaggcgacgatgcttagctgcgctgagaggcgaaacagccacattgggactgagagacggcccaaactcctacgggaggcagcagtagggaattttcggcaatgggggaaaccctgaccgagcaatgccgcgtgaatgatgacggtcttcggactgtaaagttctgttgtgagggaagaactatacgattaggaaatgagtcgtatttgacggtacctcactagaaagccc

SEQ ID NO: 1176 - DNA, 490 bp, Unknown
  Ascusbbf_726938, encodes 16S rRNA
agagtttgatcatggctcagaacgaacgctggtagcgtggattaggcatgcaagtcgaacgggatccatgaagtagcaatacggattggtgagagtggcggaagggcgaggaacacgtgggcaacctgtctttgaggtggggaaaacctcgggaaactgaggctaataccgaatgtggcgcggaagggcatccttcctgcgctaaagggggcgaaagctccccctcttcgaggggctcgcgcaccatcagctagttggcggggtaacggcccaccaaggctcacggttagctggtctgagaggatggccagccgcactgggactgagatactgcccagactcctacgggaggctgcagtcgaggatcattcgcaatgggcgaaagcctgacgatgcgacgctgcgtggaggatgaaggccttcgggttgtaaactcctgtcatgagggaaaaggagaccctgcccaatacgcaggggatttgatggtacc

SEQ ID NO: 1177 - DNA, 490 bp, Unknown
  Ascusbbf_1080819, encodes 16S rRNA
agagtttgatcctggctcaggatgaacgctggcggcgtgcttaacacatgcaagtcgaacggaacttagtcaatcgaagcagagggtgcttgcacccaaagcttcgcccgattaagtttagtggcggacgggtgagtaacgcgtgagcaaccaaccttttgcagtgggacaacaattagaaatgattgctaataccgcataagaccacactaccgcatggtagagtgagaaaagctccggcggcagaagacgggctcgcgttcgattagctggatggtggggtaacggcctaccatggcgacgatcgatagccggactgagaggtcgaccggccacattgggactgagacacggcccagactcctacgggaggcagcagtggggaatattgcacaatgggggaaaccctgatgcagcgacgccgcgtgggtgatgaagtatttcggtatgtaaagcccttttagcagggaagaaaatgacggtacctgca

SEQ ID NO: 1178 - DNA, 490 bp, Unknown
  Ascusbbf_238853, encodes 16S rRNA
agagtttgatcatggctcaggatgaacgctggcggcgtgcctaacacatgcaagtcgaacgattaacccgccttcgggcggtcatagagtggcgaacgggtgagtaacacgtgaccaacctgccccccgcaccgggacaaccgctggaaacggcggctaataccgggtactccgggaaccgcgcatgcggcgcccgggagagcccaggcggcgggggatggggtcgcggcccatcaggtagtaggcggggtgacggcccacctagcccgcgacgggtagccgggttgagagaccgaccggccacattgggactgagatacggcccagactcctacgggaggcagcagtggggaattttgcgcaatgggggcaaccctgacgcagcaacgccgcgtgcgggatgacggccttcgggttgtaaaccgctttcagcagggaagacatcgacggtacctgcagaagaagccccggctaaatacgtgccagcagc

SEQ ID NO: 1179 - DNA, 490 bp, Unknown
  Ascusbbf_395341, encodes 16S rRNA
agagtttgatcctggctcaggatgaacgctggcggcgtgcataacacattcaagtcgaacggactcaggggcttcggccccgaaagtcagtggcggacgggtgagtaacgcgtgagcaacctgcctccggaagagggataacagttggaaacgactgctaataccgcataacactgcgagtacgcatgtacatgcagtcaaaggagcaatccgaccggagatgggctcgcgtccgattagatagttggtgaggtaacggcccaccaagtctgcgatcggtagccggactgagaggttgaacggccacattggaactgagatacggtccagactcctacgggaggcagcagtggggaatattgggcaatgggcgaaagcctgacccagcgacgccgcgtgaaggaagaagatcttcggattgtaaactttagttatcagggaagaaaacaatgacggtacctgaagagaaagccacggctaactacgtgcc

SEQ ID NO: 1180 - DNA, 490 bp, Unknown
  Ascusbbf_382560, encodes 16S rRNA
agagtttgatcatggctcaggattaacgctggcggcgtgcctaatacatgcaagtcgtacgggtgattctagcttgctagatgatccagtggcgaacgggtgagtaatacataaacaacctacctataaggactgggataacgcttggaaacgagtgctaataccggataggtaacgggagggcatcctcctgttattaaaggattactacacaaatagatgggtttatggtgcattagcttgttggtgaggtaacggctcaccaaggcgatgatgcatagccggcctgagagggtgaacggccacattgggactgagacacggcccagactcctacgggaggcagcagtagggaattttcggcaatgggcgcaagcctgaccgagcaacgccgcgtgagtgatgacggccttcgggttgtaaagctctgttgtaagggaagaataacggggagtgaatctccgcatgacggtaccttaccagaaagcca

SEQ ID NO: 1181 - DNA, 490 bp, Unknown
  Ascusbbf_1594729, encodes 16S rRNA
agagtttgatcatggctcaggacgaacgctggcggcgtgcttaaaacatgcaagtcgaacggacgagaggttgtacttgtacgacttcaagttagtggcggacgggtgagtaacgcgtgagcaatctacctatcacagggggataacaactggaaacgggtgctaataccgcatatgaccacaacctaggcatcaggaaggggtgaaaggagcaatccggtgatagatgagcttgcgtctcattagctagttggcgagggtaacggcccaccaaggcgacgatgagtagccgatctgagaggatgaacggccacattggaactgagagacggtccaaactcctacgggaggcagcagttaggaatattgggcaatggaggaaactctgacccagcaacgccgcgtgaaggaagaaggttttcggattgtaaacttctgatctgtggaaaaaagatagtgatggtaccacaggagcaagccacggctaact

SEQ ID NO: 1182 - DNA, 490 bp, Unknown
  Ascusbbf_451085, encodes 16S rRNA
agagtttgatcatggctcaggacgaacgctggcggcgtgcctaacacatgcaagtcgaacggagtattgcgctgaaattgagagtagcttgctacaggatatttcttgtaatacttagtggcggacgggtgagtaacgcgtgaggaacctgcccttcagagggggacaacagttggaaacgactgctaataccgcataacgtaccgagaggacatcctcttgataccaaaggagcaatccgctgaaggatggcctcgcgtccgattagatagttggcggggtaacggcccaccaagtcgacgatcggtagccggactgagaggttgaacggccacattgggactgagacacggcccagactcctacgggaggcagcagtgggggatattgcacaatggaggaaactctgatgcagcaacgccgcgtgagggaagaaggttttcggattgtaaacctctgttttcagtgaagaaagaaatgacggtagctg

SEQ ID NO: 1183 - DNA, 490 bp, Unknown
  Ascusbbf_1778213, encodes 16S rRNA
agagtttgatcctggctcaggatgaacgctggcggcgtgcataacacatgcgagtcgaacggagtgctgatgaaacctagtgatttagcacttagtggcggacgggtgagtaacgcgtgggtaacctacctggtattgggggacaacagttagaaatgactgctaataccgcataagtcattttgagggcatcctcgaaatgggaaaggagcaatccgatagcagatggacccgcgtctgattagctagttggtgaggtaacggcctaccaaggcgacgatcagtagccgaactgagaggttgaccggccacattgggactgagacacggcccaaactcctacgggaggcagcagtggggaatattgcacaatgggggaaaccctgatgcagcaacgccgcgtgagtgaagaagtatttcggtatgtaaagctctatcgatggggaagaaaatgacggtacccaagtaagaagccccggctaactacgtg

SEQ ID NO: 1184 - DNA, 490 bp, Unknown
  Ascusbbf_735010, encodes 16S rRNA
agagtttgatcatggctcaggatgaacgctggcggcgtgcctaacacatgcaagtcgaacgaggctctgatccccgatgattcgtctgaagggaaaggatgtccgagtggcggatgggtgagtaacgcgtggagaacctgccccctgctgggggataacaactggaaacggttgacaataccgcataagcgcttcttatcgcatgatttgaagcggaaagatttatcggcaggggatggctccgcgtcggattagccagttggcggggtaacggcccaccaaagcgatgatccgtagccggcctgagagggcgaccggccacattgggactgagacacggcccagactcctacgggaggcagcagtgggggatattgcacaatggggggaaccctgatgcagcgacgccgcgtggaggaagaagtatttcggtatgtaaactcctatcagcagggaagaaactgacagtacctgactaagaagccccggc

SEQ ID NO: 1185 - DNA, 490 bp, Unknown
  Ascusbbf_1834541, encodes 16S rRNA
agagtttgatcatggctcagaacgaacgctggcggcgcgttttaagcatgcaagtcgagcggcagtagcaatacgagagcggcggacgggtgagtaacacgtgggtaatctgccccctggtcggggatagcctgtggaaacacaggataataccggatgcgacggcagccgcggaggcggcagccgggaaaggggccaaggccccgccgggggatgagcccgcgtcccattagcttgatggtgaggtaaaggcccaccatggcgatgatgggtagccggcctgagagggtgaacggccacattggaactgagacacggtccagactcctacgggaggcagcagctaagaatcttccacaatggacgaaagtctgatggagcgacgccgcgtgagcgatgaaggccgtgaggttgtaaagctcttttccggagggggaataagcggggcagggaatggccccgcgatgacgtgaatccgggaataagcccc

SEQ ID NO: 1186 - DNA, 490 bp, Unknown
  Ascusbbf_30248, encodes 16S rRNA
agagtttgatcctggctcaggatgaacgctagcggcaggcttaacacatgcaagtcgaggggcagcgcgtgtagcaatacatggcggcgaccggcgaaagggtgagtaacgcgtgagcaacgtgcccgtatgtgggggatagtcgatggaaacgtcgcgtaataccccgtaacacaaattcccgcatgaggatttgttgaaagatttattgcatacggatcggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggaagacggccctatgggttgtaaaccgcttttgcgagggagcaataagtgcaacgtgttgcgcgatgagagtacctcgcgaataagcatc

SEQ ID NO: 1187 - DNA, 490 bp, Unknown
  Ascusbbf_30209, encodes 16S rRNA
agagtttgatcatggctcaggatgaacgctggcggcgtgcctaatacatgcaagtcgaacgaggtggaagggagcttgctccttgataccgagtggcgaacgggtgagtaacacgtaggtaacctgcccttcagtttgggatacccagaggaaactttggctaataccggataacaacaaccgaggcatctcggatgcttgaaaggggcttcacagcctcgctgatagatggacctgcggcgcattagctagttggtgagataacagcccaccaaggcgaggatgcgtagccgaactgagaggttgatcggccacattggaactgagacacggtccagactcctacgggaggcagcagtaaggagttttcggcaatgggggaaaccctgaccgagcaacgccgcgtgagtgatgacggccctatgggttgtaaagctctgttatagaggacgaatgaggatcataggaaatgatggtcctttgacggtac

SEQ ID NO: 1188 - DNA, 361 bp, Unknown
  Ascusbbf_1167937, encodes 16S rRNA
agagtttgatcatggctcagaacgaacgctggcggcgcgtcttaagcatgcaagtcgggcgggattggggggcttgccccccatgagagcggcggactggcgaggaacgcgtgggcgacgcgccctccggagggggacagcccgtggaaacacggggtaataccccatgacatgggaggcttggaggccttccatcaaaggagcttcggctccgccgggggagcggcccgcgacccatcagcttgttggcggtgcaagggaccaccaaggctgcgacgggtatccggcctgagagggcgaacggacgcattgggactgagatacggcccagactcctacgggagccagcagccgcggtaat

SEQ ID NO: 1189 - DNA, 490 bp, Unknown
  Ascusbbf_129073, encodes 16S rRNA
agagtttgatcatggctcagaacgaacgctggtagcgtggattaggcatgcaagtcgaacgggatccgggagatagcaatatttcccggtgagagtggcggaagggcgaggaacacgtgaacaacctgtccatcaggtggggaaaaccgttggaaacgacggctaataccgaatgtggcgtcatggcacatgccgtgaacgctaaagggggcccgcaagggctctccctgaccgaagggttcgcgcaccatcagcttgttggcggggtaacggcccaccaaggcttacggttagctggtctgagaggatgaccagccgcactgggactgagatactgcccagactcctacgggaggctgcagtcgaggatcatttgcaatgggcgaaagcctgacaatgcgacgctgcgtggaggatgaaggccttcgggttgtaaactcctgtcataagggaaaaggagatgatacccaatacgtatcaaatttgatgg

SEQ ID NO: 1190 - DNA, 490 bp, Unknown
  Ascusbbf_5789, encodes 16S rRNA
agagtttgatcatggctcaggatgaacgctggcggcgcgcttaacacatgcaagtcgaacggaatgattggcttcggtcatgaattcagtggcggacgggtgagtaacacgtggataacttgccttttagtgggggatagctgagagaaatctcaattaataccgcataaagtaatttattcgcatgaatagattaataaagatgaaaatcgctaaaagataggtctgcgtctgattagctagttggggtggtaatggcacaccaaggcgacgatcagtaaccggtttgagagaatgaacggtcacattgggactgagatacggcccagactcctacgggaggcagcagtggggaatattgcgcaatggaggaaactctgacgcagcgacgccgtgtgaaggatgaaggccttcgggttgtaaacttttatcgattgtgaaaagaatggatggtagcaaagtaagaagctccggctaattacgtgccagc

SEQ ID NO: 1191 - DNA, 490 bp, Unknown
  Ascusbbf_13198, encodes 16S rRNA
agagtttgatcctggctcaggatgaacgctggcggcgtgcttaacacatgcaagtcgaacggaaacgtattgaaacctagtgatatacgttttagtggcggacgggtgagtaacgcgtgggtaacctgccgtattctgggggacaacagttggaaacgactgctaataccgcataagaccacagagtcgcatgactcaggggtaaaaactccggtggaatacgatggacccgcgtctgattagctagttggtgaggtaacggcccaccaaggcgacgatcagtagccggcctgagagggtgaacggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgcc

SEQ ID NO: 1192 - DNA, 487 bp, Unknown
  Ascusbbf_377870, encodes 16S rRNA
agagtttgatcatggctcagaacgaacgctggcggcaggcttaacacatgcaagttaaacgggatttgatggtagcttgctatcattgatgagagtagcgcactggtgagtaacacgtgggaacgtacattttagtgggggacaacatctggaaacggatgctaataccgcataagccctgagggggaaagatttatcgctaagatatcggcccgcggctaattaggtagttggtggggtaaaggcctaccaagcctacgatctatagctggtctgagaggacgatcagccacattggaactgagacacggtccagactcctacgggaggcagcagtgaggaatattgggcaatggaggcaactctgacccagccatgccgcgtgagtgagaaggttttcgaattgtaaagctctttcgggtgtgaagatgatgacggtaacaccagaagaagccccggcaaactacgtgccagcagccgcggtaat

SEQ ID NO: 1193 - DNA, 490 bp, Unknown
  Ascusbbf_106481, encodes 16S rRNA
agagtttgatcatggctcagattgaacgctggcggcaggcttaacacatgcaagtcgaacgatgaaatctagcttgctagatggattagtggcgaacgggtgagtaatgcttaggaatctgcctattagtgggggataaccatccgaaaggatggctaataccgcatacgtcttacgagagaaagggggcttttagctctcgctaatagatgagcctaagtcggattagctagttggtggggtaaaggcctaccaaggcgacgatctgtagctggtctgagaggatgatcagccacactgggactgagacacggcccagactcctacgggaggcagcagtggggaatattggacaatgggcgaaagcctgatccagccatgccgcgtgtgtgaagaaggccttttggttgtaaagcactttaagtggggaggaaaagcttgtggttaatacccattagccctgacgttacccacagaataagcaccggct

SEQ ID NO: 1194 - DNA, 490 bp, Unknown
  Ascusbbf_287681, encodes 16S rRNA
agagtttgatcctggctcaggatgaacgctagctacaggcttaacacatgcaagtcgaggggcagcatgggatcagcttgctgatcccgatggcgaccggcgcacgggtgagtaacgcgtatccaaccttccccctactcagggatagcccggtgaaaaccggattaacacctgatagtttcactagatggcatctgacggtgaataaagctttgcggtagaggatggggatgcgtctgattagcttgttggtggggtaacggcccaccaaggctacgatcagtaggggttctgagaggaaggtcccccacattggaactgagacacggtccaaactcctacgggaggcagcagtgaggaatattggtcaatgggcgagagcctgaaccagccaagtagcgtgcaggaagacggccctatgggttgtaaactgcttttgtacgggaataaagtcattcacgtgtggatgtttgcatgtaccgtaagaata

SEQ ID NO: 1195 - DNA, 490 bp, Unknown
  Ascusbbf_288707, encodes 16S rRNA
agagtttgatcatggctcaggatgaacgctggcggcgtgcctaatacatgcaagtcgaacgggaatcttcggattccagtggcgaacgggtgaggaatacataggtaacctgcccctccgagggggacaacagacggaaacatctgctaagaccgcatagccacagggaaggcatcttccctgtgccaaatgtcctttcggggacagcggggggatggacctatgccgcattagctggttggcggggcaacggcccaccaaggcgacgatgcgtagccggcctgagagggcggacggccacactgggactgagacacggcccagactcctacgggaggcagcagtagggaattttcggcaatgggggaaaccctgaccgagcaacgccgcgtgaacgatgaaggccttcgggtcgtaaagttctgttgcgaaggaagaacgccggtgtcaggaaatgggcgccgggtgacggtacttcgcatagaaagcc

SEQ ID NO: 1196 - DNA, 490 bp, Unknown
  Ascusbbf_276, encodes 16S rRNA
agagtttgatcatggctcaggacgaacgctggcggcgtgcctaacacatgcaagtcgaacggagtgaaagtagcttgctactggaacttagtggcggacgggtgagtaacacgtgagtaacctgcctttcagaggggaataatgtctggaaacggacactaataccgcataacatattttgatcgcatgatcgggatatcaaaggagcaatccgctgaaagatggactcgcgtctgattagccagttggcggggtaacggcccaccaaagcgacgatcagtagccggactgagaggttgaacggccacattgggactgagacacggcccagactcctacgggaggcagcagtgggggatattgcacaatgggcgcaagcctgatgcagcaacgccgcgtgcaggaagacggtcttcggattgtaaactgttgtcctctgtgacgataatgacggtagcagaggaggaagccacggctaactacgtgccag

SEQ ID NO: 1197 - DNA, 490 bp, Unknown
  Ascusbbf_23054, encodes 16S rRNA
agagtttgatcatggctcagattgaacgctggcggcatgctttacacatgcaagtcgaacggtaacagcacttcggtggctgacgagtggcgaacgggtgagtaatacatcggaacgtgcctagtagtgggggataactactcgaaagagtagctaataccgcatgagatctaaggatgaaagcaggggaccttcgggccttgcgctactagagcggctgatggcagattaggtagttggtgggataaaagcttaccaagccgacgatctgtagctggtctgagaggacgaccagccacactgggactgagacacggcccagactcctacgggaggcagcagtggggaattttggacaatgggcgcaagcctgatccagcaatgccgcgtgcaggatgaaggccttcgggttgtaaactgcttttgtacggaacgaaaagccctcttctaatacaggagggtcatgacggtaccgtaagaataagcaccg

SEQ ID NO: 1198 - DNA, 490 bp, Unknown
  Ascusbbf_58340, encodes 16S rRNA
agagtttgatcatggctcaggatgaacgctggcggcgtgcttaacacatgcaagtcgaacggagatatatatttgaagttttcggatggaagatatatatcttagtggcggacgggtgagtaacgcgtaaacaatctgccttagagagggggataacagatagaaatatctgctaataccgcataagaccacggttggcatcaaccaggggtaaaaggagcaatccgctttaagatgagtttgcgtactattagctagttggtgaggtaacggcccaccaaggcgacgatggttagccggcctgagagggtgaacggccacattggaactgagatacggtccagactcctacgggaggcagcagtgaggaatattgggcaatgggcgaaagcctgacccagcaacgccgcgtgaaggaagaaggttttaggattgtaaacttctgttgttagggaaaaagaaagtgatggtacctaacgaggaagctacg

SEQ ID NO: 1199 - DNA, 490 bp, Unknown
  Ascusbbf_53044, encodes 16S rRNA
agagtttgatcatggctcaggatgaacgctagctacaggcttaacacatgcaagtcgaggggcagcgcggagtcagcttgctgactttggcggcgaccggcgaatgggtgagtaacgcgtatccaacctggcctatgctcatggatagcccttagaaatgaggattaatacatgatggtctcccttgatcgcctgagattgggagtaaaggcttgccggcataggatggggatgcgttccattagatcgttggcggggtaacggcccaccaagtctatgatggataggggttctgagaggaaggtcccccacattggtactgagacacggaccaaactcctacgggaggcagcagtgaggaatattggtcaatgggcggaagcctgaaccagccaagtagcgtgaaggatgacggccctacgggttgtaaacttctttttccggggaataaccgccgctacgtgtagcggtctgcatgtacccggtgaat

SEQ ID NO: 1200 - DNA, 490 bp, Unknown
  Ascusbbf_3064, encodes 16S rRNA
agagtttgatcatggctcaggatgaacgctggcggcgtgcttaacacatgcaagtcgaacggagcttaagaaggaagcttgctttcattttaagcttagtggcggacgggtgagtaacgcgtgagcaacctgcccttcagtggggaataacaccgagaaatcggtgctaataccgcataatgtcggaggaccgcatgatcttccgaccaaaggatttattcgctgaaggatgggctcgcgtccgattaggcagttggcggggtaacggcccaccaaaccaacgatcggtagccgaactgagaggttgatcggccacattgggactgagacacggcccagactcctacgggaggcagcagtggggaatattgggcaatgggcgaaagcctgacccagcaacgccgcgtgaaggatgaaggtcttcggattgtaaacttctttgattggggaagaataaatgacctacccaaagaacaagtcacggctaact

SEQ ID NO: 1201 - DNA, 490 bp, Unknown
  Ascusbbf_11881, encodes 16S rRNA
agagtttgatcatggctcaggatgaacgctggcggcgtgcctaacacattcaagtcgaacgaactgtagaaatacagtgagtggcggacgggtgagtaacgcgtaagcaatctgcctttgtgtgtggaataacaaccggaaacagttgctaataccgcataacgcataggagtcgcatggctcttatgccaaagatttatcgcacgaagatgagcttgcgtccgattagatagttggcggggtaacggcccaccaagtctacgatcggtagccggactgagaggttgaacggccacattggaactgagatacggtccagactcctacgggaggcagcagtggggaatattgggcaatggacgaaagtctgacccagcgacgccgcgtgagggaagaaggtcttcggattgtaaaccttagtcaacagggacgaagcaagtgacggtacctgtggaggaagccacggctaactacgtgccagcagccgcgg

SEQ ID NO: 1202 - DNA, 490 bp, Unknown
  Ascusbbf_42308, encodes 16S rRNA
agagtttgatcctggctcaggatgaacgctggcggcgtgcctaacacatgcaagtcgaacggacgctttgaggagagtcttcggatgattcttaaagttgttagtggcggacgggtgagtaacgcgtggggaacctgcctttgtccgggggatagcagctggaaacggctggtaataccgcataagaccacgaagccgcatggctttgcggtaaaagatttatcggacagagatggacccgcgtctgattagccagttggcagggtaacggcctaccaaagcaacgatcagtagccggcctgagagggcggacggccacattgggactgagacacggcccagactcctacgggaggcagcagtgggggatattgcacaatggaggaaactctgatgcagcgacgccgcgtgagtgatgaagtatttcggtatgtaaagctctatcagcagggaagaaaggccccgaaaggggagatgacggtacctgagt

SEQ ID NO: 1203 - DNA, 490 bp, Unknown
  Ascusbbf_1372607, encodes 16S rRNA
agagtttgatcctggctcaggatgaacgctagctacaggcttaacacatgcaagtcgcggggcagcgcggagtgtagcaatacattctggcggcgaccggcggatgggtgagtaacgcgtatccaacctggccctatctcgggtacagcccctcgaaagagggattaatccccgatgttccctgggatccgcatgttttccagggcaaaggcatttgtcggatagggatggggatgcgttccattaggcagtcggcggggtaacggcccaccgagcctacgatggagaggggttctgagaggaagccccccacactggggaatgggagacggcccagactcttacgggaggcagcagtgaggaatattggtcaatggcggtaacgctgaaccagccaagtagcgtgagggattacggccctatgggttttaaacctcttttgttagggagcaaccggtggcacttgtgccattctgcgagtacctttcga

SEQ ID NO: 1204 - DNA, 490 bp, Unknown
  Ascusbbf_243548, encodes 16S rRNA
agagtttgatcctggctcaggataaacgctggcggcgcacataagacatgcaagtcgaacggaagccgttttaaattaattgattggatatgagaacttgttcaatttgaagagattttaatttaaaacatatgactttagtggcggactggtgagtaacgcgtaagcaatctgcctatcagaggggaataacagcgagaaatcgttgctaataccgcatatgcttaagtatcgcatgatacaataaggaaaggagtaatccgctgatagatgggcttgcgtctgattagatagttggtggggtaatggcctaccaagtcgatgatcagtagccggactgagaggttgaacggccacattgggactgagatacggcccagactcctacgggaggcagcagtcgggaatattgcgcaatggaggaaactctgacgcagtgacgccgcgtgcaggaagaaggttttcggattgtaaactgctttagacaggg

SEQ ID NO: 1205 - DNA, 490 bp, Unknown
  Ascusbbf_99944, encodes 16S rRNA
agagtttgatcctggctcaggatgaacgctagcggcaggcctaacacatgcaagtcgaggggcagcgggattgaagcttgcttcagttgccggcgaccggcgcacgggtgcgtaacgcgtatgcaacctacccataacagggggataacactgagaaatcggtactaatatcccataacatcaagaggggcatcccttttggttgaaaactccggtggttatggatgggcatgcgttgtattagctagttggtgaggtaacggctcaccaaggcgacgatacatagggggactgagaggttaaccccccacattggtactgagacacggaccaaactcctacgggaggcagcagtgaggaatattggtcaatggacgcaagtctgaaccagccatgccgcgtgcaggatgacggctctatgagttgtaaactgcttttgtacgagggtaaacccggatacgtgtatccggctgaaagtatcgtacgaata

SEQ ID NO: 1206 - DNA, 490 bp, Unknown
  Ascusbbf_977, encodes 16S rRNA
agagtttgatcatggctcaggacgaacgctggcggcgtgcttaacacatgcaagtcgaacggagtggaacgctgaattgatgtcagcttgctgatggattttcttgtttcacttagtggcggacgggtgagtaacgcgtgagtaacctgcctctgagtggggaataacgccctgaaaagagcgctaataccgcataatatacaggagccgcatgactcttgtatcaaagatttatcgctgagagatggactcgcgtccgattagcttgttggtggggtaacggcccaccaaggcgacgatcggtagccggactgagaggttgaacggccacattgggactgagacacggcccagactcctacgggaggcagcagtgggggatattgcgcaatgggggaaaccctgacgcagcaacgccgcgtggaggatgacggttttcggattgtaaactccttttataagggacgaattaagacggtaccttatgaat

SEQ ID NO: 1207 - DNA, 490 bp, Unknown
  Ascusbbf_672, encodes 16S rRNA
agagtttgatcctggctcaggacgaacgctggcggcgtgcttcatacatgcaagtcgaacgagaaattagagcttgctctaatggaaagtggcggacgggtgagtaatatgtaggaaatctgccctagagagggggacaacagagggaaacttctgctaataccccatatgagcgtacttgagatagtattcttgaaaactccggtgctctgggatgagcctgcatctgattagctagttggtggtgtaatggactaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgaatgttaaacccttcggggtgtaaagttctgtcagtggggacgaacaaatgacggtacccacagaggaagcaccggctaactccgtgccagcagccg

SEQ ID NO: 1208 - DNA, 490 bp, Unknown
  Ascusbbf_29817, encodes 16S rRNA
agagtttgatcatggctcaggacgaacgctggcggcgtgcttaacacatgcaagtcgaacggaactactatggaaaatcttcggatcggaagttttagtttagtggcgaacgggtgagtaacgcgtgaggaacctgcctttcagagggggacaacagttggaaacgactgctaataccgcataacatgtttttttcgcatgaagggaacatcaaagattatatcgctgaaagatggcctcgcgtctgattagatagttggtggggtaacggcccaccaagtcgacgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttaccagggacgaaggatgtgacggtacctggagaaaaagccacggc

SEQ ID NO: 1209 - DNA, 490 bp, Unknown
  Ascusbbf_76811, encodes 16S rRNA
agagtttgatcctggctcaggatgaacgctggcggcgtgcttaacacatgcaagtcgagcgagaaatcgggaaatgaagcttcggtagatttgaacgatggaaagcggcggacgggtgagtaacacgtgggaaacctgccttttgcagagggacagccgagggaaacttcgattaatacctcataacgcatcatcgtcgcatggcggagatgccaaagatttatcggcaagagatggtcccgcgtctgattagctggttggtgaggtagcggctcaccaaggcgacgatcagtagccggcctgagagggtgaacggtcacattggaactgagacacggtccagactcctacgggaggcagcagtggggaatattgcacaatgggcgcaagcctgatgcagcaacgccgcgtgaaggatgaaggccttcgggtcgtaaacttctgtccaaagggaagaacaaatgacggtacctttggaggaagccccggc

SEQ ID NO: 1210 - DNA, 490 bp, Unknown
  Ascusbbf_9769, encodes 16S rRNA
agagtttgatcatggctcaggacgaacgctggcggcacgcctaacacatgcaagtcgaacggacgatgaggagcttgctcctcaaagttagtggcggacgggtgagtaacacgtgagcaacctgcctttgagagggggatagcttctggaaacggatggtaataccccataacatatgtttgccgcatgacagacatatcaaaagaatttcgctcgaagatgggctcgcgtctgattagatagttggtgaggtaacggctcaccaagtcaacgatcagtagccggactgagaggttgaacggccacattgggactgagacacggcccagactcctacgggaggcagcagtggggaatattgcacaatgggggaaaccctgatgcagcgatgccgcgtggaggaagaaggttttcggattgtaaactccttttatgagggacgataatgacggtacctcaagaaaaagctccggctaactacgtgccagca

SEQ ID NO: 1211 - DNA, 490 bp, Unknown
  Ascusbbf_134690, encodes 16S rRNA
agagtttgatcctggctcaggacgaacgctggcggcgtgcttaacacatgcaagtcgaacgagggtatttagggagcttgctccttggatagccgagtggcgaacgggtgagtaacgcgtgagcaacctgtctcacacagggggataacgcaccgaaaggtgtgctaataccgcataagaccacagggggacatcctccaggggtcaaaggaggaatccggtgtgaggtgggctcgcgtctgattagatagttggtgaggtaacggctcaccaagtcaacgatcagtagccgacctgagagggtgatcggccacattgggactgagacacggcccagactcctacgggaggcagcagtggggaatattgggcaatgggcgcaagcctgacccagcaacgccgcgtgagggaagaaggttttcggattgtaaacctctgtcctgtatgaagagaagaagacggtagtacaggaggaagccccggctaacta

SEQ ID NO: 1212 - DNA, 490 bp, Unknown
  Ascusbbf_1098, encodes 16S rRNA
agagtttgatcatggctcaggatgaacgctagcggcaggcttaacacatgcaagtcgaggggcagcgtggagtagcaatactctgacggcgaccggcgaaagggtgagtaacgcgtgagcaacatgcccggtagtggagaatagtcgatggaaacgtcgcgtaatactccgtaacacaggtgaccgcatgattatctgttaatagatttatcgctaccggattggctcgcgtaccattagctagttggcggggtaacggcccaccaaggcgacgatggttaggggttctgagaggaaggtcccccacattggaactgagacacggtccagactcctacgggaggcagcagtgaggaatattggacaatggccgagaggctgatccagccatgccgcgtgcgggaagacggccctatgggttgtaaaccgcttttgttggggagcaataaggtccacgtgtggatcgatgagagtacccagcgaataagca

SEQ ID NO: 1213 - DNA, 490 bp, Unknown
  Ascusbbf_69128, encodes 16S rRNA
agagtttgatcatggctcaggatgaacgctggcggcgtgcttaacacatgcaagtcgaacggagatgtatttaggaagttttcggatggaatgaatgcatcttagtggcggacgggtgagtaacgcgtaaacaatctgccttagagagggggacaacagatagaaatatctgctaataccgcataagaccacgggtgggcatccaccaggggtaaaaggagaaatccgctttaagatgagtttgcgtactattagctagttggtggggtaatggcctaccaaggcgacgatggttagccggcctgagagggtgaacggccacattggaactgagaaacggtccagactcctacgggaggcagcagtgaggaatattgggcaatggaggaaactctgacccagcaacgccgcgtggaggaagaaggtcttcggattgtaaacttctgttatgggggaaaaagaaagtgatggtaccccatgagaaagctac

SEQ ID NO: 1214 - DNA, 490 bp, Unknown
  Ascusbbf_421120, encodes 16S rRNA
agagtttgatcctggctcaggatgaacgctagcggcaggcttaacacatgcaagtcgaggggcagcgcgttgtagcaatacgatggcggcgaccggcgaaagggtgagtaacgcgtgagcgacgtgcccgtcacagggggacaagggctggaaacggcttctgataccccataggaatgtatgcttcatggtgtatgtttgaaagatttatcggtgacggatcggctcgcgtccgattagctagttggtggggtaacggcccaccaaggcgacgatcggtaggggttctgagaggaaggtcccccacattggaactgagacacggtccagactcctacgggaggcagcagtgaggaatattggacaatggccggaaggctgatccagccatgccgcgtgcgggatgacggccctatgggttgtaaaccgcttttgtgtgggagcaataatcactacgtgtagtgagatgagagtaccatacgaataagca

SEQ ID NO: 1215 - DNA, 490 bp, Unknown
  Ascusbbf_111216, encodes 16S rRNA
agagtttgatcctggctcaggatgaacgctggcggcgtgcctaacacatgcaagtcgagcgagaagtctatgatcgaaacttcggttgattgattagatggaaagcggcggacgggtgagtaacgcgtaggcaacctgcccctggctgagggacagcctcgggaaaccgggattaatacctcataatacgaagggaagacatcttaccttcgtcaaagatttatcggctggggatgggcctgcgtctgattagttagttggtggggtaacggcctaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaaggatgaaggcccttgggtcgtaaacttctgttctaagggaagataatgacggtaccttaggagcaagtcccggcta

SEQ ID NO: 1216 - DNA, 490 bp, Unknown
  Ascusbbf_8119, encodes 16S rRNA
agagtttgatcatggctcaggacgaacgctggcggcgtgcctaacacatgcaagtcgagcggggatgatggaagagcttgctcggaaatcatcctagcggcggacgggtgagtaacgcgtgagcaacctgtcccagacagggggataccagatggaaacatctgctaataccgcataagaccacggggtcgcatggctctggggtaaaaggaggaatccggtttggggtgggctcgcgtccgattagctggttggtgaggtaacggcccaccaaggcgacgatcggtagccgacctgagagggtgatcggccacattggaactgagacacggtccaaactcctacgggaggcagcagtggggaatattgggcaatgggcgaaagcctgacccagcaacgccgcgtgagggaagaaggttttcggattgtaaacctctgtcctaagtgacgaaggaagtgacggtagcttaggaggaagccccggctaact

SEQ ID NO: 1217 - DNA, 490 bp, Unknown
  Ascusbbf_210346, encodes 16S rRNA
agagtttgatcatggctcagattgaacgctggcggcaggcttaacacatgcaagtcgaacggtagcggggagaaagcttgctttctctgccgacgagtggcggacgggtgagtaatgcttgggaatctggcttatggagggggataactactggaaacggtagctaataccgcgtaatgtctgcggactaaagggtgggactttcgggccacctgccataagatgagcccaagtgggattaggtagttggtgaggtaatggctcaccaagcccgcgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtagcgaggaaggcggttagtttaatagactaatcgattgacgttaactacaga

SEQ ID NO: 1218 - DNA, 490 bp, Unknown
  Ascusbbf_174156, encodes 16S rRNA
agagtttgatcctggctcaggatgaacgctagcggcaggcctaatacatgcaagtcggacgggatccatcggtagcttgctatcaatggtgagagtggcgcacgggtgcgtaacgcgtgagcaacctacctccatcagggggatagcctctcgaaagagagattaacaccgcataacataatgttccggcatcgggatattattaaatatttataggatggagatgggctcgcgtgacattagctagttggtagggtaacggcttaccaaggcgacgatgtctaggggctctgagaggagaatcccccacactggtactgagacacggaccagactcctacgggaggcagcagtaaggaatattggtcaatgggcggaagcctgaaccagccatgccgcgtgcaggatgactgccctatgggttgtaaactgcttttgtccgggaataaacctccttacgagtagggagctgaatgtaccggaagaataa

SEQ ID NO: 1219 - DNA, 490 bp, Unknown
  Ascusbbf_180714, encodes 16S rRNA
agagtttgatcatggctcaggacgaacgctggcggcgtgcctaatacatgcaagtcgagcgaacagaaaaggagcttgctcctttgacgttagcggcggacgggtgagtaacacgtgggcaacctaccctatagtttgggataactccgggaaaccggggctaataccgaataatctcttttgcttcatggtgaaagactgaaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtacc

SEQ ID NO: 1220 - DNA, 490 bp, Unknown
  Ascusbbf_28385, encodes 16S rRNA
agagtttgatcatggctcaggatgaacgctggcggcgtgcttaacacatgcaagtcgaacggagcttagaaggaagcttgctttcatttaagcttagtggcggacgggtgagtaacgcgtgagcaacctgccctcgagtggggaataacatcgagaaatcggtgctaataccgcataatgtcgagagaccgcatgatctttcgaccaaaggatttattcgcttgaggatgggctcgcgtccgattagttagttggtgaggtaacggcccaccaagacttcgatcggtagccgaactgagaggttgatcggccacattgggactgagacacggcccagactcctacgggaggcagcagtggggaatattgggcaatgggcgaaagcctgacccagcaacgccgcgtgaaggatgaaggtcttcggattgtaaacttctttgattggggaagaataaaatgacctacccaaagaacaagccacggctaacta

SEQ ID NO: 1221 - DNA, 490 bp, Unknown
  Ascusbbf_14082, encodes 16S rRNA
agagtttgatcctggctcaggacgaacgctggcggcgtgcttcatacatgcaagtcgaacgagaagttatcttcggataatggacagtggcggacgggtgagtaatgtgtagagaatctgccctatagagggggatagcagttggaaacgactattaataccccatatgcgcgtagttgcgatactattcgtgaaagatttatcgctataggatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgatcgcagacgcttttcggagtgtaaagatctgtcagtggggacgaacaatgactgtacccacagaggaagcaccggctaactccgtgccagcagccgcg

SEQ ID NO: 1222 - DNA, 490 bp, Unknown
  Ascusbbf_1423680, encodes 16S rRNA
agagtttgatcatggctcagaacgaacgctggtagcgtggattaggcatgcaagccgaacgggatcaccgatatagtaatattgaggtgtgagagtggcggattggggaggaacacgtgagcaacctgcctttgagtcggggaaaaccgttggaaacgacggctaataccggatgtggcgcccggtgacatcatcggagcgctaaagggggccgcaaggctctcgctcgtagaggggctcgcgcaccatcagcttgttggcggggtaacggcccaccaaggcctacggttagctggtctgggaggatgaccagccccactgggactgagatactgcccagactcctacgggaggctgcagtcgaggatcatttgcaatgggcgaaagcctgacaatgcgacgctgcgtggaggatgaaggccttcgggttgtaaactcctgtcatgggggaacaggcgaggatacctaatacgtttcttagttgagtgta

SEQ ID NO: 1223 - DNA, 490 bp, Unknown
  Ascusbbf_440105, encodes 16S rRNA
agagtttgatcctggctcagattgaacgctggcggcaggcctaatacatgcaagtcgaacgaggatagcaatatccgagtggcgaacgggtgagtaacacgtgagcaacctgccttacacaacgggatacctactggaaacagtagttaatacggtataagaccacagtaccgcatgatacagtggtaaaagatttatcggtgtaagatgggctcgcggcgcattagctagttggagaggtaacggctcaccaaggcgacgatgcgtagccgacctgagagggtgatcggccacattgggactgagatacggcccagactcctacgggaggcagcagtggggaatattgggcaatggaggaaactcttacccagcaatgccgcgtgagtgaagaaggtcgtaagattgtaaagctctttagtcagggaaaaagatagtgattgatctgaagaataagctccggctaactacgtgccagcagccgcggtaa

SEQ ID NO: 1224 - DNA, 490 bp, Unknown
  Ascusbbf_29367, encodes 16S rRNA
agagtttgatcatggctcaggacgaacgctggcggcgtgcctaatacatgcaagtcgagcggagctttcgcggcggaagccttcgggtggaagctgcgaaagcttagcggcggacgggtgagtaacacgtgggcaacctgcccgaaagaccgggataacatccggaaacggatgctaataccggataagcggacctttcgcatgaagggttcgggaaagacggggcaacctgtcactttcggatgggcccgcggcgcattagctggttggcggggtaacggcccaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgaggaaggtcttcggatcgtaaagctctgttgccagggaagaatcccctggggagtcactgccccg

SEQ ID NO: 1225 - DNA, 490 bp, Unknown
  Ascusbbf_22227, encodes 16S rRNA
agagtttgatcatggctcaggatgaacgctggcggcgtgcttaacacatgcaagtcgaacgaagcatttggtttgatttcttcggattgaaaaccttatgacttagtggcggacgggtgagtaacgcgtgggcaatctgccccataccgggggacaacagttggaaacgactgctaataccgcataagcgcacggagccgcatggccctgtgtgaaaaactccggtggtatgggatgagcccgcgttggattaggtagttggtgaggtaacggcccaccaagccgacgatccatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaagatgacggtacctgcacaagaagccccggct

SEQ ID NO: 1226 - DNA, 490 bp, Unknown
  Ascusbbf_701287, encodes 16S rRNA
agagtttgatcctggctcaggacgaacgctggcggtatgcctaacacatgcaagtcgaacgtgtgtgtagagagcttgctctttatttcactagtggcggacgggtgagtaacgcgtgagtaatctgccttgaagtggggaataacatttggaaacaaatgctaataccgcgtaatatactttcttcgcatgaagtttgtatcatagcttttcgcttcaagatgagctcgcgtccgattagtttgttggcgaggtaaatgctcaccaagactacgatcggtagccgggttgagagactgaacggccacattgggactgagacacggcccagactcctacgggaggcagcagtggggaatattgcacaatgggggaaaccctgatgcagcaataccgcgtgagggatgaaggctctagggttgtaaacctctgtccaaagggacgaattttgacggtacctttgtaggaagctccggctaactacgtgcca

SEQ ID NO: 1227 - DNA, 490 bp, Unknown
  Ascusbbf_78878, encodes 16S rRNA
agagtttgatcatggctcaggattaacgctggcggcgtgcctaacacatgcaagtcgagcgagaagcagtgaagggagtcttcggacaaacggaactgtggacagcggcggacgggtgagtaacgcgtgggcaacctgcccctttccggaggatagccaagggaaactttgaataatactccataaagcagagatgtcgcatggcaattctgccaaagatttatcggagagggatgggcccgcgtctgattagccagttggtgaggcagcggctcaccaaagcgacgatcggtagccggcctgagagggtgaacggccacattggaactgagacacggtccagactcctacgggaggcagcagtggggaatattgcacaatgggcggaagcctgatgcagcaacgccgcgtgaaggaagaaggttttcggatcgtaaacttctgtccctggggaagaaagaaatgacggtacccaaggaggaagccccgg

SEQ ID NO: 1228 - DNA, 490 bp, Unknown
  Ascusbbf_203782, encodes 16S rRNA
agagtttgatcctggctcagaatgaacgttggcggcgtggattaggcatgcaagtcgagcggcaaggtttttattttcggatataaaccctagagcggcggaagggataggacaatatagatacgcgcctcttagctcaggatagcgtctggaaacgggcgataatactgaatgaggtctccggaccaaaggtgagattccgctaggagatcggtctatagcctattagttagttggtagggtaacggcctaccaagacgatgatgggtacggggcgtgagagcgcgaccccgatcactgggactgagacactgcccagacgcctacgggcggctgcagtcgagaatcttcggcaatggacgcaagtctgaccgagcgacgccgcgtgtatgacgaaggccttcgggttgtaaagtactgtcgattgggcggaagttagagggggttctccctttcttttgacctatcatttgaggaaggacgggctaag

SEQ ID NO: 1229 - DNA, 490 bp, Unknown
  Ascusbbf_2278, encodes 16S rRNA
agagtttgatcatggctcaggatgaacgctagcggcaggcttaacacatgcaagtcgaggggcagcgggtgtagcaatacatgccggcgaccggcgaaagggtgagtaacgcgtgagcaacgtgcccgtatgtgggggatagtcgatggaaacgtcgcgtaataccccgtaacacatttggccgcatggccttatgttgaaagattgattgcatacggatcggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggaagacggccctatgggttgtaaaccgcttttgcgagggagcaataagggcaacgagttgtccgatgagagtacctcgcgaataagcatc

SEQ ID NO: 1230 - DNA, 490 bp, Unknown
  Ascusbbf_12358, encodes 16S rRNA
agagtttgatcatggctcaggatgaacgctggcggcgtgcctaacacatgcaagtcgaacgaagcatactccttcgggggtatgactgagtggcggacgggtgagtaacgcgtgggtaacctgccctctacagggggacaacagttagaaatgactgctaataccgcatgagcgcacagggaggcatcttcccgtgtgaaaaactatcggtggtagaggatgggcccgcgtctgattagctagttggcggggtaatagcccaccaaggcgacgatcagtagccggtctgagaggatgaacggccacattggaactgagacacggtccaaactcctacgggaggcagcagtgagggatattgcacaatgggggaaaccctgatgcagcaacgccgcgtgagtgaagaagtatttcggtatgtaaagctctatcagcagggaagataatgacggtacctgactaagaagctccggctaaatacgtgccagca

SEQ ID NO: 1231 - DNA, 490 bp, Unknown
  Ascusbbf_11105, encodes 16S rRNA
agagtttgatcatggctcaggatgaacgctggcggcgtgcttaatacatgcaagtcgaacgaagcacctctcccgaagattgaagctgcttgcagctgattgattcaattgaggtgactgagtggcggacgggtgagtaacgcgtgggtaacctgcctcatacagggggataacagttggaaacgactgctaataccgcataagcgcacagtatcgcatgatacagtgtgaaaaactccggtggtatgagatggacccgcgtctgattagctagttggaggggtaacggcccaccaaggcgacgatcagtagccgacttgagagagtgatcggccacattgggactgagacacggcccaaactcctacgggaggcagcagtagggaatattgcacaatgggggaaaccctgatgcagcgacgccgcgtgaaggatgaagtatttcggtatgtaaacttctatcagcaaggaagaaaatgacggtacttga

SEQ ID NO: 1232 - DNA, 490 bp, Unknown
  Ascusbbf_19198, encodes 16S rRNA
agagtttgatcatggctcaggatgaacgctagcgacaggcttaacacatgcaagtcgaggggcagcacaggtagcaataccgggtggcgaccggcgcacgggtgagtaacgcgtatgcaacttacctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgtaagcctgaaccagccaagtcgcgtgagggatgaaggttctatggatcgtaaacctcttttataagggaataaagtgtgggacgtgtcctattttgtatgtaccttatgaataagga

SEQ ID NO: 1233 - DNA, 490 bp, Unknown
  Ascusbbf_11905, encodes 16S rRNA
agagtttgatcctggctcaggatgaacgctggcggcgtgcttaacacatgcaagtcgaacgaagccaaaaggaagcttgctttctttgaagcttagtggcggacgggtgagtaacgcgtgagtaacctgcccttcagtggggaataacacagagaaatctgtgctaataccgcataacgtcttcttgccgcatgacaggaagaccaaaggatttattcgctgaaggatggactcgcgtccgattagctagttggtgaggtaacggcccaccaaggcgacgatcggtagccgaactgagaggttgatcggccacattgggactgagacacggcccagactcctacgggaggcagcagtggggaatattgggcaatgggcgaaagcctgacccagcaacgccgcgtgaaggaagacggtcttcggattgtaaacttctttgattggggaagaaacaaatgacctacccaaagaacaagtcacggctaactac

SEQ ID NO: 1234 - DNA, 490 bp, Unknown
  Ascusbbf_30239, encodes 16S rRNA
agagtttgatcatggctcaggatgaacgctggcggcatgcctaagacatgcaagtcgaacgaagtggcccaacaataatggagtgcttgcacaaaatttgcgatggattttccacttagtggcagacgggtgagtaacacgtaagtaatctacctttaagactgggataacgtttggaaacggacgctaataccggataattcacacttagataactaggggtgctaaaaggagcttcggctttacttgaagatgagcttgcggcgtattaactagttggtgaggtaatggctcaccaaggtaacgatgcgtagccgagctgagaggctaatcggccacattgggactgagacacggcccaaactcctacgggaggcagcagttaggaatattcgtcaatgggggaaaccctgaacgagcaatgccgcgtgagtgatgacggtcttatagattgtaaaactctgttgtaaaggaagaacccttattatag

SEQ ID NO: 1235 - DNA, 490 bp, Unknown
  Ascusbbf_142243, encodes 16S rRNA
agagtttgatcctggctcaggacgaacgctggcggcgtgcttaacacatgcaagtcgaacggtaaggcccttcggggtacacgagtggcgaacgggtgagtaacacgtgagtaacctgccccggactctgggataagcattcgaaagggtgtctaatactggataggactcctgcctgcatgggtgggggtggaaagattttttggttcgggatgggctcgcggcctatcagcttgttggtggggtgatggcctaccaaggcgtcgacgggtagccggcctgagagggcgaccggccacactgggactgagatacggcccagactcctacgggaggcagcagtggggaatattgcgcaatgggcggaagcctgacgcagcaacgccgcgtgcgggatgacggccttcgggttgtaaaccgctttcacccatgacgaagatttttttgacggtagtgggagaagaagcaccggccaactacgtgccagcag

SEQ ID NO: 1236 - DNA, 490 bp, Unknown
  Ascusbbf_263970, encodes 16S rRNA
agagtttgatcctggctcaggacgaacgctggcggcgtgcctaatacatgcaagtcgagcggacttgtttggagcttgcttcagacaggttagcggcggacgggtgagtaacacgtaggcaacctgcctctcagactgggataacatagggaaacttatgctaataccggataggttttcggatcgcatgatccgaaaagaaaaggcggcttttcgctgtcactgggagatgggcctgcggcgcattagctagttggtggggtaacggcccaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgtcagggacgaacaagtaccgtttgaacaaggcggtaccttgacggta

SEQ ID NO: 1237 - DNA, 490 bp, Unknown
  Ascusbbf_21453, encodes 16S rRNA
agagtttgatcatggctcaggatgaacgctggcggcgtgcctaacacatgcaagtcgagcgggaatcgcctgattgaaacttcggtcgaatgaaggcgaggatagcggcggacgggtgagtaacgcgtaggtaacctgccccttacacagggatagcctcgggaaactgggattaatacctgataatgcggtttgttcacatggacagaccgccaaagatttatcggtgagggatggacctgcgtctgattagcttgttggtgaggtaacggcccaccaaggcaacgatcagtagccgacctgagagggtaatcggccacattggaactgagacacggtccaaactcctacgggaggcagcagtggggaatattgcacaatgggcgcaagcctgatgcagcaacgccgcgtgagcgaagaaggtcttcggatcgtaaagctctgtcctcaggaacgaagaagtgacggtacctgaggaggaagccccggc

SEQ ID NO: 1238 - DNA, 490 bp, Unknown
  Ascusbbf_12101, encodes 16S rRNA
agagtttgatcatggctcagaacgaacgctggtggcgtgtcttatacatgcaagtcgagcggtccgcaaggatagcggcgaacgggtgagtaacgcgtaagcaatctgccccgcatattgggatagccgtgccaacgcgcggataataccgaataacgtggccccggacatccggggttgacgaaagattcatcgatgcgggatgagcttgcgtccgattagctagttggcggggcaacggcccaccaaggcgacgatcggtagccggcctgagagggtgatcggccacattgggactgagatacggcccagactcctacgggaggcagcagtagggaatattgcacaatgggggaaaccctgatgcagcaacgccacgtgtgggaagaagcatttcggtgtgtaaaccactgtcgtgagggaataatacgcggtttcggccgcgggggaatgtacctcgagaggaagcaccggcaaacttcgtgccagc

SEQ ID NO: 1239 - DNA, 490 bp, Unknown
  Ascusbbf_75702, encodes 16S rRNA
agagtttgatcctggctcaggacgaacgctggcggcgtgcctaacacatgcaagtcgaacgaggtccatgcagtggcaacactgcggaagacctagtggcgaacgggtgagtaacacgtgagaaacctgccccgaagaccgggataactctccgaaaggggagctaataccggatacccccatctgaccgcatggtcggatgaggaaatggattccgcttcgggagggtctcgcggcctatcagctagttggtgaggtaacggctcaccaaggcatcgacgggtagctggtctgagaggacgatcagccacactgggactgagacacggcccagactcctacgggaggcagcagtggggaatcttgcgcaatgggcgaaagcctgacgcagcaacgccgcgtgggggatgaaggctctcgggttgtaaacccctttcagcagggacgaaattgacggtacctgcagaagaagccccggctaactacgtgc

SEQ ID NO: 1240 - DNA, 490 bp, Unknown
  Ascusbbf_234, encodes 16S rRNA
agagtttgatcatggctcagaacgaacgctggcggcgcgttttaagcatgcaagtcgagcggtagtagcaatacgagagcggcggacgggtgagtaacacgtgggtaatctgcccttcggtcgggaatagcctgtggaaacacaggataataccggatgcgatggtcttcacacaagtggaggtcaggaaaggagccaaggctccgccggaggatgagcccgcgtcccattagctagatggtgaggtaaaggcccaccatggcgatgatgggtagccggcctgagagggtgaacggccacattggaactgagacacggtccagactcctacgggaggcagcagctaagaatcttccacaatggacgaaagtctgatggagcgacgccgcgtgggcgatgaaggccgtgaggttgtaaagcccttttcttgagggggaataatgcgggcagggaatggcctgcagatgacgtgaatcaaggaataagcccc

SEQ ID NO: 1241 - DNA, 490 bp, Unknown
  Ascusbbf_77644, encodes 16S rRNA
agagtttgatcctggctcaggatgaacgctggcggcgtgcctaacacatgcaagtcgaacgaagcactgcggatagaggcttcggccaattgaagctttgacttagtggcggacgggtgagtaacacgtgagcaacctgcccttcagtgggggacaacagctggaaacggctgctaataccgcataatgtatatgggaggcatctccggtataccaaagatttattgctgaaggatgggctcgcgtctgattagatagttggtgaggtaacggctcaccaagtcgacgatcagtagccggactgagaggttgaacggccacattgggactgagatacggcccagactcctacgggaggcagcagtggggaatattgggcaatgggggaaaccctgacccagcaacgccgcgtggaggaagaaggtcttcggattgtaaactcctttgacgagggacgataatgacggtacctcgaaaacaagccacggct

SEQ ID NO: 1242 - DNA, 490 bp, Unknown
  Ascusbbf_161051, encodes 16S rRNA
agagtttgatcatggctcagaacgaacgctggcggcgcgtcttaagcatgcaagtcgagcggtaacttaccttcgggtaagctagagcggcggactggtgagtaacacgtgggtgacataccctccggatcgggatagctcctagaaataggagataataccgggtacgaccactacggtcagagcgtagtgaggaaaggtgcgttttgcaccgccggaggagtggcccgcggcccattagctagttggtgaggtaacggcccaccaaggcgacgatgggtatccggcctaagagggtggacggacacattgggactgagatacggcccagactcctacgggaggcagcagctaagaatattccgcaatggacgaaagtctgacggagcgacgccgcgtgaacgatgaaggccgaaaggttgtaaagttcttttgaatctgacgaataaggtgtggaggaaatgccatactggtgacggtaggatttgaa

SEQ ID NO: 1243 - DNA, 490 bp, Unknown
  Ascusbbf_510673, encodes 16S rRNA
agagtttgatcctggctcaggatgaacgctagctacaggcttaacacatgcaagtcgcggggcagcgcggcggtgcttcggcactgctggcggcgaccggcgcacgggtgagtaacgcgtatccaacctgccccttaccacgggatagccctccgaaagggggattaataccgtatgtggccacgagacggcatccgaccgtggctaaaggctcagcggtaagggatggggatgcgtctgattaggtagtcggcggggtaacggcccaccgagccttcgatcagtaggggttctgagaggaaggtcccccacattggaactgagacacggtccaaactcctacgggaggcagcagtgaggaatattggtcaatgggcgcgagcctgaaccagccaagtagcgtgagggatgacggccctacgggttgtaaacctcttttacgcggggataaaccgcgccacgcgtggcgcgttgcaggtaccgcgtgaat

SEQ ID NO: 1244 - DNA, 487 bp, Unknown
  Ascusbbf_11735, encodes 16S rRNA
agagtttgatcctggctcagaacgaacgctggcggcaggcttaacacatgcaagttgaacgggatttgtatggtgcttgcactagacaatgagagtagcgcactggtgagtaacacgtgggaacatgccctgaagtgggggacaacagttggaaacgactgctaataccgcataatccctgagggggaaagatttatcgctttaggattggcccgcggaagattaggtagtaggtggggtaaaggcctacctagccgacgatctatagctggtctgagaggacgatcagccacattggaactgagacacggtccagactcctacgggaggcagcagtgaggaatattgggcaatggagggaactctgacccagccatgccgcgtgagtgagaaggtcttcggattgtaaagctctttcggatgggacgatgatgacggtaccatctaaagaagccccggcaaacttcgtgccagcagccgcggtaat

SEQ ID NO: 1245 - DNA, 490 bp, Unknown
  Ascusbbf_24085, encodes 16S rRNA
agagtttgatcatggctcaggatgaacgctggcggcgtgcttaatacatgcaagtcgaacgaagttttctcgccgaagcttgcttcattgagaaaacttagtggcggacgggtgagtaacgcgtgggtaacctgccttacacagggggataacagttagaaatgactgctaataccgcataagcgcacagaatcgcatgattcagtgtgaaaagatttatcggtgtaagatggacccgcgtctgattagctagttggtgaggtaacggcccaccaaggcgacgatcagtagccggcctgagagggtgaacggccacattgggactgagacacggcccaaactcctacgggaggcagcagtagggaatattggacaatgggggaaaccctgatccagcgacgccgcgtgagtgaagaagtatttcggtacgtaaagctctatcagcagggaagaaaatgacggtacctgactaagaagcaccggctaaata

SEQ ID NO: 1246 - DNA, 355 bp, Unknown
  Ascusbbf_507703, encodes 16S rRNA
agagtttgatcctggctcagaacgaacgctggcggcgcgttttaagcatgcaagtcgagcggcaaggacttcggtccccagagcggcggacgggtgagtaacacgtggataatctgccctgcagtccggaataccccatggaaacatgggctaatgccggatgcgagatggaggcgatggccttcatgggaaagctcccacgggagcgctgcaggatgagtccgcggcccattagcttgatggcggggtaaaggcccaccatggcgacgatgggtagccggcctgagagggtggacggccacattggaactgagacacggtccagactcctacgggagccagcagccgcggtaat

SEQ ID NO: 1247 - DNA, 490 bp, Unknown
  Ascusbbf_7866, encodes 16S rRNA
agagtttgatcatggctcaggatgaacgctagcggcaggcttaacacatgcaagtcgaggggcagcgcgttgtagcaatacgatggcggcgaccggcgaaagggtgagtaacgcgtgagcaacgtgcccgtatgtgggggatagtcgatggaaacgtcgcgtaataccccgtaacacaagggaccgcatgatctcttgttgaaagatttattgcatacggatcggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggaggacggccctatgggttgtaaaccgcttttgcgagggagcaataagggtaacgtgttgcccgatgagagtacctcgcgaataagca

SEQ ID NO: 1248 - DNA, 490 bp, Unknown
  Ascusbbf_386598, encodes 16S rRNA
agagtttgatcatggctcagaacgaacgctggcggcgcgtcttaagcatgcaagtcgagcgggattgtccagcttgctggacatgagagcggcggactggcgaggagcgcgtgggcgacgcgccccccggacgggaacagcccgtggaaacacggggtaatgccggatggcatgcagggcttggaggccctgcatcaaaggggcttcggccccgccgggggagcggcccgcgtcccatcagcttgttggcggtgcaagggaccaccaaggctacgacgggtgtccggcctgagagggcgatcggacgcattgggactgagatacggcccagactcctacgggaggcagcagctaagaatattccgcaatgggcgaaagcctgacggagcgacgccgcgtgcacgatggaggccggaaggttgtaaagtgcttttgggagggaggaagaagtccgggaggaaacgcccgggcggcgacggtacctcgcgaa

SEQ ID NO: 1249 - DNA, 490 bp, Unknown
  Ascusbbf_195984, encodes 16S rRNA
agagtttgatcatggctcaggacgaacgctggcggcgcgcctaacacatgcaagtcgaacggactttacggaaacagaagcttcggcagaagaagaaataaagttagtggcgaacgggtgagtaacacgtgaggaaccaacccttaagagggggataacacttagaaataggtgctaataccgcataagaccacactccggcatcggagaggggtcaaaggagcaatccgcttaaggacggcctcgcgtccgattaggtagttggcggggcaacggcccaccaagccgacgatcggtagccggactgagaggttgaacggccacattgggactgagacacggcccagactcctacgggaggcagcagtggggaatattgggcaatgggggaaaccctgacccagcgacgccgcgtgagggaagaaggtcttcggattgtaaacctctgtcttcggggacgatagtgactgtacccgaggaggaagccacg

SEQ ID NO: 1250 - DNA, 490 bp, Unknown
  Ascusbbf_3409, encodes 16S rRNA
agagtttgatcatggctcaggatgaacgctagctacaggcttaacacatgcaagtcgcggggcagcattggcgtggcaacacgccagatggcgaccggcgcacgggtgcgtaacgcgtatccaacctggccttcactcgggtatagccctgcgaaagtaggattaatccccgatgtcgtcaagcaggtgcatattttcttgacgaaaggtttaccggtgagggatggggatgcgttccattagctagttggcggggcaacggcccaccaaggcaacgatggataggggttctgagaggaaggtcccccacactggaactgagacacggtccagactcctacgggaggcagcagtgaggaatattggtcaatgggcgagagcctgaaccagccaagtagcgtgaaggatgacagcccttcgggttttaaacttcttttgcgggagattaaccgccatcactagtgatggtctgcagcaatcccgcgaataa

SEQ ID NO: 1251 - DNA, 490 bp, Unknown
  Ascusbbf_6474, encodes 16S rRNA
agagtttgatcatggctcaggacgaacgctggcggcgtgcctaacacatgcaagtcgagcggagatttcgggggagcttgctccaccgggatttcagcggcggacgggtgagtaacgcgtgagcaacctgccttcaacagggggataacgcatcgaaagatgtgctaataccgcatgagaccacaacatcacatggtgaaggggtcaaaggagcaatccggttgaagatgggctcgcgtccgattagctggttggtgagacaacagcccaccaaggcgacgatcggtagccgacctgagagggtgatcggccacattggaactgagatacggtccagactcctacgggaggcagcagtgggaatattgggcaatgggcgaaagcctgacccagcaacgccgcgtgagggaagaagggtttcggctcgtaaacctctgtcctgtgggacgaaggaagtgacggtaccacaggaggaagccccggctaacta

SEQ ID NO: 1252 - DNA, 488 bp, Unknown
  Ascusbbf_6257, encodes 16S rRNA
agagtttgatcatggctcagaacgaacgctggcggcatggattaggcatgcaagtcgaacgaggtagcaataccgagtggcggaagggtgaggaacacgtgagtaatctgcccccaagttgggaataacagttggaaacgattgctaataccgaatgtggctgtttttctgcatggaagaacagttaaagatttatcgcttggggatgagctcgcgtcccattagttagttggtgaggtaacggcccaccaagacgatgatgggtagctggtctgagaggatggtcagccacactgggactgagacactgcccagactcctacgggaggctgcagtcgagaatcttgggcaatgcgcgaaagcgtgacccagcaatgccgcgtgtatgatgaaggtcttcggattgtaaaatactgtctcccgggacgaaagatgacggtaccggggaaggaagccacggctaactacgtgccagcagccgcggtaat

SEQ ID NO: 1253 - DNA, 490 bp, Unknown
  Ascusbbf_10088, encodes 16S rRNA
agagtttgatcctggctcaggacgaacgctggcggcgtgcttaacacatgcaagtcgaacggagttagacgctggtttgatgctagcttgctagtggatttccttgtttaacttagtggcggacgggtgagtaacgcgtgagtaacctgcctctcagtggggaataacgccctgaaaagagcgctaataccgcataacgtattctgaccgcatgatcgggataccaaagatttatcgctgagagatggactcgcgtccgattagctagttggtgaggtaacggcccaccaaggcgacgatcggtagccggactgagaggttgaacggccacattgggactgagacacggcccagactcctacgggaggcagcagtgggggatattgcgcaatgggggaaaccctgacgcagcaacgccgcgtggaggatgacggttttcggattgtaaactccttttataagggacgaattaagacggtaccttatgaat

SEQ ID NO: 1254 - DNA, 490 bp, Unknown
  Ascusbbf_17142, encodes 16S rRNA
agagtttgatcatggctcagaacgaacgctggcggcatggattaggcatgcaagtcgaacgggcgcagcaatgcgtcagtggcgaaagggtgaggaacacgtgagtaacttgcccccaagttcggaatagctttgggaaactgaagataataccggatgtggttgttctgctgcatggtggagcaactaaaggtttactgcttggggataggctcgcgtcccattagctagttggtgaggcaacggctcaccaaggcgacgatgggtagctggtctgagaggatggtcagccacactgggactgagacactgcccagactcctacgggaggctgcagtcgagaatcttccgcaatgcgcgaaagcgtgacggagcaatgccgcgtgccggatgaaggtcttcggattgtaaacggctgtcgaccgggacgaatgaatgacggtaccggtagaggaagccacggctaactacgtgccagcagccgcggtaa

SEQ ID NO: 1255 - DNA, 490 bp, Unknown
  Ascusbbf_343268, encodes 16S rRNA
agagtttgatcatggctcaggatgaacgctggcggcaggcttaatacatgcaagtcgaacggtaaggccgagtgcagcaatgcacgaggtacacgagtggcgcacgggtgcgtaacgcgtatgcaacctgcccccaaccgggacaaaacagctggaaacggctgctaatatcccatggtcaccggaagtggcatcacctttggtgtaaagattcattggttggggatgggcatgcgtattattaggtagttggcggggtaacggcccaccaagccgacgatgattaggggttctgagaggaaagacccccaaactggaactgggacacggtccagactcctacgggaggcagcagtagggaatattgggcaatggaggcaactctgacccagccatgccgcgtgaaggaataaggccctatgggtcgtaaacttcttttaccgcagagtaaacccggggacgcgtccccggttgagagtatgcggggaat

SEQ ID NO: 1256 - DNA, 490 bp, Unknown
  Ascusbbf_17106, encodes 16S rRNA
agagtttgatcatggctcaggatgaacgctagcggcaggcctaacacatgcaagtcgaggggtaacaggcggtagcaatactgtgctgacgaccggcgcacgggtgcgtaacgcgtatgcaacctgcccgtaacagggggataaatcagggaaacttgacctaataccccatattgccaatccaccgcatgatgggttggcgaaagtttcgatggttacggatgggcatgcgtgacattagctagttggtaaggtaacggcttaccaaggcgacgatgtctaggggagctgagaggctaatcccccacactggtactgagacacggaccagactcctacgggaggcagcagtgaggaatattggtcaatggtgggaacactgaaccagccatgccgcgtgagggaggaaggccctatgggttgtaaacctcttttgcacgggagtaataaggctcatgcgtgggccgatgagagtaccgtgcgaataagc

SEQ ID NO: 1257 - DNA, 490 bp, Unknown
  Ascusbbf_76842, encodes 16S rRNA
agagtttgatcctggctcaggatgaacgctagctacaggcttaacacatgcaagtcgaggggcatcatggcggtagcttgctactgctgatggcgaccggcgcacgggtgcgtaacgcgtatccaaccttcccgcgagtcagggacagcccggcgaaagtcggattaatacctgatgttctccttagatggcatcagacgaggagtaaagattaatcgcttgcggatggggatgcgtaggattagcttgccggcggggtaacggcccaccggggcgacgatccttaggggttctgagaggaaggtcccccacactggtactgagacacggaccagactcctacgggaggcagcagtgaggaatattggtcaatgggcgtaagcctgaaccagccaagtagcgtgcaggacgacggccctacgggttgtaaactgcttttatgcggggataaagtgcagcacgtgtgctgtattgcaggtaccgcatgaat

SEQ ID NO: 1258 - DNA, 490 bp, Unknown
  Ascusbbf_40656, encodes 16S rRNA
agagtttgatcctggctcagattgaacgctggcggcatgctttacacatgcaagtcggacggcagcatcaagaagcttgcttcttggatggcgagtggcgaacgggtgagtaatgcatcggaatgtaccgagtaatgggggataactaatcgaaagattagctaataccgcatacgacctgagggtgaaagcaggggatcttcggaccttgcgttattcgagcagccgatgtcggattaggtagttggtggggtaaaggcctaccaagccgacgatccgtagcgggtctgagaggatgatccgccacattgggactgagacacggcccaaactcctacgggaggcagcagtggggaattttggacaatgggggcaaccctgatccagccatgccgcgtgtctgaagaaggccttcgggttgtaaaggacttttgtacgggaagaaaagggaagtgataataccactttctgctgacggtaccgtaagaat

SEQ ID NO: 1259 - DNA, 490 bp, Unknown
  Ascusbbf_41575, encodes 16S rRNA
agagtttgatcctggctcaggataaacgctggcggcgtgcgtaacacatgcaagttgagcgacgacgtttctgaagtggagacatggaagggcgagcggagcagcggacgggtgagtacaacatgagaagctgtcctgaagtgggggacaacgtctggaaacggacgctaataccccataggccgagaggttaaagccgcaaggcgctttaggaggtgctcgtgtcctatcagctagttggtgaggtaagggctcaccaaggcgacgacgggtagccggcctgagagggtgtacggccacactgggactgagatacggcccagactcctacgggaggcagcagtggggaatattgggcaatgggaggaatcctgacccagcgacgccgcgtgaacgaagacggccttagggttgtaaagttcttttatgtgggaagaaggaagtgacggtaccacatgaataagccccggctaactacgtgccagcagcc

SEQ ID NO: 1260 - DNA, 490 bp, Unknown
  Ascusbbf_17228, encodes 16S rRNA
agagtttgatcctggctcaggatgaacgctggcggcgtgcttaacacatgcaagtcgaacggagatatatttaagaagttttcggatggaatagatatatcttagtggcggactggtgagtaacgcgtaaacaatctgccttagagagggggacaacagatagaaatatctgctaataccgcataagaccacagacaggcatctgtcaggggtaaaaggagaaatccgctttaagatgagtttgcgtactattagctagttggtgaggtaacggcccaccaaggcgacgatggttagccggcctgagagggtgaacggccacattggaactgagatacggtccagactcctacgggaggcagcagtgaggaatattgggcaatggagggaactctgacccagcaacgccgcgtgaaggaagaaggttttcggattgtaaacttctgttataggggaaaaagaaagtgatggtaccctatgagaaagctac

SEQ ID NO: 1261 - DNA, 468 bp, Unknown
  Ascusbbf_15640, encodes 16S rRNA
agagtttgatcatggctcagaacgaacgctggcggcatgcctaacacatgcaagtcgaacggctcttcggagcagtggcgcacgggtgagtaacgcgtgggaacctaccctgaggttcggaataacggctggaaacggccgctaataccggatgtgtcctgaggggcaaaggcttgccgccttgggaggggcccgcgtccgattagcttgttggtgaggtaacggctcaccaaggcgacgatcggtagctggtctgagaggatgatcagccacactgggactgagacacggcccagactcctacgggaggcagcagtggggaatattggacaatgggcgaaagcctgatccagcaatgccgcgtgtgtgatgaaggccctagggttgtaaagcactttcgccgatgacgatgatgacggtagtcggataagaagccccggctaactccgtgccagcagccgcggtaat

SEQ ID NO: 1262 - DNA, 471 bp, Unknown
  Ascusbbf_16936, encodes 16S rRNA
agagtttgatcatggctcagaacgaacgctggcggcaggcctaacacatgcaagtcgaacggttccttcggggacagtggcggacgggtgagtaacgcgtgggaacgtgccttccagttcggaataacccagggaaacttgggctaataccggatacgtcctttgggagaaagattttatcgctggaagatcggcccgcgtctgattagctggttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgacggccttagggttgtaaagctctttcggcggggacgataatgacggtacccgcagaagaagccccggctaacttcgtgccagcagccgcggtaat

SEQ ID NO: 1263 - DNA, 490 bp, Unknown
  Ascusbbf_33917, encodes 16S rRNA
agagtttgatcctggctcaggatgaacgctagctacaggcttaacacatgcaagtcgaggggcagcatgaaggaagcttgcttcctttgatggcgaccggcgcacgggtgagtaacgcgtatccaacctgccacatactcggggatagcccggtgaaaaccgaattaagacccgatggcatcctttgaggacatctgacgaggattaaaggcaacggtatgtgatggggatgcgtccgattagcttgttggcggggtaacggcccaccaaggcgacgatcggtaggggttctgagaggaaggtcccccacattggtactgagacacggaccaaactcctacgggaggcagcagtgaggaatattggtcaatgggcggaagcctgaaccagccaagtagcgtgcaggatgacggccctatgggttgtaaactgcttttgtcagggaacaaagtgaggcacgtgtgcctttttgcgtgtacctgtcgaataa

SEQ ID NO: 1264 - DNA, 490 bp, Unknown
  Ascusbbf_41139, encodes 16S rRNA
agagtttgatcatggctcaggatgaacgctggcggcgcgcttaacacatgcaagtcgaacgagatgagtggcttcggtcatgagtctagtggcggacgggtgagtaacgcgtggacaacttgccttatagtgggggatagccgaaagaaatttcgattaataccgcataatacaatttggttgcatgatcagattgggaaaggctttggtcgctaaaagaaaggtccgcgtctgattagctagttggtgtggtaatggcataccaaggcaacgatcagtagctggtttgagagaatgaacagccacattgggactgagatacggcccagactcctacgggaggcagcagtggggaatattgcgcaatggaggaaactctgacgcagcgacgccgtgtaaaggatgaaggccttcgggttgtaaacttatatcgattgtgaaaagcaaggatggtagcaaagtaagaagctccggctaactacgtgccagc

SEQ ID NO: 1265 - DNA, 490 bp, Unknown
  Ascusbbf_140607, encodes 16S rRNA
agagtttgatcctggctcaggatgaacgctggcggcgtgcctaacacatgcaagtcgagcgggaagcctctgattgaaacttcggtagatagaagaggtggatagcggcggacgggtgagtaacgcgtaggtaagctgccccacgcacagggatagcccggggaaacctggattaatacctgataacgcagaggagtcacatggctcttctgccaaagatttatcggcatgggatgcacctgcgtctgattagccagttggtgaggtaacggcccaccaaagcaacgatcagtagccgacctgagagggtaatcggccacattggaactgagacacggtccaaactcctacgggaggcagcagtggggaatattgcacaatgggcgcaagcctgatgcagcaacgccgcgtgagcgatgaaggtcttcggattgtaaagctctgtccttgaggacgaaaaatgacggtactcttggaggaagccccggct

SEQ ID NO: 1266 - DNA, 490 bp, Unknown
  Ascusbbf_229170, encodes 16S rRNA
agagtttgatcctggctcagaacgaacgctggcggcgcgtcttaagcatgcaagtcgagcggcaaggtgcctccgggcatcctagagcggcggactggtgagtaacgcgtggatgacgcacccttgcgacggggatagcctgtggaaacacagggtaataccggataagctcagtatcgttggagggtactgaggaaaggagctattgctccgcgcgaggagcggtccgcgtcccatcagctggttggcggggtaaaggcccaccaaggcaatgacgggtacccggcctgagagggcgatcgggcacattgggactgagatacggcccagactcctacgggaggcagcagctaagaatattccgcaatgcgcgaaagcgtgacggagcgacgccgcgtggacgatgaaggccggaaggttgcagagtcctttggcgcccgaggaaacggcgggggagcggaaagcccccgaactgactgtagggcgagaa

SEQ ID NO: 1267 - DNA, 490 bp, Unknown
  Ascusbbf_975431, encodes 16S rRNA
agagtttgatcatggctcaggacgaacgctggcggcgtgcttaacacatgcaagtcgaacgaagcttgacgaatgatttcttcggaatgaattctgatatgactgagtggcggacgggtgagtaacgcgtgagtaacctgcctcttggagggggatagtgtttggaaacgaacagtaataccgcataagtgcagagaaggcatcttttttgtaccaaagatttatcgccaagagatggactcgcgtctgattagatagttggtggggtaacggcccaccaagtcgacgatcagtagccggactgagaggttgaacggccacattgggactgagacacggcccagactcctacgggaggcagcagtggggaatattgcacaatgggggaaaccctgatgcagcaacgccgcgtggaggaagacggttttcggattgtaaactcctgttcttagggaagaagaaagtgacggtacctaaggagcaagccacg

SEQ ID NO: 1268 - DNA, 490 bp, Unknown
  Ascusbbf_32608, encodes 16S rRNA
agagtttgatcatggctcaggatgaacgctggcggcgtgcctaacacatgcaagtcgaacgggaaccttgcaacggagacttcggtcaaagatgcaagaattctagtggcggacgggtgagtaacgcgtgggtaacctgcccttaagaggcgaataacagtgagaaatcactgctaatacgccatatgcttacggaatcgcatgattttgtgaggaaaagaatttcgcttaaggatggacccgcgtttgattagccagttggcagggtaacggcctaccaaagcaacgatcaatagccggcctgagagggtgaacggccacattggaactgagacacggtccaaactcctacgggaggcagcagtggggagtattgcacaatgggcgaaagcctgatgcagcaacgccgcgtgagtgaagaagtatttcggtatgtaaagctctatcgatggggaataagatgaaggtacccaagtaagaagccccggct

SEQ ID NO: 1269 - DNA, 490 bp, Unknown
  Ascusbbf_101943, encodes 16S rRNA
agagtttgatcatggctcaggatgaacgctggcggcatgcctaagacatgcaagtcgaacgagacgaccttaggaaaactgagtgcttgcacgaagttggatcaagatcatcgtctagtggcagacgggtgagtaacacgtgggtaacctaccttcaagttggggataacagttggaaacgattgctaataccgaataaggtacttgtactgaaagaagcctttaaagcttcacttaaagatgggcctgcggcgtattaactagttggtgaggtaatggctcaccaaggtaacgatgcgtagccgaactgagaggttgaacggccacactgggactgagacacggcccagactcctacgggagacagcagttaggaatattcgtcaatgggggaaaccctgaacgagcaatgccgcgtgagtgatgaaggccctatgggttgtaaagctctgttgtatgggaagaacgtctatattaggaaatgaatatg

SEQ ID NO: 1270 - DNA, 490 bp, Unknown
  Ascusbbf_31925, encodes 16S rRNA
agagtttgatcctggctcaggatgaacgctagctacaggcttaacacatgcaagtcgaggggcagcggggaggaagcttgctttctccgccggcgaccggcgaatgggtgagtaacgcgtatccaacctggcctatgctctgggatagcccttagaaatgaggattaatacgagatagtctcctttgatcgcctgagattaggagtaaagacttgtcggcataggatggggatgcgttccattagatagttggcggggtaacggcccaccaagtcgatgatggataggggttctgagaggaaggtcccccacactggtactgagacacggaccagactcctacgggaggcagcagtgaggaatattggtcaatgggcgagagcctgaaccagccaagtagcgtgaaggatgacggccctatgggttgtaaacttcttttgtcggggaataacaagcgccacgtgtggcgccctgcatgtacccggtgaat

SEQ ID NO: 1271 - DNA, 490 bp, Unknown
  Ascusbbf_49311, encodes 16S rRNA
agagtttgatcctggctcaggacgaacgctggcggcacgcctaacacatgcaagtcgaacggtgaatttggtgcttgcactgaattcatagtggcggacgggtgagtaacacgtgagcaacctgccttcaagagagggatagcttctggaaacggatggtaataccttataaaatatatttgtcgcatggcatatatatcaaagatttattgcttgaagatgggctcgcgtctgattagatagttggtgaggtaacggctcaccaagtcgacgatcagtagccggactgagaggttgaacggccacattgggactgagacacggcccagactcctacgggaggcagcagtgagggatattgcacaatgggggaaaccctgatgcagcgatgccgcgtggaggaagaaggttttcggattgtaaactccttttatcagggacgataatgacggtacctgaagaaaaagctccggctaactacgtgccagca

SEQ ID NO: 1272 - DNA, 490 bp, Unknown
  Ascusbbf_50895, encodes 16S rRNA
agagtttgatcctggctcaggatgaacgctagcggaacgcctaacacatgcaagtcgaacggattctgcgttgtagcaatacatagtagaattagtggcaaacgagcgagtaacgcgtgcctaacctgcccttaagatgggaacaactacggagacgtagctaaatcccaatatgctcacgatggtgaaatgccgatgcgaggaaagatttatcgcttaaggaggggggcgcgtcctatcaggtagttggttgaggtaacggctcaccaagcctatgacaggtagctggtctgagatgatgtccagccgcgatgggactgagatacggcccatactcctacgggaggcagcagtggggaatcttgcacaatggacgaaagtctgatgcagcgatcccgcgtgaaggatgaagcattacggtgtgtaaacttcttttttggtggaagacgaatgacggtacaccaagaataagagacggctaactacgtgc

SEQ ID NO: 1273 - DNA, 490 bp, Unknown
  Ascusbbf_354361, encodes 16S rRNA
agagtttgatcatggctcaggatgaacgctggcggcgtgcctaacacatgcaagtcgaacggagtacagacgctgtgcggagaagtgcttgcacggaaccaaacttgtttgtacttagtggcggacgggtgagtaacgcgtggagaacctgcctcacacagggggataacagggagaaattcctgctaataccgcataagcgcacgacatggcatcatgaagtgtgaaaagatttatcggtgtgagatggctccgcgtctgattagtcagttggcggggtaacggcccaccaaagcgacgatcagtagccggcctgagagggcggacggccacattgggactgagacacggcccagactcctacgggaggcagcagtgggggatattgcacaatggggggaaccctgatgcagcgacgccgcgtgggtgaagaagtatttcggtatgtaaagccctatcagcagggaagataatgacggtacctgactaa

SEQ ID NO: 1274 - DNA, 490 bp, Unknown
  Ascusbbf_357925, encodes 16S rRNA
agagtttgatcctggctcaggatgaacgctagcgacaggcctaacacatgcaagtcgaggggcagcatggagtagcaatactctgatggcgaccggcgcacgggtgcgtaacaggtgtgcaatctgtccatagtcgggggatagcccggcgaaagccgaattaatactccatgtgtcacgaagccgcatgactttgtgatgaaacgtaaggactatggatgagcacgcttctgattaggtagttggtgaggtaacggcccaccaagccgacgatcagtaggggttctgagaggaaggtcccccacattggaactgagacacggtccaaactcctacgggaggcagcagtgaggaatattggtcaatggacggaagtctgaaccagccaagtcgcgtgaaggatgaaggttctatggattgtaaacttcttttgtctgagggtaaagtcggggacgtgtccccgttggcaagtatcagacgaataagcatc

SEQ ID NO: 1275 - DNA, 490 bp, Unknown
  Ascusbbf_62037, encodes 16S rRNA
agagtttgatcctggctcaggacgaacgctggcggcacgcttaacacatgcaagtcgaacgaacggagatagcttgctatcaaagttagtggcggacgggtgagtaacacgtgagcaatctgcctctaagtggggaataacgactggaaacggtcggtaataccgcataacatagctgagccgcatgacttagctatcaaagatttatcgcttagagatgagctcgcgtctgattagctagttggtgaggtaacggcccaccaaggcgacgatcagtagccggactgagaggttgaacggccacattgggactgagacacggcccagactcctacgggaggcagcagtggggaatattgcacaatgggcgcaagcctgatgcagcgatgccgcgtgagggaagaaggttttcggattgtaaacctctgttgacagggacgataatgacggtacctgttcagaaagctccggctaactacgtgccagcagc

SEQ ID NO: 1276 - DNA, 490 bp, Unknown
  Ascusbbf_97348, encodes 16S rRNA
agagtttgatcatggctcaggatgaacgctggcggcgtgcctaacacatgcaagtcgaacggggatagagagaagttttcggacagacctttatcttagtggcggacgggtgagtaacgcgtggataacctgcctttttctgggggatagcagttggaaacgactgataataccgcataagctccgattcccgcatgggagccggaggaaagatttatcgggagaagatggatccgcgtctgattagccagttggcggggtaacggcccaccaaagcgacgatcagtagccggcctgagagggtgaacggccacattgggactgagacacggcccaaactcctacgggaggcagcagtggggaatattgcacaatgggcgcaagcctgatgcagcgacgccgcgtgagtgaagaagtatttcggtatgtaaagctctatcggcagggaagaaaggcccgaaagggagatgacggtacctgactaagaagc

SEQ ID NO: 1277 - DNA, 490 bp, Unknown
  Ascusbbf_60697, encodes 16S rRNA
agagtttgatcatggctcaggataaacgctagcggcaggcctaacacatgcaagtcgagcggcagcggggtgtagcaatacattgccggcgagcggcggacgggtgagtaacgcgtatgcaacctgcccaccacacggagatagccgaccgaaaggacgattaaactccgatggcaccttctgggggcatccccgaaaggttaaatattcataggtggtggatgggcatgcgtggcattagttagttggcggggcaacggcccaccaagacggtgatgcctatgggttctaaaaggaagatcccacacatcggtactgagacacggaccgaactcctacgggaggcagcagtgaggaatattggacaatgggggcaaccctgatccagccaaaccgcgtgggggaaggaggtcgttaagatcgtaaaccccttttatatgggagcaatccgccgtatgtatatggcgttgagagtaccatttgaataagc

SEQ ID NO: 1278 - DNA, 490 bp, Unknown
  Ascusbbf_105248, encodes 16S rRNA
agagtttgatcctggctcaggacgaacgctggcggcacgcttaacacatgcaagtcgaacggtgaaggtagcttgctaccggaacagtggcggacgggtgagtaacacgtgagcaatctgcctttaagtggggaataacgattggaaacgatcggtaataccgcataatatacatgagtcgcatgacatatgtatcaaagatttatcgcttaaagatgagctcgcgtctgattagctagttggtgcggtaacggcgtaccaaggcgacgatcagtagccggactgagaggttgaacggccacattgggactgagacacggcccagactcctacgggaggcagcagtggggaatattgcacaatggaggaaactctgatgcagcgatgccgcgtgagggaagaaggttttcggattgtaaacctctgttgacagggacgataatgacggtacctgttcagaaagctccggctaactacgtgccagcagccg

SEQ ID NO: 1279 - DNA, 490 bp, Unknown
  Ascusbbf_241805, encodes 16S rRNA
agagtttgatcctggctcaggatgaacgctagcggcaggcttaacacatgcaagtcgaggggcagcggggtgtagcaatacaccgccggcgaccggcgcacgggtgcgtaacgcgtatgcaacctgcccgtaacagggggataacggggagaaatccccactaataccccgtatagcggaggggccgcatggtctttccgcgaaagcttcggcggttacggatgggcatgcgtggcattaggtagttggcggggcaacggcccaccaagcctacgatgcctaggggagctgagaggcttatcccccacactggtactgagacacggaccagactcctacgggaggcagcagtgaggaatattggtcaatggacggaagtctgaaccagccatgccgcgtgcgggaagacggccctatgggttgtaaaccgcttttccccgggagtaataagggccgtgcgcggcccgatgagagtaccgggggaataagc

SEQ ID NO: 1280 - DNA, 490 bp, Unknown
  Ascusbbf_378911, encodes 16S rRNA
agagtttgatcctggctcagattgaacgctggcggcaggcctaacacatgcaagtcggacggtagcacaggggagcttgctccccgggtgacgagtggcggacgggtgagtaatgtctgggaaactgcccggtggagggggataactactggaaacggtagctaataccgcataacgtcttcggaccaaagtgggggatcttcggacctcacgccaccggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaag

SEQ ID NO: 1281 - DNA, 490 bp, Unknown
  Ascusbbf_78625, encodes 16S rRNA
agagtttgatcatggctcaggacgaacgctggcggcgtgcttaacacatgcaagtcgaacgaagctctcacgcttgagttttcggacaagagggtgagatgacttagtggcggactggtgagtaacgcgtgagcaacctgccctccggtgggggacaacagttggaaacgactgctaataccgcataatgtacagagaccgcatgatctttgtaccaaagctttatgtgccggaggatgggctcgcgtctgattagatagttggcggggtaacggcccaccaagtcgacgatcagtagccggactgagaggttgaacggccacattgggactgagatacggcccagactcctacgggaggcagcagtggggaatattgggcaatggacgaaagtctgacccagcaacgccgcgtgaaggaagaaggccttcgggttgtaaacttcttttgtcaaggacgataatgacggtacttgacgaataagccacgg

SEQ ID NO: 1282 - DNA, 490 bp, Unknown
  Ascusbbf_723530, encodes 16S rRNA
agagtttgatcatggctcaggatgaacgctggcggcgtgcataacacattcaagtcgaacggactttcattgatagcttgctatcgatgaaagttagtggcggacgggtgagtaacgcgtgagcaacctgcctatgtgagggggacaacagttggaaacgactgctaataccgcataaagtatattgagggcatcctcgatataccaaagagattcgcacatagatgggctcgcgtccgattagatagttggtgaggtaacggcccaccaagtcgacgatcggtagccggactgagaggttgaacggccacattggaactgagagacggtccagactcctacgggaggcagcagtggggaatattgggcaatgggcgaaagcctgacccagcgacgccgcgtgagtgaagaaggtcttcggattgtaaagcttagttatcggggaagaaggaagtgacggtacccgaagagaaagccacggctaactacg

SEQ ID NO: 1283 - DNA, 490 bp, Unknown
  Ascusbbf_346473, encodes 16S rRNA
agagtttgatcatggctcaggacgaacgctggcggcgtgcttaacacatgcaagtcgaacggagttaagcgctggattgatggtagcttgctaccggatttccttgtttaacttagtggcggacgggtgagtaacgcgtgagtaacctgccccggagtggggaataacgttctgaaaagaacgctaataccgcataacacatacagatcgcatggtcggtatgtcaaagatttatcgctctgggatggactcgcgtccgattagctagttggcggggtaacggcccaccaaggcgacgatcggtagccggactgagaggttgaacggccacattgggactgagacacggcccagactcctacgggaggcagcagtgggggatattgcgcaatgggggaaaccctgacgcagcaacgccgcgtggaggatgacggttttcggattgtaaactccttttatgggggacgaactaagacggtaccccatgaat

SEQ ID NO: 1284 - DNA, 490 bp, Unknown
  Ascusbbf_382838, encodes 16S rRNA
agagtttgatcctggctcagaatgaacgttggcggcatggattaggcatgcaagtcgagcgagaacttcaagatagagacttcggtcaaagtcttgaagggacagcggcgaaagggtgagtaacgcgtagttacctgcctgagggtccagaatagcttcgggaaactgaaggtaatgctggataatatctccggatcaaaggtgagattccgccctcagaggggactgcgtcctactagcttgttggtggggtaatggcctaccaaggctacgatgggtagcgggcgtgagagcgtggcccgtcacactgggactgagacactgcccagacacctacgggtggctgcagtcgagaatcttcggcaatgcgcgaaagcgtgaccgagcaatgccgcgtgcgggatgacggccttcgggttgtaaaccgcgaaagtaaggaggaaggctctgtgaagagcagagtttgaccaatttacagtaaggacgggct

SEQ ID NO: 1285 - DNA, 490 bp, Unknown
  Ascusbbf_391956, encodes 16S rRNA
agagtttgatcatggctcaggatgaacgctggcggcgtgcctaatacatgcaagtcgaacgagatagcaatatcgagtggcgaacgggtgagtaacacgtaggtaacctgccttacagtttgggataccctggcgaaagctaggctaataccgaataattggattggaggcatctccgatctctaaaaggggcccttaaagcctcgctgaatgatggacctgcggcgcattagctagttggtgagataacagcccaccaaggcgaggatgcgtagccgacctgagagggtgaacggccacactggaactgagacacggtccagactcctacgggaggcagcagtagggagttttcggcaatgggggcaaccctgaccgagcaacgccgcgtgaatgatgaaggtcttcggattgtaaagttctgttataagggaaaaatgatatggtgaggaaatgctccatatttgatggtaccttattagaaagccac

SEQ ID NO: 1286 - DNA, 490 bp, Unknown
  Ascusbbf_149438, encodes 16S rRNA
agagtttgatcatggctcagaacgaacgctggtggcgtgccttatacatgcaagtcgagcgaggacgcagcaatgcgagccgagcggcgaacgggtgagtaacgcgtgagcaacctgccccggagtccggaatagcccttccaacggaggattaatgccggatgacgaggagcaccgagtggtgctttttccaaagcctaggcgcttcgggaggggctcgcgtccgattagctagttggcggggcagcggcccaccaaggcgacgatcggtagccggcctgagagggcgaacggccacaatgggactgagatacggcccatactcctacgggaggcagcagtagggaatattgcgcaatggggggaaccctgacgcagcaacgccacgtgtgggacgacgcctttcggggtgtaaaccactgtcagcggggactagcccgcggagcaatccgcgccgaatgtacccgcagaggaagcaccggcaaacttc

SEQ ID NO: 1287 - DNA, 354 bp, Unknown
  Ascusbbf_1732332, encodes 16S rRNA
agagtttgatcatggctcaggacgaacgctggcggcgtgcctaatacatgcaagtcgagcgagccccttcgggggctagcggcggacgggtgagtaacacgtaggcaacctgcctctcagaccgggataacatagggaaacttatgctaataccggataggtttttggatcgcatgatcggaaaagaaaagatggcttcggctatcactgggagatgggcctgcggcgcattagctagttggtggggtaacggcccaccaaggcgacgatgcgtagccgacctgagagggtgaccggccacactgggactgagacacggcccagactcctacgggagccagcagccgcggtaat

SEQ ID NO: 1288 - DNA, 490 bp, Unknown
  Ascusbbf_197010, encodes 16S rRNA
agagtttgatcctggctcaggatgaacgctagcggcaggcttaacacatgcaagtcgaggggcagcgcgaggtagcaataccttggcggcgaccggcgaaagggtgagtaacgcgtgagcaacgtgcccgatactgggggatagtcattggaaacgatgtgtaataccccgtaacacaatggtccgcatgggctgttgttgagagatttatcgttatcggatcggctcgcgtaccattagctagttggtagggtaacggcctaccaaggcgacgatggttaggggttctgagaggaaggtcccccacattggaactgagacacggtccagactcctacgggaggcagcagtgaggaatattggtcaatggccgagaggctgaaccagccatgccgcgtgcgggaggacggccctatgggttgtaaaccgcttttgttggggagcaataaggtggacgtgtccgccgacgagagtacccagcgaataagca

SEQ ID NO: 1289 - DNA, 490 bp, Unknown
  Ascusbbf_190515, encodes 16S rRNA
agagtttgatcatggctcaggatgaacgctggcggcgtgcttaacacatgcaagtcgaacggactttactgaaaagagggcttgcccgatggaaggtaaagttagtggcggacgggtgagtaacgcgtgggcaacctgccttacacagggggacaacagttggaaacgactgctaataccgcataagccggtagtgccgcatggcacatccggaaaagattcatcggtgtaagatgggcccgcgttggattagttagttggcggggtaacggcccaccaagaccgcgatccatagccgacctgagagggtgatcggccacattgggactgagacacggcccaaactcctacgggaggcagcagtggggaatattgcgcaatgggggaaaccctgacgcagcaacgccgcgtgagtgaagaagtatttcggtatgtaaagctctatcagcagggaagaagatgacggtacctgcagaagaagtcccggcta

SEQ ID NO: 1290 - DNA, 490 bp, Unknown
  Ascusbbf_1079146, encodes 16S rRNA
agagtttgatcatggctcaggacgaacgctggcggcacgcttaacacatgcaagtcgaacggtgacggtttcaagcttgcttgaaactcgatcagtggcggacgggtgagtaacacgtgagcaatctgcctttaagtggggaataacgattggaaacggtcggtaataccgcataaaatagctgaaccgcatgatttggctatcaaagatttatcgcttaaagatgagctcgcgtctgattagctagttggtgaggtaacggcccaccaaggcgacgatcagtagccggactgagaggttgaacggccacattgggactgagacacggcccagactcctacgggaggcagcagtggggaatattgcacaatgggcgcaagcctgatgcagcgatgccgcgtgagggaagaaggttttcggattgtaaacctctgttgacagggacgataatgacggtacctgttcagaaagctccggctaactacgtgcc

SEQ ID NO: 1291 - DNA, 490 bp, Unknown
  Ascusbbf_1263310, encodes 16S rRNA
agagtttgatcctggctcaggatgaacgctggcggcgtgtttaacacatgcaagtcgagcgagaagcttctcagcagattcttcggatgatgcagagttgcggaagcggcggacgggtgagtaacgcgtaggcaacctgccccctgcagagggatagcctcgggaaaccgggattaaaacctcataacgcgcgaccgggacatcccggacgcgccaaagatttatcggcaggggatgggcctgcgtctgattagttagttggtggggtaacggcctaccaaggcgacgatcagtagccgacctgagagggtgatcggccacattggaactgagacacggtccaaactcctacgggaggcagcagtggaggatcttgcacaatgggcgcaagcctgatgcagcaacgccgcgtgaaggatgaaggcccttgggtcgtaaacttctgttctaagggaagataatgacggtaccttaggagcaagtcccggct

SEQ ID NO: 1292 - DNA, 490 bp, Unknown
  Ascusbbf_184531, encodes 16S rRNA
agagtttgatcatggctcaggatgaacgctagcggcaggcttaacacatgcaagtcgaggggcagcgcgcgggtagcaatacctgtggcggcgaccggcgcaagggtgcgtaacgcgtgagcaacatgcccgtgtcagggggataagcgatggaaacgtcgtctaataccgcataacaacaggaaggacatcctttttgtttgaaagatacgtcggacacggattggctcgcgagacattagctagacggcggggtaacggcccaccgtggcgacgatgtctaggggttctgagaggaaggtcccccacactggaactgagacacggtccagactcctacgggaggcagcagtgaggaatattggacaatggtcggaagactgatccagccatgccgcgtgaaggcagacggtcctatggattgtaaacttcttttgtacgggagcaataaggatcacgtgtggtccgatgagagtaccgtacgaataag

SEQ ID NO: 1293 - DNA, 490 bp, Unknown
  Ascusbbf_657443, encodes 16S rRNA
agagtttgatcctggctcaggatgaacgctagcgacaggcttaacacatgcaagtcgaggggcagcgcggcgtgagcaatcatgctggcggcgaccggcgcactggtgagtaacacgtatgcaacctgccccctgccggggaataacccagggaaacctggcctaatgccgcataacactggcggggacatccccgccggttgaaagctccggcggcaggggatgggcatgcgccgcattagcttgttggtggggcgacggcccaccaaggcgacgatgcgtaggggttctgagaggaaggtcccccacactggtactgagacacggaccagactcctacgggaggcagcagtgaggaatattggtcaatgggcgcgagcctgaaccagccaagtcgcgtgagggacgacggccctacgggttgtaaacctcttttgccggggagcaaccgcccgcacgcgtgcgggtctgagcgtacccggagaaaaag

SEQ ID NO: 1294 - DNA, 490 bp, Unknown
  Ascusbbf_717945, encodes 16S rRNA
agagtttgatcatggctcaggacgaacgctggcggcgtgcttaacacatgcaagtcgagcggggataacggaactgaagcctagcgaagaactgttatttcagcggcggacgggtgagtaacgcgtgagcaatctgtcccagacagggggataacacttggaaacaggtgctaataccgcataagaccacgatgtcacatgacattgaggtaaaaggagcaatccggtttggggtgagctcgcgtccgattagctagttggcgaggtaacggcccaccaaggcgacgatcggtagccgacctgagagggtgatcggccacattggaactgagacacggtccaaactcctacgggaggcagcagtgggaatattgggcaatgggcgaaagcctgacccagcaacgccgcgtgagggaagacggttttcggattgtaaacctctgtcctcagggacgaaggaagtgacggtacctgaggaggaagccccggc

SEQ ID NO: 1295 - DNA, 490 bp, Unknown
  Ascusbbf_411305, encodes 16S rRNA
agagtttgatcatggctcaggacgaacgctggcggcgtgcctaatacatgcaagtcgagcggagctagtgttttcttcggaaaacacgatgcttagcggcggacgggtgagtaacacgtaggtaacctgcccataagaccgggataacattcggaaacggatgctaataccggatacgcgattctctcgcatgagggagttgggaaaggcggagcaatctgtcacttatggatggacctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgctagagagagtaactgctctttaggtgacggt

SEQ ID NO: 1296 - DNA, 490 bp, Unknown
  Ascusbbf_709203, encodes 16S rRNA
agagtttgatcatggctcaggatgaacgctggcggcgtgcctaacacatgcaagtcgagcggagatgtacgccggaggaggtttcggccgaattcatgtacatcttagcggcggatgggtgaggaacgcgtgggcaacctgcccttcacagggggataacagctggaaacggctgttaataccgcatatgctcacagcaccgcatggtgcagggaggaaagcgatcagtggtgaaggatggacccgcgtcggattagccagttggtggggtaacggcctaccaaagcgatgatccgtagccggcctgagagggcgaccggccacattgggactgagacacggcccaaactcctacgggaggcagcagtgggggatattgcacaatggggggaaccctgatgcagcgacgccgcgtgaaggaagaagtgcttcggcatgtaaactttctttcagcagggaagaagatgacggtacctgcagaagaagcccc

SEQ ID NO: 1297 - DNA, 490 bp, Unknown
  Ascusbbf_213018, encodes 16S rRNA
agagtttgatcatggctcaggacgaacgctggcggcacgcttaacacatgcaagtcgaacggtgaaagtacttcggtactggatcagtggcggacgggtgagtaacacgtgagcaatctgcctttaagaggggaataacgactggaaacggtcggtaataccgcataacatatcgaagccgcatgactttgatatcaaagatttatcgcttaaagatgagctcgcgtctgattagctagttggtgaggtaacggcccaccaaggcgacgatcagtagccggactgagaggttgaacggccacattgggactgagacacggcccagactcctacgggaggcagcagtggggaatattgcacaatgggcgcaagcctgatgcagcgatgccgcgtgagggaagaaggttttcggattgtaaacctctgttgacagggacgataatgacggtacctgttcagaaagctccggctaactacgtgccagcagccg

SEQ ID NO: 1298 - DNA, 490 bp, Unknown
  Ascusbbf_122661, encodes 16S rRNA
agagtttgatcatggctcaggacgaacgctggcggcgtgcttaacacatgcaagtcgagcggaaaggccccttcgggggtactcgagcggcgaacgggtgagtaacacgtgagcaacctgcccctgactctgggataagcctgggaaaccgggtctaataccggatacgaccattgcgggcatccgttggtggtggaaagttttttcggtcggggatgggctcgcggcctatcagcttgttggtggggtgacggcctaccaaggcgacgacgggtaaccggcctgagagggcgaccggtcacactgggactgagacacggcccagactcctacgggaggcagcagtggggaatattgcgcaatgggcggaagcctgacgcagcgacgccgcgtgggggatgacggccttcgggttgtaaacctctttcagcggggacgaagccctttggggtgacggtacctgcagaagaagcgccggctaactacgtgc

SEQ ID NO: 1299 - DNA, 490 bp, Unknown
  Ascusbbf_1875326, encodes 16S rRNA
agagtttgatcatggctcaggattaacgctggcggcatgcctaagacatgcaagtcgaacggagtgccccattgaagtcagatgaagcggaagagcttgctcggaagtggatgaagacggaagtggattttgcactcagtggcgaacgggtgagtaacacgtgggttacctgcctctaagatggggacaacagttggaaacgactgctaataccgaatgtgatagagatattaaaggagcctttaaagcttcgcttagagatgggcctgcggcgtattagctagttggtggggcaatggcctaccaaggcaacgatgcgtagccggactgagaggttgaacggccacactgggactgagacacggcccagactcctacgggagacagcagttaggaatattcggcaatgggggaaaccctgaccgagcaatgccgcgtgtgagaagaaggtcctctggattgtaaatcacttttattgagaaagaaatgt

SEQ ID NO: 1300 - DNA, 490 bp, Unknown
  Ascusbbf_246663, encodes 16S rRNA
agagtttgatcatggctcaggatgaacgctagcggcaggcttaacacatgcaagtcgaggggcagcgcgggtagcaatatctggcggcgaccggcgaaagggtgagtaacgcgtgagcaacgtgcccgtctgagggggatagtcattggaaacgatgcgtaataccccgtaacaacagtcaccgcatggtgggtgtttgaaagatttattgcagacggatcggctcgcgtaccattagctagttggcggggtaacggcccaccaaggcaacgatggttaggggttctgagaggaaggtcccccacattggaactgagacacggtccagactcctacgggaggcagcagtgaggaatattggacaatggccgggaggctgatccagccatgccgcgtgcgggaagacggccctatgggttgtaaaccgcttttgtcggggagcaataagtagtacgcgtactacgatgagagtacctggcgaataagcatc

SEQ ID NO: 1301 - DNA, 490 bp, Unknown
  Ascusbbf_1150037, encodes 16S rRNA
agagtttgatcctggctcaggacgaacgctggcggcgtgcctaacacatgcaagtcgaacggttctagagactagactgtgggtgcctacataaaggagaagagagaggcatttagagtctagtatctaggatagtggcggacgggtgagtaacgcgtgagtaacctgccttagagagggggataacgttcggaaacggacgctaataccgcataacatcagaagatcgcatggttttcggatcaaaggagcaatccgctttaagatggactcgcgtccgattagctagttggtggggtaaaggcctaccaaggcaacgatcggtagccggactgagaggttgaacggccacattgggactgagacacggcccagactcctacgggaggcagcagtgggggatattgcacaatgggggaaaccctgatgcagcaacgccgcgtgagggaagaaggttttcggattgtaaacctctgtcgtaggtgaagaa

SEQ ID NO: 1302 - DNA, 490 bp, Unknown
  Ascusbbf_221789, encodes 16S rRNA
agagtttgatcctggctcagaacgaacgctggcggtatgcttaacacatgcaagtcgcacgagaaagttcttcggaatgagtaaagtggcgtacgggtgagtaatatataggaatctacccagtaatgaggaataagcactggaaacggtgtctaataccacatactaccgatttatcgggaaaggtttaatcttcgggttaaactgttattggatgagcctatatctgattagctagttggtggggtaaaggcctaccaaggcgatgatcagtagctgatctgagagggtgatcagccacattgggactgcgacacggcccaaactcctacgggaggcagcagtggggaatattggacaatgggcgaaagcctgatccagcaataccgcgtgaacgacgaaggccttcgggttgtaaagttcttttagtaggaaagataatgacggtacctacagaaaaagcaccggctaacttcgtgccagcagccgc

SEQ ID NO: 1303 - DNA, 490 bp, Unknown
  Ascusbbf_294338, encodes 16S rRNA
agagtttgatcctggctcaggatgaacgctggcggcgtgcttaacacatgcaagtcgaacggttaaggcaccttcgggtgcgcatagagtggcgaacgggtgagtaacacgtgaccaacctgccccccgcaccgggacaaccgccggaaacggcggctaataccggatgctccgggttccccgcatggggtccccgggaaagcccaggcggcgggggatggggtcgcggcccatcaggtagttggcggggtgacggcccaccaagcttacgacgggtagccgggctgagaggccgaccggccacattgggactgagatacggcccagactcctacgggaggcagcagtggggaattttgcgcaatgggggcaaccctgacgcagcaacgccgcgtgcgggatggaggccttcgggttgtaaaccgctttcagcagggaagaagccagacggtacctgcagaagaagccccggctaaatacgtgccagcag

SEQ ID NO: 1304 - DNA, 490 bp, Unknown
  Ascusbbf_151945, encodes 16S rRNA
agagtttgatcatggctcaggacgaacgctggcggtgtgcttaatacatgcaagtcgagcggaagaaaggggcttgctcctttctttagcggcggacgggtgagtaacgcgcgagcaacctgcctatatcaacggaataacacatagaaatgtgtgctaatgccgtataagaccacagtaaggcatcttacagcggtaaaagatttatcggatatagatgggctcacgtaccattagatagttggtagtgtaacggactaccaagtcgacgatggttagccgacctgagagggtgatcggccacattggaactgagatacggtccagactcctacgggaggcagcagtagggaatattgggcaatggaggcaactctgacccagcaacaccgcgtgaatgatgaaggtcttcggattgtaaagttctgtgatgggggacgaaaaaactgacggtaccccaatagcaagccacggctaactacgtgccagc

SEQ ID NO: 1305 - DNA, 490 bp, Unknown
  Ascusbbf_738230, encodes 16S rRNA
agagtttgatcatggctcaggacgaacgctggcggcgtgcttaacacatgcaagtcgagcggggataacggaactgagaacttcggttggatgatctgttattctagcggcggacgggtgagtaacgcgtgagcaatctgtcccagacagggggataacacttggaaacaggtgctaataccgcataagaccacggagcgacatcgctttgaggtaaaaggagtaatccggtttggggtgagctcgcgtccgattagctagttggcgaggtaacggcccaccaaggcgacgatcggtagccgacctgagagggtgatcggccacattggaactgagacacggtccaaactcctacgggaggcagcagtgggaatattgggcaatgggcgaaagcctgacccagcaacgccgcgtgagggaagaaggttttcggattgtaaacctctgtcctcagggacgaaggaagtgacggtacctgaggaggaagccc

SEQ ID NO: 1306 - DNA, 490 bp, Unknown
  Ascusbbf_419191, encodes 16S rRNA
agagtttgatcatggctcaggacgaacgctggcggcgtgcctaacacatgcaagtcgaacgaagctgcgatgaaggaggcttcggccaatggattcgtagacttagtggcggacgggtgagtaatgcgtgagcaacctgcccttcagagggggacaacagttggaaacgactgctaataccgcatgacatctacggaaggcatcttgtgtagatcaaagatttatcgctgaaggatgggctcacgtctgattagctagttggtgaggtaacggctcaccaaggctgcgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttatgaggaacgaaggacgtgacggtacctcatgaataagccacg

SEQ ID NO: 1307 - DNA, 490 bp, Unknown
  Ascusbbf_730938, encodes 16S rRNA
agagtttgatcatggctcaggatgaacgctggcggcgtgcctaacacatgcaagtcgagcgggagtatgtggagcagagattcgtcaaagcaagacatacgagagcggcggacgggtgagtaacgcgtaggtaacctaccttaagctgagggataacccagggaaacccgggataataccacataatgcgggggagtcacatggtcccctcgccaaagatttatcggcataagatggacctgcgtctgattagccagttggtggggtaacggcctaccaaagcaacgatcagtagccgacctgagagggtgatcggccacattggaactgagacacggtccaaactcctacgggaggcagcagtggggaatattgcacaatgggcgcaagcctgatgcagcaacgccgcgtgagcgaagaaggtcttcggatcgtaaagctctgtcctaagggacgaagaagtgacggtaccttaggaggaagccccggc

SEQ ID NO: 1308 - DNA, 490 bp, Unknown
  Ascusbbf_151670, encodes 16S rRNA
agagtttgatcctggctcaggacgaacgctggcggcgtgcttaacacatgcaagtcgagcggaaaggcctttcggggtactcgagcggcgaacgggtgagtaacacgtgagtgacctgcccttcactttgggataagccctggaaacggggtctaataccgaatattcatcactggctgcatggctggtggtggaaagcttttgcggtgaaggatgggctcgcggactatcagcttgttggtggggtgatggcctaccaaggctttgacggttagccggcctgagagggtgtccggccacactgggactgagacacggcccagactcctacgggaggcagcagtggggaatattgcgcaatgggcgaaagcctgacgcagcgacgccgcgtgagggatgacggccttcgggttgtaaacctctttcggtagggacgaagcgaaagtgacggtacctgcagaagaagcaccggccaactacgtgccagcag

SEQ ID NO: 1309 - DNA, 360 bp, Unknown
  Ascusbbf_332212, encodes 16S rRNA
agagtttgatcatggctcaggatgaacgctagcggcaggcttaacacatgcaagtcgaggggcagcgcggggtagcaatactctggcggcgaccggcgaaagggtgagtaacgcgtgagcaacgtgcccgtatgtgggggatagtcgatggaaacgtcgcgtaataccccgtaacacaaatcttcgcatggggatttgttgaaagattcattgcatacggatcggctcgcgtgccattaggtagacggcggggtaacggcccaccgtgccgacgatggctaggggttctgagaggaaggtcccccacattggaactgagacacggtccagactcctacgggagccagcagccgcggtaat

SEQ ID NO: 1310 - DNA, 490 bp, Unknown
  Ascusbbf_1566992, encodes 16S rRNA
agagtttgatcatggctcagaacgaacgctggtagcgtggattaggcatgcaagtcgaacgggatccggaaggcagcaatgtcggccggtgagagtggcggaagggcgaggaacacgtgggcaacctgtccttgaggtggggaaaaccgctggaaacggcggctaataccgaatgtggcgccgggaggcatcttccgagcgccaaagggggcgaaagctccccctcatcgaggggctcgcgcaccatcagcttgttggcggggtaacggcccaccaaggcttacggttagctggtctgagaggatggccagccgcactgggactgagatactgcccagactcctacgggaggctgcagtcgaggatcattcgcaatgggcgaaagcctgacgatgcgacgctgcgtggaggatgaaggccttcgggttgtaaactcctgtcatgagggaaaaggagaacctgcccaatacgcaggggatttgatggtacc

SEQ ID NO: 1311 - DNA, 490 bp, Unknown
  Ascusbbf_438876, encodes 16S rRNA
agagtttgatcctggctcaggatgaacgctggcggcgtgcctaatacatgcaagtcgagcgagaaatcttttaaagattcttcggatgaattaaaaggcggaaagcggcggacgggtgagtaacgcgtaggcaacctgccctttgcacagggatagccactggaaacggtgattaatacctgataatgcagttctgtagcatttcagaactgccaaagatttatcggcagaggatgggcctgcgtctgattagctggttggtgaggtaacggcccaccaaggcgacgatcagtagccgacctgagagggtgatcggccacattggaactgagacacggtccaaactcctacgggaggcagcagtagggaatcttgcacaatgggcgcaagcctgatgcagcaacgccgcgtgagcgatgaaggcccttcgggtcgtaaagctctgtcctaggggaagaaacaaatgacggtacccttggaggaagccccg

SEQ ID NO: 1312 - DNA, 490 bp, Unknown
  Ascusbbf_314242, encodes 16S rRNA
agagtttgatcatggctcaggatgaacgctggcggcgtgcctaacacatgcaagtcgagcgagaagagaatgacctattcttcggatgaagccattctcggacagcggcggacgggtgagtaacacgtaggaaacctgccctttactgggggatagccgagggaaacttcgagtaataccccataacgcgttatgatcgcatgatcgaaacgccaaagatttatcggtaagggatggtcctgcgtccgattagccagttggtgaggtagcggctcaccaaagcgacgatcggtagccggcctgagagggcggacggccacattggaactgagacacggtccagactcctacgggaggcagcagtggggaatattgcacaatggaggaaactctgatgcagcaacgccgcgtgagcgaagaaggtcttcggatcgtaaagctctgtccttggggaagaaacaaatgacggtacccttggaggaagccccgg

SEQ ID NO: 1313 - DNA, 490 bp, Unknown
  Ascusbbf_1725526, encodes 16S rRNA
agagtttgatcctggctcagaatgaacgttggcggcatggattaggcatgcaagtcgagcgagaagagtcatttgcttgcatttgactcggaaagcggcgtaagggtgagtaacgcgtagttacctacctccgggtccggaatagctgcgggaaactgcaggtaatgccggataacatctcaggatcaaaggtgagattccgcccggagaggggactgcgtcctactagcttgttggtggggtaatggcctaccaaggcttcgatgggtagcgggcgtgagagcgtggcccgtcacactgggactgagacactgcccagacacctacgggtggctgcagtcgagaatcttcggcaatgggcgaaagcctgaccgagcaatgccgcgtgcgggatgaaggccctcgggttgtaaaccgcgaaagtaaggaggaaggacctgcgaagagcaggttttgaccgatctacagtaaggacgggctaagttcgtgc

SEQ ID NO: 1314 - DNA, 490 bp, Unknown
  Ascusbbf_1725709, encodes 16S rRNA
agagtttgatcctggctcaggattaacgctggcggcgtgcataacacattcaagtcgaacggacggaagagcttcggttcttacgtcagtggcggacgggtgagtaacgcgtgagcaatctgccctttacagcgggataacacagagaaatttgtgctaatacggcataacatatcggagtcgcatggcattggtatcaaagatttatcggtaaaggatgagctcgcgtccgattagatagttggtgacggtaacggcgcaccaagtcgacgatcggtagccggactgagaggtcgaacggccacattgggactgagacacggcccagactcctacgggaggcagcagtggggaatattggacaatgggggaaaccctgatccagcgacgccgcgtgaaggaagaaggccttcaggttgtaaacttcagttagcagggaagaaagcaatgacggtacctgcagggaaagccacggctaactacgtgccag

SEQ ID NO: 1315 - DNA, 490 bp, Unknown
  Ascusbbf_769782, encodes 16S rRNA
agagtttgatcatggctcaggatgaacgctggcggcatgcctaagacatgcaagtcaagcggagtgacccattgaagttggagtgcttgcacaaagacggatttggattttcactcagcggcagacgggtgagtaacgcgtgggtaatctacctcaaagactgggataacttctggaaacggatgctaataccggatgattcatatttagataactagatatgctaaaaggagcttttgcttcactttgagatgagcttgcgttgtattagctagttggtggggtaatggcctaccaaggcaacgatgcatatccgagctgagaggctgatcggacacattgggactgagacacggcccagactcctacgggagacagcagttaggaatattcgtcaatgggggaaaccctgaacgagcaatgccgcgtgaatgacaatcctctggattgtaaagttctgttgtaaaggaagaaaccttactataggtaa

SEQ ID NO: 1316 - DNA, 490 bp, Unknown
  Ascusbbf_1712151, encodes 16S rRNA
agagtttgatcatggctcaggatgaacgctggcggcgcgcataacacatgcaagtcgaacggagtgtgattgaaacctagtgatatcacacttagtggcggacgggtgagtaaagcgtgggtaacctgcctgatattgggggacaacagttagaaatgactgctaataccgcataagtcattgaggaggcatctctttaatgggaaaggaaatatccgataccagatggacccgcgtctgattagctagttggtgaggtaacggcccaccaaggcgacgatcagtagccgaactgagaggttgaccggccacattgggactgaggcacggcccaaactcctacgggaggcagcagtggggaatattgcacaatggggggaaccctgatgcagcgacgccgcgtgagtgatgaagtatttcggtatgtaaagctctatcgatggggaagaaaatgacggtacccaagtaagaagccccggctaactacgtg

SEQ ID NO: 1317 - DNA, 490 bp, Unknown
  Ascusbbf_302905, encodes 16S rRNA
agagtttgatcatggctcaggatgaacgctagctacaggcttaacacatgcaagtcgaacggagcttagcggaagcttgcttctgcgaaagcttagtggcggacgggtgagtaacgcgtgagtaacctgccttaaagagggggataacacagagaaatttgtgctaataccgcataatgtagcgaagccgcatgactttgctaccaaaggtcagccgctttaagatggactcgcgtccgattaggtagttggtgaggtaacggcccaccaagccgacgatcggtagccggactgagaggtcgaacggccacattgggactgagacacggcccagactcctacgggaggcagcagtagggaatattgcgcaatgggggcaaccctgacgcagcaataccgcgtgaaggatgacggttttcggattgtaaacttcagcaagcagggaagaaaaaaatgacggtacctgaacaaaagccacggctaactacgt

SEQ ID NO: 1318 - DNA, 490 bp, Unknown
  Ascusbbf_3663, encodes 16S rRNA
agagtttgatcctggctcaggataaacgctggcggcgcacataagacatgcaagtcgaacggaagtcgttataaaatgaattgaagaattctctgattgaagttttataacaatggctttagtggcggactggtgagtaatgtataagtaacctgcctattagaggggaacaacagttggaaacgactgctaataccgcatatgccataggaaccgcatggttctggtgggaaaggagcaatccgctgatagatggacttatatctgattagttagttggtagggtaacggcctaccaagacgacgatcagtagccggactgagaggttaaacggccacattgggactgagatacggcccagactcctacgggaggcagcagtcgggaatattgcgcaatggaggaaactctgacgcagtgacgccgcgtgcaggaagaaggttttcggattgtaaactgctttagacagggaagaaaaaagacagtacc

SEQ ID NO: 1319 - DNA, 490 bp, Unknown
  Ascusbbf_34526, encodes 16S rRNA
agagtttgatcatggctcaggatgaacgctggcggcgtgcgtaacacatgcaagttgagcgacgacgcatctgaagtggcaacatggaaggtgcgagcggagcagcggacgggtgagtataacatgagaagctgtcctctggtggggggcaacgtctagaaatggacgctaataccccataggccgaaaggttaaagcagcaatgtgccagaggaggtgctcgtgccctatcagctagttggtgaggtaatggctcaccaaggcgacgacgggtagccggcctgagagggtgtccggccacactgggactgagatacggcccagactcctacgggaggcagcagtggggaatattgggcaatgggagaaatcctgacccagcgacgccgcgtgaacgaagaaggccttcgggtcgtaaagttcttttatgcgggaagaagaaagtgacggtaccgcatgaataagccccggctaactacgtgccagcagc

SEQ ID NO: 1320 - DNA, 490 bp, Unknown
  Ascusbbf_16867, encodes 16S rRNA
agagtttgatcctggctcaggataaacgctggcggcgcacataagacatgcaagtcgaacgaacttaatagaaatgtttacatttttaagcggttagtggcggactggtgagtaacatgtaagcaatctgcctatcagaggggaataacagtgagaaatcattgctaataccgcatatgccatagaaatcgcatgattttagtgggaaaggagcaatccgctgatagatgagcttgcacctgattagctagttggtggggtaaaggcctaccaaggcgacgatcagtagccggactgagaggttgaacggccacattgggactgagatacggcccagactcctacgggaggcagcagtcgggaatattgcgcaatggaggaaactctgacgcagtgacgccgcgtatgggaagaaggttttcggattgtaaaccattttagacagggaagaaaaaagacagtacctgtagaataagctccggctaactac

SEQ ID NO: 1321 - DNA, 490 bp, Unknown
  Ascusbbf_129482, encodes 16S rRNA
agagtttgatcatggctcaggatgaacgctagcggcaggcctaacacatgcaagtcgaggggtaaaggcagcttgctgctttgagaccggcgcacgggtgcgtaacgcgtatgcaatctaccttatactaagggatagcccggagaaatccggattaataccttatggtttttatgaatagcattatttatagaataaagatttatcggtataagatgagcatgcgtcccattagttagttggtgtggtaacggcacaccaagacgatgatgggtaggggtcctgagagggagatcccccacactggtactgagacacggaccagactcctacgggaggcagcagtgaggaatattggtcaatggaggcaactctgaaccagccatgccgcgtgcaggatgacggtcctatggattgtaaactgcttttgtacgggaagaaaaagagctacgtgtagtttattgacggtaccgtaagaataaggatcggc

SEQ ID NO: 1322 - DNA, 490 bp, Unknown
  Ascusbbf_235447, encodes 16S rRNA
agagtttgatcatggctcaggacgaacgctggcggcgtgcctaacacatgcaagtcgagcgaagcttttaaagtgaattctttcgggatgaaactttaattgtcttagcggcggacgggtgagtaacgcgtgagaaacctgcctttcacaaagggatagcctcgggaaactgggattaataccttatgatacttaactaccgcatggtagagaagtcaaagcgtaaagcggtgaaagatggtctcgcgtcccattagttagttggtgaggtaacggctcaccaagactacgatgggtagccggcctgagagggtgaacggccacactggaactgagacacggtccagactcctacgggaggcagcagtggggaatattgcacaatggaggaaactctgatgcagcgacgccgcgtgaacgatgaaggctttcgggtcgtaaagttctgtcctaggggacgataatgacggtaccctaggaggaagccccg

SEQ ID NO: 1323 - DNA, 490 bp, Unknown
  Ascusbbf_1023866, encodes 16S rRNA
agagtttgatcatggctcaggacgaacgctggcggcacgcctaacacatgcaagtcgaacggagaaaatagcttcggttgttttcttagtggcggacgggtgagtaacacgtgaggaacctgcctctgagagtgggatagcttctggaaacggatggtaataccgcataacatagcgaaaccgcatgattttgctatcaaagtatttcgctcagggatggcctcgcgtctgattagatagttggtgaggtaacggctcaccaagtcgacgatcagtagccggactgagaggttgaacggccacattgggactgagacacggcccagactcctacgggaggcagcagtgggggatattgcacaatgggggaaaccctgatgcagcgatgccgcgtggaggaagaaggttttcggattgtaaactcctgtcgtaagggaagaggaaggactgtaccttacaagaaagctccggctaactacgtgccagcagc

SEQ ID NO: 1324 - DNA, 490 bp, Unknown
  Ascusbbf_377989, encodes 16S rRNA
agagtttgatcctggctcaggatgaacgctagcgataggcttaacacatgcaagtcgaggggcagcagggacttcggtctgctggcgaccggcgcacgggtgcgtaacgcgtatgcaacttgcctcacacagggggataacccgttgaaagacggactaataccgcatacacttattggatggcatcatttgataaggaaagatttattggtgtgagataggcatgcgtcccattagctagttggtgaggtaacggctcaccaaggcgacgatgggtaggggaactgagaggttgaacccccacactggtactgagacacggaccagactcctacgggaggcagcagtgaggaatattggtcaatgggcgagagcctgaaccagccaagtcgcgtgaaggatgacggtcttatggattgtaaacttcttttatacgggaataatttgcgtcacgtgtggcgtattgaatgtaccgtatgaataagcatcg

SEQ ID NO: 1325 - DNA, 486 bp, Unknown
  Ascusbbf_454121, encodes 16S rRNA
agagtttgatcctggctcagaatgaacgttggcagcgtggattaggcatgcaagtcgagcgacaaggtccttcgggactggaggagcggcaaacggggtagtaaggcatcggaacgtaccctcttgtccgggatagctgcgggaaactgcaagtaataccggataatctcttcggagcaaaggtccgccgcgggaggagcggccgatgtgatatcaggtagttggcggggtaacggcccaccaagccatcgacgtctagggggtgtgagagcatggcccccaccactgggactgagacactgcccagacacctacgggtggctgcagtcgagaatcttcggcaatgggcgaaagcctgaccgagcaacgctgcgtgcgggatgacggcccttgggttgtaaaccgctgtcagaggggatgaaagcgaaagcttgacagagcctcagaggaagcgcgggctaagttcgtgccagcagccgcggtaat

SEQ ID NO: 1326 - DNA, 490 bp, Unknown
  Ascusbbf_1283184, encodes 16S rRNA
agagtttgatcctggctcaggacgaacgctggcggcgtgcttaacacatgcaagtcgaacggggatgctttggcggaatttttcgaaaggaagcggaagtattctagtggcgaacgggtgagtaacgcgtgaacaacctgccctggagtgggggataacatttggaaacagatgctaataccgcatgagaccacagcccggcatcggggaggggtcaaagaataatcgctctgggaggggttcgcgtcccattaggtagttggtgagataacagcccaccaagccgacgatgggtagccgagctgagaggctgaacggccacactggaactgagacacggtccagactcctacgggaggcagcagtggggaatattgggcaatgggcgcaagcctgacccagcaacgccgcgtgagggaagaaggttttcggattgtaaacctctgtcgcaagggacgaaggagtgacggtaccttgtgaggaagccccg

SEQ ID NO: 1327 - DNA, 490 bp, Unknown
  Ascusbbf_1705112, encodes 16S rRNA
agagtttgatcctggctcaggatgaacgctagctacaggcttaacacatgcaagtcggggggaaacggagacgggagcttgctcttgtcagacgtcgaccggcggatgggtgcgtaacgcgtatccaacctgcccgtgtcccggggatagcccatggaaacgtggattaacacccgatggtccgtactttccgcatggcgggtacggtaaacgcgagggacatggatggggatgcgtaccattaggcagcaggcggggtaacggcccacctggcccgcgatggttaggggttctgagaggaaggccccccacactgggactgagacacggcccagactcctacgggaggcagcagtgaggaatattggtcaatgggcgagagcctgaaccagccaagtagcgtgcaggatgacggccctacgggttgtaaactgcttttatgcggggataaagagtgccacgtgtggcacgttgcaggtaccgcatgaat

SEQ ID NO: 1328 - DNA, 490 bp, Unknown
  Ascusbbf_1855213, encodes 16S rRNA
agagtttgatcatggctcaggacgaacgctggcggcgtgcctaatacatgcaagtcgagcggggtggagggtcgcaagacccaaagcctagcggcggacgggtgagtaacacgtaggcaacctgcctgtaagaccgggataacttcgggaaaccgaagctaataccggataactcttaagaccgcatggtcttaagctaaaaggacgcgatccacttacagatgggcctgcggcgcattagctagttggtgaggtaacggctcaccaaggcgacgatgcgtagccgacctgagagggtgaccggccacactgggactgagacacggcccagactcctacgggaggcagcagtagggaatcttctgcaatggacgaaagtctgacagagcaatgccgcgtgagtgaagaaggtcttcggattgtaaaactctgttgtcagggaagaacacccgggagaggatcccggcttgacggtacctgacgagaaagc

SEQ ID NO: 1329 - DNA, 483 bp, Unknown
  Ascusbbf_1082151, encodes 16S rRNA
agagtttgatcatggctcaggatgaacgctagcgagacgcttaacacatgcaagtcgaatgctgatttatcagcatggcagacgggtgagtaacacgtgcttaatttgccccggagtgggggacaacatcggaaacggtgataatcccgcatacgttccataaaatgaaaatatatggaagaaaggtttatcgctctgggaggagggcgcggctgactagttagttggtgaggtaatggctcaccaagacgatgatcagtagctggtctgagaggacgaacagccacaatgggactgagacaaggcccatacccctacggggggcagcagtggggaatcttgcgcaatggacgaaagtctgacgcagcgatctcgcgtgaaggatgaagctttgcggagtgtaaacttcttttctgggagaaaacgactgatggtatctcaggaataagggacggctaactacgtgccagcagccgcggtaat

SEQ ID NO: 1330 - DNA, 490 bp, Unknown
  Ascusbbf_1152603, encodes 16S rRNA
agagtttgatcatggctcaggatgaacgctagctacaggcttaacacatgcaagtcgaggggtaacgacagcgaaagcttgcttttgctgggcgacgaccggcgcacgggtgagtaacgcgtatccaacctgcccataactaagggataatccgtagaaatgcggtctaataccttatgtgttccgacgaggacatctgaattggaataaagatttatcggttatggatggggatgcgtctgattagattgttggcggggcaacggcccaccaagtctacgatcagtggagactctgagaggaagatcccccacattggaactgaaacacagtccaaactcctacaaaaaacaacagtgaggaatattaatcaatgggcgaaagcctgaaccagccaagtagcgtgcaggaagacggccctatgggttgtaaactgcttttgtatggggataaagtgctccacgtgtggagttttgtaggtaccatacga

SEQ ID NO: 1331 - DNA, 490 bp, Unknown
  Ascusbbf_29453, encodes 16S rRNA
agagtttgatcatggctcaggatgaacgctggcggcgtgcctaacacatgcaagtcgagcgggaatcatctgattgaaacttcggtagatagaggatgaggatagcggcggacgggtgagtaacgcgtaggtaacctgccccttacacagggatagcctcgggaaactgggattaatacctgataatgcggtgaagtcacatggctttaccgccaaagatttatcggtgagggatggacctgcgtctgattagctggttggtgaggtaacggcccaccaaggcaacgatcagtagccgacctgagagggtaatcggccacattggaactgagacacggtccaaactcctacgggaggcagcagtggggaatattgcacaatgggcgcaagcctgatgcagcaacgccgcgtgagcgaagaaggtcttcggatcgtaaagctctgtcctcaggaacgaagaagtgacggtacctgaggaggaagccccggc

SEQ ID NO: 1332 - DNA, 490 bp, Unknown
  Ascusbbf_108828, encodes 16S rRNA
agagtttgatcatggctcaggacgaacgctggcggcgtgcttaatacatgcaagtcgaacggagatattccgccgttcaaggtttcggctgagaacatgggatatcttagtggcgaacgggtgagtaacgcgtgaacaacctgactcaaagagggggataacaacgggaaactgttgctaataccgcataagaccacgccctcgcatgggggaggggtaaaagatttatcgctttgagaggggttcgcgtcccattaggtagttggaggggtaacggcccaccaagccgacgatgggtagccgagctgagaggctgatcggccacactggaactgagacacggtccagactcctacgggaggcagcagtagggaatattgggcaatgggcgcaagcctgacccagcaacgccgcgtgagggaagaaggttttcggattgtaaacctctgtcctatgtgacgaaggaagtgacggtagcataggaggaagc

SEQ ID NO: 1333 - DNA, 490 bp, Unknown
  Ascusbbf_48301, encodes 16S rRNA
agagtttgatcatggctcaggatgaacgctagcggcaggcttaacacatgcaagtcgaggggcagcgcggagtagcaatactttggcggcgaccggcgaaagggtgagtaacgcgtgagcaacatgcccgcatctgggggatagtcgatggaaacgtcgcgtaataccccgtaacaacagttcccgcatgaggattgtttaagagatttattgaatgcggattggctcgcgtgccattagatagttggtgaggtaacggcccaccaagtcgacgatggctaggggttctgagaggaaggtcccccacattggaactgagacacggtccagactcctacgggaggcagcagtgaggaatattggacaatggccgagaggctgatccagccatgccgcgtgcgggatgaaggccctatgggtcgtaaaccgcttttgtcggggagcaataaggtgtacgtgtacaccgatgagagtacctggcgaataagca

SEQ ID NO: 1334 - DNA, 490 bp, Unknown
  Ascusbbf_148531, encodes 16S rRNA
agagtttgatcatggctcaggatgaatgctggcggcgtgcctaatacatgcaagtcgagcggtaacagggtttcaccgtttccttgacacacctagcgcattatcgtaggtggtgagacttcgagggaacagtgaaactgctgacgagcggcggacggctgagtaacgcgtgggaacgtaccccaaactgagggataacgcaccgaaaggtgtgctaataccgcatatgatcttcggattaaagctttcgggcggtttgggaatggcctgcgtacgattagatagttggtagggtaacggcctaccaagtcgacgatcgttagatggtttgagaagatgatcatccagactgggactgagacacggcccagactcctacgggaggcagcagtagggaatctttcacaatgggcgaaagcctgatggagcaacgccgcgtgcaggatgacggccttcgggttgtaaactgcttttataagcgagaaatatg

SEQ ID NO: 1335 - DNA, 490 bp, Unknown
  Ascusbbf_294310, encodes 16S rRNA
agagtttgatcctggctcaggatgaacgctagcgacaggcttaacacatgcaagtcgaggggcagcggaggtaaaggcttgcctttacctgccggcgaccggcgcacgggtgagtaacacgtatgcaacctggccgtcacaggaggataaccgggagaaattccgcctaatactccataacactttcggaggacatcctccggaagtcaaagggattcgttccggtgacggatgggcatgcggcgcattagctagtcggcggggtaacggcccaccgaggcgacgatgcgtaggggttctgagaggaaggtcccccacattggaactgagacacggtccaaactcctacgggaggcagcagtgaggaatattggtcaatgggcggaagcctgaaccagccaagtcgcgtgagggaataaggccctaagggtcgtaaacctcttttgccggggagcaatggtcctcttgcgaggggacagggagagtaccc

SEQ ID NO: 1336 - DNA, 490 bp, Unknown
  Ascusbbf_1714782, encodes 16S rRNA
agagtttgatcatggctcaggatgaacgctggcggcgtgcttaacacatgcaagtcgaacggagtgctcttgaaagaggattcgtccaattgatagagttacttagtggcggacgggtgagtaacgcgtgaggaacctgccttggagtggggaataacacagagaaatctgtgctaataccgcataatgcatttgggtcgcatgactcggaatgccaaagatttgtcgctctgagatggcctcgcgtctgattagctagttggaggggtaacggcccaccaaggcaacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttatcagggacgaacaaatgacggtacctgatgaataagccacg

SEQ ID NO: 1337 - DNA, 490 bp, Unknown
  Ascusbbf_149069, encodes 16S rRNA
agagtttgatcatggctcaggatgaacgctggcggcgtgcttaacacatgcaagtcgaacgaagcactcaggagcgacttcggtcaatcctgtttgacttagtggcggacgggtgagtaacgcgtgaggaacctgccttgcagtggggaataacagttggaaacgactgctaataccgcataatgcagagagatcgcatggtctttctgccaaagatttatcgctgtgagatggcctcgcgtctgattagctagttggtgaggtaacggcccaccaaggcgacgatcagtagccggactgagaggttgatcggccacattgggactgagacacggcccagactcctacgggaggcagcagtggggaatattgggcaatgggcgcaagcctgacccagcaacgccgcgtgaaggaagaaggctttcgggttgtaaacttcttttattagggacgataatgacggtacctattgaataagctccggctaact

SEQ ID NO: 1338 - DNA, 490 bp, Unknown
  Ascusbbf_338415, encodes 16S rRNA
agagtttgatcctggctcaggatgaacgctagcgacaggcttaacacatgcaagtcgtggggcagcgggggtgaaggcttgccttcacctgccggcgaccggcgcacgggtgagtaacacgtatgcaacctggccgtgacaggaggataaccggtagaaatgccgcctaatactccataacactttgcggggacatccccgtgaggtcaaaggaagcgattccggtcacggatgggcatgcggcgcattagctagtcggcggggtaacggcccaccgaggcgacgatgcgtaggggttctgagaggaaggtcccccacattggaactgagacacggtccaaactcctacgggaggcagcagtgaggaatattggtcaatgggcgaaagcctgaaccagccaagtcgcgtgagggaataaggccctatgggtcgtaaacctcttttgccggggagcaagatcggggacgtgtcccagattggagagtaccc

SEQ ID NO: 1339 - DNA, 490 bp, Unknown
  Ascusbbf_683365, encodes 16S rRNA
agagtttgatcctggctcaggatgaacgctagctacaggcttaacacatgcaagtcgaggggaaacggaagggaaagcttgctttccctagacgtcgaccggcggatgggtgcgtaacgcgtatccaacctgcccgtgtcccggggatagcccatggaaacgtggattaacacccgatggtcctgcgcttccgcatggcggcgcaggtaaacgttagggacatggatggggatgcgtaccattaggcagcaggcggggtaacggcccacctggcccgcgatggttaggggttctgagaggaaggccccccacactgggactgagacacggcccagactcctacgggaggcagcagtgaggaatattggtcaatgggcgagagcctgaaccagccaagtagcgtgcaggatgacggccctacgggttgtaaactgcttttatgcggggataaagagtgccacgtgtggcacgttgcaggtaccgcatgaat

SEQ ID NO: 1340 - DNA, 490 bp, Unknown
  Ascusbbf_591702, encodes 16S rRNA
agagtttgatcctggctcaggatgaacgctagctacaggcttaacacatgcaagtcgaggggcagcattatcttagcttgctaagatagatggcgaccggcgcacgggtgagtaacacgtatccaaccttccggttactcggggataggctttcgaaagaaagattaatacccgatgttgcgtatctttctcctgaaagatacgccaaaggattccggtaaccgatggggatgcgttccattaggcagttggcggggtaacggcccaccaaaccttcgatggataggggttctgagaggaaggtcccccacattggaactgagacacggtccaaactcctacgggaggcagcagtgaggaatattggtcaatggacgcaagtctgaaccagccaagtagcgtgaaggatgactgccctctgggttgtaaacttcttttatacgggaataacatgaggtacgcgtaccttattgcatgtaccgttatgaat

SEQ ID NO: 1341 - DNA, 490 bp, Unknown
  Ascusbbf_741269, encodes 16S rRNA
agagtttgatcctggctcaggatgaacgctggcggcgtgcctaatacatgcaagtcgaacgagttctgattattgaagggtgcttgcatcttgatttaattttgaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgtt

SEQ ID NO: 1342 - DNA, 490 bp, Unknown
  Ascusbbf_1324292, encodes 16S rRNA
agagtttgatcatggctcaggatgaacgctagcgacaggcctaacacatgcaagtcgaggggcaacggggagctgagcttgctcagttctgccggcgaccggcgcacgggtgagtaacgcgtatgcaaccttcccttttcagggggataacccggagaaatccggcctaatatcccatggttcctttctgaggcatcttaggaagggtaaaggagcgatccggaaaaggatgggcatgcgtgacattagctagttggcggagtaacggcccaccaaggcgacgatgtctaggggttctgaggggaaggacccccacactggtactgagacacggaccagactcctacgggaggcagcagtgaggaatattggtcaatgggcgatagcctgaaccagccaagtcgcgtgagggaagacggccctatgggttgtaaacctcttttgtcagggaacaatgaccggtacgtgtaccgggagagagtgtacctga

SEQ ID NO: 1343 - DNA, 490 bp, Unknown
  Ascusbbf_1502622, encodes 16S rRNA
agagtttgatcctggctcaggacgaacgctggcggcgcgcctaacacatgcaagtcgaacggagataatggaggagcttgctccactgttatcttagtggcggacgggtgagtaacacgtgggcaacctgcctttcagagggggataacgtttggaaacgaacgctaatacctcataacatcataatgtggcatcatattgtgatcaaaggagcaatccgctgaaagatgggctcgcgtccgattagatagttggtgaggtaacggcccaccaagtcgacgatcggtagccggactgagaggttgaacggccacattgggactgagacacggcccagactcctacgggaggcagcagtggggaatattgcacaatgggggaaaccctgatgcagcgacgccgcgtgagggaagaaggttttcggattgtaaacctctgtctttggtgacgataatgacggtagccaaagaggaagctacggctaactacg

SEQ ID NO: 1344 - DNA, 490 bp, Unknown
  Ascusbbf_1494899, encodes 16S rRNA
agagtttgatcctggctcaggacgaacactggcggcgtgcctaatacatgcaagtcgagcgaagtgaagagagcttgctcttggaacttagcggcaaacgggtgagtaacacgtgggcaacctgcctgacagactgggataacttcaggaaactggagctaataccggataggatcgcgaaccgcatggaacgcgatggaaagtctgaacgacactgtcagatgggcccgcggcgcattagctagttggtagggtaatggcctaccaaggcaacgatgcgtagccgacctgagagggtgaccggccacactgggactgagacacggcccagactcctacgggaggcagcagtagggaatcttccacaatgggcgaaagcctgatggagcaacgccgcgtgagtgatgaaggttttcggatcgtaaaactctgttgttagggaagaacacccgggagaggatcccggtttgacggtacctaacgaggaagc

SEQ ID NO: 1345 - DNA, 490 bp, Unknown
  Ascusbbf_1186955, encodes 16S rRNA
agagtttgatcatggctcaggacgaacgctggcggcgtgcttcaaacatgcaagtcgaacggagtgaagttgaaagcttgcttttaactttacttagtggcggactggtgagtaacgcgtgagtaatctgcctatcacagggggataacagttggaaacgactgctaataccgcataagaccacatgatggcatcatcgaggggtcaaagggttactggtgatagatgagcttgcgtatcattagctagttggtgagggtaatggcccaccaaggcgacgatgattagccgatctgagaggatgaccggccacactggaactgagatacggtccagactcctacgggaggcagcagttaggaatattgggcaatggaggaaactctgacccagcaacgccgcgtgaaggaagaaggttttcggactgtaaacttctgatctaggggaaaaagaaagtgatggtaccctaggagaaagccacggctaacta

SEQ ID NO: 1346 - DNA, 490 bp, Unknown
  Ascusbbf_34177, encodes 16S rRNA
agagtttgatcctggctcaggacgaacgctggcggcgtgcctaacacatgcaagtcgaacggagttttttaagatgaagttttcggatggaattttagaaaacttagtggcggacgggtgagtaacgcgtgagtaacctgccgatgagagggggataacgttctgaaaagaacgctaataccgcatgacatatcgaagccgcatgactttgatatcaaaggagtgatccgctcatcgatggactcgcgtccgattagctggttggcggggtaacggcccaccaaggcgacgatcggtagccggactgagaggttgaacggccacattgggactgagacacggcccagactcctacgggaggcagcagtgggggatattgcgcaatgggggaaaccctgacgcagcaacgccgcgtgaaggatgaaggtcttcggattgtaaacttcttttgttaaggacgaagaaagtgacggtacttaacgaataagct

SEQ ID NO: 1347 - DNA, 490 bp, Unknown
  Ascusbbf_84901, encodes 16S rRNA
agagtttgatcctggctcaggatgaacgctggcggcatgcctaagacatgcaagtcgaacgaagtggcccattgaagttggagtgcttgcacaaagacggatttggattcccacttagtggcagacgggtgagtaacacgtgggtaatctaccctagagactgggacaacagttggaaacgactgctaataccggataattcatatttagataactagatatgctaaaaggagcctttaaagcttcactctaggatgagcttgcggcgcattagctagttggtggggtaatggcctaccaaggcaacgatgcgtatccgggctgagaggctaaacggacacattgggactgagacacggcccaaactcctacgggagacagcagttaggaatattcgtcaatgggggaaaccctgaacgagcaatgccgcgtgagtgatgacggtcttatagattgtaaaactctgttgtaagagacgaaaccacagtat

SEQ ID NO: 1348 - DNA, 490 bp, Unknown
  Ascusbbf_258391, encodes 16S rRNA
agagtttgatcctggctcagaacgaacgctggtagcgtggattaggcatgcaagtcgaacgggatcggccgattagcaataaccggccgtgagagtggcggattggggaggaacacgtgagcaacctgtccttgagttggggaaaaccgttggaaacgacggctaataccggatgtagcgcccggcgacatcgccggagcgccaaagggggccaaaagctcccgctcaccgaggggctcgcgcatcatcagcttgttggcggggtaacggcccaccaaggcttacgattagctggtctgagaggatgaccagccccactgggactgagatactgcccagactcctacgggaggctgcagtcgaggatcatttgcaatgggcgaaagcctgacaatgcgacgctgcgtggaggatgaaggccttcgggttgtaaactcctgtcataagggaaaaggcgagggtacccaatacgtaccttagttgattgtac

SEQ ID NO: 1349 - DNA, 490 bp, Unknown
  Ascusbbf_4239, encodes 16S rRNA
agagtttgatcatggctcaggacgaacgctggcggcatgcttaacacatgcaagtcgaacgggcataattgtttatagcaatatacgtgattatgtcagtggcgaacgggtgagtaacgcgtgagcaacctgccttgtacactgggataacagatggaaacgtctgctaataccggataagaccacagtggggcatcccacaggggccaaagccgagacggtacaagatgggctcgcgtcctattaggtagttggtgagataacagcccaccaagccgatgataggtagccgacttgagagagtgatcggccacaatggaactgagacacggtccatactcctccgggaggcagcagtggggaatattgggcaatgggcgaaagccttacccagcaatgccgcgtgaaagatgaaggtcttcggattgtaaatttcttttattggtgacgaacaaaatgacggtagccgatgaataagccccggctaact

SEQ ID NO: 1350 - DNA, 490 bp, Unknown
  Ascusbbf_13594, encodes 16S rRNA
agagtttgatcatggctcaggatgaacgctagcggcaggcctaacacatgcaagtcgaggggcagcagggcgtagcaatacgctgctggcgaccggcgcacgggtgcgtaacgcgtatgcaacctacccataacagggggataacggagtgaaaattccactaataccccgtattgacacttggtcgcatggccgggtgtcgaaagccttcgggtggttatggatgggcatgcgtggcattaggtagttggcggggcaacggcccaccaagcccacgatgcctaggggagctgagaggctaatcccccacactggtactgagacacggaccagactcctacgggaggcagcagtgaggaatattggtcaatggagggaactctgaaccagccatgccgcgtgagggaggaaggccctatgggttgtaaacctcttttgccccggggcaataaggctcatgcgtgagccgatgagagtacggggcgaataa

SEQ ID NO: 1351 - DNA, 490 bp, Unknown
  Ascusbbf_54225, encodes 16S rRNA
agagtttgatcctggctcaggatgaacgctagctacaggcttaacacatgcaagtcgaggggcagcatgggcttagcttgctaagcccgatggcgaccggcgcacgggtgagtaacacgtatccaacctgccgattactccggtacagcctttcgaaagaaagattaatcccggatggcatggcgattccgcatggtttctccattaaaggtttttccggtaatcgatggggatgcgttccattaggcagttggcggggtaacggcccaccaaacctacgatggataggggttctgagaggaaggtcccccacattggaactgagacacggtccaaactcctacgggaggcagcagtgaggaatattggtcaatgggcggaagcctgaaccagccaagtagcgtgaaggatgactgccctatgggttgtaaacttcttttataagggaataattgcgggtacgcgtacctgtttgcatgtaccttatgaa

SEQ ID NO: 1352 - DNA, 490 bp, Unknown
  Ascusbbf_406625, encodes 16S rRNA
agagtttgatcctggctcagaacgaacgctggcggcgcgtcttaagcatgcaagtcgagcggcaaggaaggagcttgcttcttccctagagcggcggactggtgagtaacgcgtgggtgacgtaccctccggacggggacagcctgtggaaacacaggataataccggatacggtgcatgttgtcagaggacatgcaggaaaggttcttttgaaccgccggaggagcggcccgcgtgccattagctagttggtggggtaacggctcaccaaggcagtgatggctacccggcctaagagggtggacgggcacattgggactgagatacggcccagactcctacgggaggcagcagctaagaatattccgcaatgggggaaaccctgacggagcgacgccgcgtggacgatgaaggccggaaggttgtaaagtccttttatgactgaagaataaggagaatgagagaaacgttttctggtgacggtaggtca

SEQ ID NO: 1353 - DNA, 490 bp, Unknown
  Ascusbbf_279243, encodes 16S rRNA
agagtttgatcatggctcaggacgaacgctggcggcgcgcttaacacatgcaagtcgaacggagcttgaacgagcgtcttcggacaattgttcaaacttagtggcggacgggtgagtaacgcgtgagcaaccggtcctgaagagggggacaacattgagaaatcaatgctaataccgcgtaagaccacgctgtggcatcacagaggggtcaaaggagagatccgcttcagggagggctcgcgtcccattaggtagttggtgacggtaacggcgcaccaagccgacgatgggtagccgtgctgagaggcagaacggccacactggaactgagacacggtccagactcctacgggaggcagcagtggggaatcttgggcaatggggggaaccctgacccagcgacgccgcgtggaggaagaaggtcttcggattgtaaacttctgtgacaggggacgaaggaagtgacggtaccctgtaaggaagccccggc

SEQ ID NO: 1354 - DNA, 490 bp, Unknown
  Ascusbbf_87823, encodes 16S rRNA
agagtttgatcatggctcaggacgaacgctggcggcgtgcctaacacatgcaagtcgagcggggatagattggatgagagcttcggcaggattctgatttattctagcggcggacgggtgagtaacgcgtgaacgatctgtcccagacagggggataacacttggaaacaggtgctaataccgcataagaccacgtagctgcatggctatgaggtaaaaggagcgatccggtttggggtgagttcgcgtctgattagctagttggtgaggtaacggcccaccaaggcgacgatcagtagccgacctgagagggtgatcggccacattggaactgagacacggtccaaactcctacgggaggcagcagtgggaatattgggcaatgggcgaaagcctgacccagcaacgccgcgtgagggaagaaggttttcggattgtaaacctctgtccttggtgacgaaggaagtgacggtagccaaggaggaagccc

SEQ ID NO: 1355 - DNA, 490 bp, Unknown
  Ascusbbf_2193, encodes 16S rRNA
agagtttgatcatggctcaggatgaacgctggcggcgtgcctaatacatgcaagtcgaacggcagtagcaatactgtagtggcgaacgggtgagtaacacgttggtgacctgccccaaagatgggaatatcacctggaaacgggtggcaaaaccgaataagcttatactgcttagaaaggtataagtaaaagtgcaaactactttgggaggggcctgcggcccatcagttagttggtgagggtaacggcccaccaagacgaagacgggtaggggacctgagagggtggtcccccacaatggaactgaaacacggtccatacacctgcgggtggcagcagtagggaatattgcttaatgggcgaaagcctgaagcagcaacgccgcgtggacgaaggaggccttcgggtcgtaaagtccttttatgtgtgaagaggaaggacggtagcacatgaataagtctcggctaactacgtgccagcagccgcggta

SEQ ID NO: 1356 - DNA, 490 bp, Unknown
  Ascusbbf_1231, encodes 16S rRNA
agagtttgatcatggctcaggatgaacgctagcggcaggcttaacacatgcaagtcgaggggcagcgtggagtagcaatactctgacggcgaccggcgaaagggtgagtaacgcgtgagcaacatgcccgatactggaggatagtcgatggaaacgtcgcgtaatactccgtaacataggggaccgcatgattctctattaatagatttatcggtatcggattggctcgcgtaccattagctagttggcggggtaacggcccaccaaggcgacgatggttaggggttctgagaggaaggtcccccacattggaactgagacacggtccagactcctacgggaggcagcagtgaggaatattggacaatggccgagaggctgatccagccatgccgcgtgcgggaggacggccctatgggttgtaaaccgcttttgttggggagcaataagggtcacgtgtgacctgatgagagtacccagcgaataagca

SEQ ID NO: 1357 - DNA, 490 bp, Unknown
  Ascusbbf_384227, encodes 16S rRNA
agagtttgatcctggctcaggatgaacgctggcggcatgcctaagacatgcaagtcgaacgaagtggcccaacaataacggagtgcttgcacgaagtttgcgatggattttccacttagtggcagacgggtgagtaacacgtaagtaatctacctttaagactgggataacgtttggaaacggacgctaataccggatgattcacgtttaggtaactagatgtgctaaaaggagcttcggcttcacttaaagatgagcttgcggcgtattaactagttggtgaggtaacggctcaccaaggtgacgatgcgtagccgagctgagaggctaatcggccacattgggactgagacacggcccaaactccgacgggaggcagcagttaggaatattcgtcaatgggggaaaccctgaacgagcaatgccgcgtgagtgatgacggtcttatagattgtaaaactctgttgtaaaggaagaacccttattatag

SEQ ID NO: 1358 - DNA, 490 bp, Unknown
  Ascusbbf_118551, encodes 16S rRNA
agagtttgatcctggctcaggatgaacgctggcggcgtgcctaacacatgcaagtcgaacgaagcatttcgcccgacaaagaggagtgcttgcacaaatcggagtcaattggaatgacttagtggcggacgggtgagtaacgcgtgggtaacctgccttatacagggggataacagttagaaatgactgctaataccgcataagcgcacaggatcgcatgatccggtgtgaaaagccgagacggtataagatggacccgcgtctgattagccagttggcagggtaacggcctaccaaagcaacgatcagtagccggcctgagagggtgaacggccacattgggactgagacacggcccaaactcctacgggaggcagcagtgggggatattgcacaatgggggaaaccctgatgcagcgacgccgcgtgagcgattgaagtatttcggtatgtaaagctctatcagcagggaagaaaatgacggtacctg

SEQ ID NO: 1359 - DNA, 490 bp, Unknown
  Ascusbbf_123062, encodes 16S rRNA
agagtttgatcctggctcaggatgaacgctggcggcgtgcctaacacatgcaagtcgaacggagctattttggaaagtccttcgggactggaatctatagcttagtggcggacgggtgagtaacgcgtgagcaatctgcccttaggtgggggataacagccggaaacgactgctaataccgcataatgcagagagatggcatcttctttctgccaaagatttattgcctttggatgagctcgcgtctgattagctagttggtgaggtaacggcccaccaaggcgacgatcagtagccggactgagaggttgaacggccacattgggactgagacacggcccagactcctacgggaggcagcagtggggaatattgcgcaatgggggcaaccctgacgcagcaacgccgcgtgattgaagaaggccttcgggttgtaaagatctttaatcagggacgaattttgacggtacctgaagaataagctccggct

SEQ ID NO: 1360 - DNA, 488 bp, Unknown
  Ascusbbf_63270, encodes 16S rRNA
agagtttgatcctggctcagggctaacgctggcggcgcgcctaacacatgcaagtcgaacgaacccttcggggttagtggcagacgggtgagtaacgcgtgagtaacgtgccttctttctggggataccgtttggaaacgaacgttaataccgaatgtgcttattttgcggcatcgtagagtaagtaaactgttagggagagaagagcgactcgcgttctatcagctagatggtggggtaacggcctaccatggctacgacggataactggtctgagaggatgatcagtcacactggaactgagacacggtccagactcctacgggaggcagcagtgaggaatcttgcacaatgggcgaaagcctgatgcagcgacgccgcgtgagggacgaaggccttcgggttgtaaacctctgtcagtagggaagaagaatgacggtacctactgaggaagcttcggctaactacgtgccagcagccgcggtaat

SEQ ID NO: 1361 - DNA, 490 bp, Unknown
  Ascusbbf_166172, encodes 16S rRNA
agagtttgatcatggctcaggatgaacgctggcggcgtgcctaacacatgcaagtcgaacggttaagccggcttcggccgggcatacagtggcgaacgggtgagtaacacgtgaccaacctgccccctcctccgggacagcctcgggaaaccgggattaataccggatactccgcgcgcggcgcatgccgcgcgcgggaaagcccaagcgggaggggatggggtcgcggcccatcaggtagtgggcggggcagcggcccgcccagccgacgacgggtagccgggttgagagaccgaccggccacattgggactgagatacggcccagactcctacgggaggcagcagtggggaatattgcgcaatgggggcaaccctgacgcagcaacgccgcgtgcgggaagaaggcgtccgcgtcgtaaaccgctttcagcagggaagacatcgacggtacctgcagaagaagccccggctaactacgtgccagcagc

SEQ ID NO: 1362 - DNA, 490 bp, Unknown
  Ascusbbf_360553, encodes 16S rRNA
agagtttgatcctggctcaggataaacgctggcggcgcacataagacatgcaagtcgaacggaagtcgtattaattgaagtggattgaagatttattggattgaagcagattttaatacaatggctttagtggcggactggtgagtaacacgtaagcaatctacctattagaggggaataacaatgagaaatcattgctaataccgcataagcttgtatgaccgcatggtcaagcaagaaaaggagtaatccgctaatagatgagcttgcggctgattagctagttggttaggtaacggctgaccaaggcaacgatcagtagccgggctgagaggctctgcggccacattgggactgagatacggcccagactcctacgggaggcagcagtcgggaatattgcgcaatggaggaaactctgacgcagtgacgccgcgtataggaagaaggttttaggattgtaaactattttagacagggaagaaaaatg

SEQ ID NO: 1363 - DNA, 490 bp, Unknown
  Ascusbbf_22995, encodes 16S rRNA
agagtttgatcctggctcaggatgaacgctagcggcaggcttaacacatgcaagtcgaggggcagcgcgaggtagcaatactttggcggcgaccggcggaagggtgcgtaacgcgtgagcaacatgcccgtatgagggggataagcgatggaaacgtcgtctaataccccgtaacacaggagatcgcatgatcatctgttgaaagatttatcgcatacggattggctcgcgtgacattagctagtcggcggggtaacggcccaccgaggcgacgatgtctaggggttctgagaggaaggtcccccacactggaactgagacacggtccagactcctacgggaggcagcagtgaggaatattggtcaatgggcggaagcctgaaccagccatgccgcgtgaaggaataaggccctatgggtcgtaaacttcttttgacggggagcaataagggtcacgtgtggcccgatgagagtactcgtcgaataagca

SEQ ID NO: 1364 - DNA, 490 bp, Unknown
  Ascusbbf_93131, encodes 16S rRNA
agagtttgatcatggctcaggacgaacgctggcggcgtgcctaacacatgcaagtcgaacggagtaagaatttcggtttttacttagtggcgaacgggtgagtaacgcgtgaacaacctgccttcctgagggggataacacctggaaacaagtgctaataccgcataagaccacagagccgcatggcccaggggtcaaaggagtgatccgcaggaagaggggttcgcgtcccattagctagttggcggggcaacggcccaccaaggcgacgatgggtagccgagctgagaggctgatcggccacactggaactgagacacggtccagactcctacgggaggcagcagtggggaatattgggcaatgggcgcaagcctgacccagcaacgccgcgtgagggaagaaggtcttcggattgtaaacctctgtcctatgtgacgaaggaagtgacggtagcataggaggaagccccggctaactacgtgccagc

SEQ ID NO: 1365 - DNA, 490 bp, Unknown
  Ascusbbf_61473, encodes 16S rRNA
agagtttgatcctggctcaggataaacgctggcggcgcacataagacatgcaagtcgaacggaagccgttgtaatgatatcgaagtggactgagaacttgttcaaagaaaattgaagttgacttacaacaatgactttagtggcggactggtgagtaacgcgtgagcaacctgcctatcagaggggaacaacagttagaaatgactgctaataccgcatatgccttagtatcacatggtacaaaagggaaaagagtaatctgctgatagatgggctcgcgtctgattagatagttggtggggtaacggcctaccaagtcgacgatcagtagccggactgagaggttgaacggccacattgggactgagatacggcccagactcctacgggaggcagcagtcgggaatattgcgcaatggaggaaactctgacgcagtgacgccgcgtgcaggaagaaggttttcggattgtaaactgctttagacaggga

SEQ ID NO: 1366 - DNA, 490 bp, Unknown
  Ascusbbf_9876, encodes 16S rRNA
agagtttgatcatggctcagaacgaacgctggtggcgtgtcttatacatgcaagtcgagcggcatagcaatatgtagcggcgaacgggtgagtaacgcgtaagcaatctgccccatatcaggaaatacccgtgccaacgcgcggttaatgtccaggagagtggccctccgcatggagggttgactagagattcatcggtatgggatgagcttgcgtccgattagctagttggcggggcaacggcccaccaaggcgacgatcggtagccggcctgagagggtgatcggccacattgggactgagatacggcccagactcctacgggaggcagcagtagggaatattgcacaatggggggaaccctgatgcagcaacgccacgtgtgggaagaagcatttcggtgtgtaaaccactgtcatgagggaataaggcccttattcgtaagggattgaatgtaccttgagaggaagcaccggcaaacttcgtgcca

SEQ ID NO: 1367 - DNA, 490 bp, Unknown
  Ascusbbf_26781, encodes 16S rRNA
agagtttgatcctggctcagagttaacgctggcatcgtgcataacacatgcaagtcgaacgggacttacttgagtagcaatacttgagtaagtttagtggcagacgggtgagtaatacataaggaacgtacctctgagtggagaataacagtccgaaaggattgctaatactccataacataactttgtggcatcacttagttatcaaagatttatcgcttggagagcgtcttatggtctatcagcttgttggcagtgtaacggactaccaaggcgacgacggatagccggcctgaaagggcgaccggccacaagggcactgagacacgggccctactcctacgggaggcagcagtggggaattttggacaatgggcgcaagcctgatccagcaacgatgcgtggaggatgaaggttctcggattgtaaactccttttgagggggacgaaaaaaatgacggtacccctcgaataagccacggctaactac

SEQ ID NO: 1368 - DNA, 490 bp, Unknown
  Ascusbbf_32717, encodes 16S rRNA
agagtttgatcctggctcaggacgaacgctggcggcgtgcctaatgcatgcaagtcgagcgacgcctcttgaaacgtaagtttcgagagtgacggagcggcgaacgggtgagtaacacgtgagcaacctgccccaaagaccgggatagccaggggaaaccctgattaataccggatgatctcgtagaaccacatggttcatcgagcaaatgcttttgcgctttgggatgggctcgcggcctatcagctagttggtgaggtaacagctcaccaaggcgacgacgggtagctggtctgagaggacgatcagccacactgggactgagacacggcccagactcctacgggaggcagcagcagggaatcttgcacaatgggcgaaagcctgatgcagcaacgccgcgtgagggatgaaggctctcgggttgtaaacctctttcaggagggaagaaattgacggtacctccagaagaagctccggctaactacgt

SEQ ID NO: 1369 - DNA, 490 bp, Unknown
  Ascusbbf_2214, encodes 16S rRNA
agagtttgatcatggctcaggatgaacgctagcggcaggcttaacacatgcaagtcgaggggcagcgcgaggtagcaatactttggcggcgaccggcgaaagggtgagtaacgcgtgagcaacatgcccgatagtggaggatagtcgatggaaacgtcgtgtaatactccgtaacaacagttcccgcatgagaattgtttaatagatttatcgctatcggattggctcgcgtcccattaggcagttggcggggtaacggcccaccaaaccgacgatgggtaggggttctgagaggaaggtcccccacattggaactgagacacggtccagactcctacgggaggcagcagtgaggaatattggacaatggccgagaggctgatccagccatgccgcgtgcgggaagacggccctatgggttgtaaaccgcttttgttggagagcaataagagttacgtgtaacttgatgagagtatccagcgaataagca

SEQ ID NO: 1370 - DNA, 490 bp, Unknown
  Ascusbbf_1726049, encodes 16S rRNA
agagtttgatcatggctcagaacgaacgctggcggcatggattaggcatgcaagtcgagcgaggcagcaatgcctagcggcgaacgggtgagtaacgcgtaagcaatctgccccatatcaggaaatacccgtgccaacgcgcggttaatgtccaggagggtggccttccgcatgggaggttgaccagagatttatcggtatgggatgagcttgcgtccgattagctagttggcggggcaacggcccaccaaggcgacgatcggtagccggcctgagagggtgatcggccacattgggactgagatacggcccagactcctacgggaggcagcagtagggaatattgcacaatgggggaaaccctgatgcagcaacgccacgtgtgggaagaagcatttcggtgtgtaaaccactgtcgtgagggaataaggctagctttcgggctagttgaatgtacctcgaaaggaaacaccggcaaacttcgtgccag

SEQ ID NO: 1371 - DNA, 490 bp, Unknown
  Ascusbbf_38420, encodes 16S rRNA
agagtttgatcatggctcaggacgaacgctggcggcgtgcctaatacatgcaagtcgagcggaccgaagggagcttgctcctttaggttagcggcggacgggtgagtaacacgtgggcaacctgccctgcagactgggataacttcgggaaaccggagctaataccggataacaccgaaaaccgcatggttttcggttgaaaggcggcttttagctgtcactgcaggatgggcccgcggcgcattagctagttggtgaggtaacggctcaccaaggcgacgatgcgtagccgacctgagagggtgaccggccacactgggactgagacacggcccagactcctacgggaggcagcagtagggaatcttccgcaatggacgaaagtctgacggagcaacgccgcgtgagcgaagaaggtcttcggatcgtaaagctctgttgtcagggaagaacaagtaccgttcgaacagggcggtaccttgacggtacc

SEQ ID NO: 1372 - DNA, 490 bp, Unknown
  Ascusbbf_36095, encodes 16S rRNA
agagtttgatcctggctcaggatgaacgctggcggcgtgcctaacacatgcaagtcgaacggactgctataaacggagattcgtcaaagattgtagtaagttagtggcggacgggtgagtaacgcgtgggtaacctgcctcatagagggggataacgattggaaacgatcgctaataccgcataagcccacagtaccgcatggtacagagggaaaagatttcatcgctatgagatggacccgcgtcagattagctggttggtggtgtaacggaccaccaaggcaacgatctgtagccggactgagaggttgaacggccacattgggactgagacacggcccaaactcctacgggaggcagcagtggggaatattgcacaatgggggaaaccctgatgcagcgacgccgcgtgggtgaagaagtttttcggaatgtaaagccctatcagcagggaagataatgacggtacctgactaagaagccccggcta

SEQ ID NO: 1373 - DNA, 468 bp, Unknown
  Ascusbbf_26504, encodes 16S rRNA
agagtttgatcctggctcagagcgaacgctggcggcaggcctaacacatgcaagtcgagcgcccagcaatgggagcggcagacgggatagtaacacgtgggaacgtacctttcagttcggaacaaccaagggaaactttggctaataccgaatacgcccgtaaggggaaagatttatcgctgaaagatcggcccgcgtctgattagctagttggtgaggtaatggctcaccaaggcgacgatcagtagctggtctgagaggatgatcagcatcactgggactgagacacggcccagactcctacgggaggcagcagtggggaatattggacaatgggcgcaagcctgatccagccatgccgcgtgagtgatgaaggccttagggttgtaaagctctttcgtcagggaagataatgacggtacctgaagaagaagccccggctaacttcgtgccagcagccgcggtaat

SEQ ID NO: 1374 - DNA, 490 bp, Unknown
  Ascusbbf_108990, encodes 16S rRNA
agagtttgatcatggctcaggacgaacgctggcggcgcgcctaacacatgcaagtcgaacggaggtattgagacggaagcttcggcggaagacttaatactttagtggcgaacgggtgagtaacacgtgaggaacctgcctttaagagggggataacacttagaaataggtgctaataccgcataagaccacagagcggcatcgctcaggggtcaaaggaggaatccgcttaaagatggcctcgcgtccgattaggtagtaggcggggcaacggcccacctagcctgcgatcggtagccggactgagaggttgaacggccacattgggactgagacacggcccagactcctacgggaggcagcagtggggaatattgggcaatgggggaaaccctgacccagcgacgccgcgtgagggaagaaggttttcggattgtaaacctctgtcttcggggacgatagtgacggtacccgaggaggaagccacggc

SEQ ID NO: 1375 - DNA, 490 bp, Unknown
  Ascusbbf_367189, encodes 16S rRNA
agagtttgatcctggctcaggatgaacgctggcggcgtgtttaacacatgcaagtcgagcgagaaactcatgacagatacttcggttgatggattgagcggaaagcggcggacgggtgagtaacgcgtaggcaacctgccccatgcagagggatagcctcgggaaaccgggattaaaacctcataatgcggagaagagacatctctttcccgccaaagatttatcggcatgggatgggcctgcgtctgattagttagttggtggggtaacggcctaccaaggcgacgatcagtagccgacctgagagggtgatcggccacattggaactgagacacggtccaaactcctacgggaggcagcagtggagaatcttgcacaatgggcgaaagcctgatgcagcaacgccgcgtgaaggatgaaggcccttgggtcgtaaacttctgttctaagggaagatagtgacggtaccttaggagcaagtcccggcta

SEQ ID NO: 1376 - DNA, 490 bp, Unknown
  Ascusbbf_8218, encodes 16S rRNA
agagtttgatcatggctcaggacgaacgctggcggcgtgcctaacacatgcaagtcgaacggagttattttgaatgaagatttcggttggattttagaatgacttagtggcggacgggtgagtaacgcgtgagtaacctgccgatgagagggggataacgttctgaaaaggacgctaataccgcataacgtatttgagccgcatgacttaaataccaaaggagcaatccgctcattgatggactcgcgtccgattagctagttggcggggtaacagcccaccaaggcgacgatcggtagccggactgagaggttgaacggccacattgggactgagacacggcccagactcctacgggaggcagcagtgggggatattgcgcaatgggggaaaccctgacgcagcaacgccgcgtgaaggacgaaggtcttcggattgtaaacttcttttgttaaggacgaagaaagtgacggtacttaacgaataagct

SEQ ID NO: 1377 - DNA, 490 bp, Unknown
  Ascusbbf_142685, encodes 16S rRNA
agagtttgatcatggctcaggacgaacgctggcggcgtgcctaatacatgcaagtcggacgaaccaggaagggaacttgttcctttccttggttagtggcagacgggtgagtaacacgtggagaacctacctttcagcgggggataaccattggaaacgatgactaataccgcataggactttgagtcacctgacttaaagaggaaagacggcttcggctgtcactgaaagatggctccgcggtgcattagctagatggtaaggtaacggcttaccatggccatgatgcatagccgacctgagagggtgatcggccacattgggactgagacacggcccaaactcctacgggaggcagcagtagggaatcttccgcaatggacgcaagtctgacggagcaacgccgcgtgtgtgaagaaggtcttcggatcgtaaagcactgttgttagagaagaacacccggtagagtaactgttaccggcatgacggt

SEQ ID NO: 1378 - DNA, 490 bp, Unknown
  Ascusbbf_197522, encodes 16S rRNA
agagtttgatcatggctcagaatgaacgctggcggcatggattaggcatgcaagtcgaacggggcgcagcaatgcgtccagtggcgaaagggtgaggaacacgtgaagaacctgcccccggatccggaacaagcgctggaaacggcgtctgatacgggatgtggcggggagccgcatggcttccctgctaaagattcatcgtccggggagggcttcgcgtcccattagctggttggcggggtaacggcccaccaaggctgcgacgggtaggtggtctgagaggatggtcacccacactgggactgagacactgcccagactcctacgggaggctgcagtcgagaatcttccgcaatgggggcaaccctgacggagcgatgccgcgtgagggaagtaggccttcgggtcgtgaacctctgtcacccgggacgaatcaagcgacggtaccgggagaggaagccatggctaactacgtgccagcagccgcggt

SEQ ID NO: 1379 - DNA, 490 bp, Unknown
  Ascusbbf_127662, encodes 16S rRNA
agagtttgatcctggctcagattgaacgctggcggaacgctttacacatgcaagtcgaacggtaacgcggagagaagcttgcttctctccggcgacgagtggcgaacgggtgagtaatacatcggaacgtgtccgctcgtgggggacaaccagccgaaaggttggctaataccgcatgagttctacggaagaaagagggggacccgcaagggcctctcgcgagcggagcggccgatgactgattagccggttggtgaggtaacggctcaccaaagcaacgatcagtagctggtctgagaggacgaccagccacactgggactgagacacggcccagactcctacgggaggcagcagtggggaattttggacaatgggcgcaagcctgatccagctattccgcgtgtgggatgaaggccctcgggttgtaaaccacttttgtagagaacgaaaagacaccttttaaaaaagggtgttgctgacggtactct

SEQ ID NO: 1380 - DNA, 490 bp, Unknown
  Ascusbbf_110447, encodes 16S rRNA
agagtttgatcatggctcaggatgaacgctggcggcgtgcctaatacatgcaagtcgagcgagaaatgtccgattgaaacttcggtagatttcggacatggaaagcggcggacgggtgagtaacgcgtaggcaacctgccccttgcacagggatagccactggaaacggtgattaatacctgataatgcattcctatcgcctgttagggatgccaaagatttattggcaagggatgggcctgcgtctgattagcttgttggtggggtaacggctcaccaaggcgacgatcagtagccgacctgagagggtgatcggccacattggaactgagacacggtccaaactcctacgggaggcagcagtagggaatcttgcacaatgggcgaaagcctgatgcagcaacgccgcgtgagcgatgaaggcccttgggtcgtaaagctctgtcctatgggaagaaacaaatgacggtaccattggaggaagccccgg

SEQ ID NO: 1381 - DNA, 490 bp, Unknown
  Ascusbbf_47738, encodes 16S rRNA
agagtttgatcctggctcaggacgaacgctggcggcgtgcttaacacatgcaagtcgaacgaggtttagggaagagcttgctcggaactaaaccgagtggcggacgggtgagtaacgcgtgaggaacctgtctcacacagggggataacgcatcgaaagatgtgctaataccgcataagaccacggtgtcgcatggcacaggggtcaaaggagcaatccggtatgaggtggactcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgaaagcctgacccagcaacgccgcgtgaaggaagaaggttttcggatcgtaaacttctgtcctacatgaagagaagtagacggtagtgtaggaggaagccccggctaacta

SEQ ID NO: 1382 - DNA, 490 bp, Unknown
  Ascusbbf_8146, encodes 16S rRNA
agagtttgatcctggctcaggagaaacgctggcggcgcacataagacatgcaagtcgaacggaacttagtcgaatgtttacatgagacgaaagtttagtggcggacgggtgagtaacacgtgagcaacctgcctttaagagggggataacattgagaaatcagtgctaataccgcataacgcatttctaccgcatgatagaaatagccaaaggagaaatccgcttagagatgggctcgcggctgattagttagttggtggggtaatggcctaccaagacgatgatcagtagccgagctgagaggcacaacggccacattgggactgagacacggcccagactcctacgggaggcagcagtcgggaatattgcacaatgggggaaaccctgatgcagtgacgccgcgtataggaagaaggtctttggattgtaaactattgtcgacagggaagaaaaaaatgacagtacctgtggaggaagccccggcaaa

SEQ ID NO: 1383 - DNA, 490 bp, Unknown
  Ascusbbf_6022, encodes 16S rRNA
agagtttgatcatggctcaggacaaacgctggcggcgtgcctaacacatgcaagtcgaacggacccttcggggttagtggcagacgggtgagtaacacgtaggtaatgtaccttcttgctggggatacctacccgaaagggtggttaataccgaatggtctcatgctgcggcatcgcggtatgagtaaagtgttcagcgcgagaggatcagcctgcgggccatcagcttgttggtggggtaacggcctaccaaggcatcgacggttagccggtctgagaggatgatcggccacactggaactgagacacggtccagactcctacgggaggcagcagtgaggaatattgcgcaatgggcggaagcctgacgcagcgacgccgcgtgagggatgaaggttttcggatcgtaaacctctgttaagcagggaagagaacggacggtacctgctgaggaagcatcggcttactacgtgccagcagccgcggtaat

SEQ ID NO: 1384 - DNA, 490 bp, Unknown
  Ascusbbf_100994, encodes 16S rRNA
agagtttgatcctggctcagaacgaacgctggcggcatggattaggcatgcaagtcgaacggtgcagcaatgcatagtggcgcaagggtgaggaacgcgtgagtaacctgccctcaagttgggaacagcttctggaaacggaaattaataccgaatgtgaccattggaaggcatcttctgttggttaaaggccgcaaggtcgcttgaggaggggctcgcgtcccattatgctagttggtgaggtaaaggctcaccaaggcgaagatgggtagctggtctgagaggacgatcagccacactgggactgagaactgcccagactcctacgggaggctgcagtcgagaattttgggcaatggacgaaagtctgacccagcaatgccgcgtgcgggatgaaggtcttcggattgtaaaccgctgtcaagtgggacgaaacaaatgacggtaccgctgaaggaagtcacggctaactacgtgccagcagccgcgg

SEQ ID NO: 1385 - DNA, 490 bp, Unknown
  Ascusbbf_107170, encodes 16S rRNA
agagtttgatcctggctcaggacgaacgctggcggcgtgcctaacacatgcaagtcgaacgagaagtcttgaaatgatcccttcggggtgaatggatagatggacagtggcggacgggcgagtaacgcgtgagtaacctgcccataagagagggatagccgatggaaacgtcgagtaatacctcatattgtaattaattcgcatggattgattatgaaagatttatcgcttatggatggactcgcgtctgattagatagttggtggggtaacggctcaccaagtcgacgatcagtagccgaactgagaggttgatcggccgcattgggactgagacacggcccagactcctacgggaggcagcagtggggaatattgcgcaatggggggaaccctgacgcagcaacgccgcgtgcaggaagaaggtcttcggattgtaaactgttgtcgcaagggaagaaggaagtgacggtaccttgtgagaaagtcac

SEQ ID NO: 1386 - DNA, 490 bp, Unknown
  Ascusbbf_325421, encodes 16S rRNA
agagtttgatcctggctcaggatgaacgctagcgggaggcctaacacatgcaagccgagcgggatttatttattagcttgctaatgaataatgagagcggcgtacgggtgcggaacacgtgtgtaacctgcccttatcaaggggatagcccagagaaatttggattaataccctataacacaagtagtggcatcactatttgttaaaaactgaggtggataaggatgggcacgcgcaagattagctagttggtgaggtaacggctcaccaaggcgacgatctttagggggcctgagagggtgatcccccacactgggactgagacacggcccagactcctacgggaggcagcagtgaggaatattggacaatgggtggaagcctgatccagccatcccgcgtgaaggacgactgccctatgggttgtaaacttcttttgtatagggataaacctactctcgtgagggtagctgaaggtactatacgaata

SEQ ID NO: 1387 - DNA, 470 bp, Unknown
  Ascusbbf_1540758, encodes 16S rRNA
agagtttgatcctggctcagaacgaacgctggcggcaggcttaacacatgcaagtcgagcgggcccttcgaggtcagcggcagacgggtgagtaacgcgtgggaatctacccaactctacggaacaacagttggaaacgactgctaataccgtacacgcccttcgggggaaagatttatcggagttggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgaatgatgaaggccttagggttgtaaagttctttcaccggagaagataatgacggtatccggagaagaagccccggctaacttcgtgccagcagccgcggtaat

SEQ ID NO: 1388 - DNA, 490 bp, Unknown
  Ascusbbf_841, encodes 16S rRNA
agagtttgatcatggctcaggatgaacgctagcggcaggcttaacacatgcaagtcgaggggcagcgtggagtagcaatactctgacggcgaccggcgaaagggtgagtaacgcgtgagcaacatgcccggtatcgggggatagtcgatggaaacgtcgcgtaataccccgtaacaacagaggccgcatgacctttgtttaagagatttatcgctaccggattggctcgcgtcccattaggcagttggcggggtaacggcccaccaaaccgacgatgggtaggggttctgagaggaaggtcccccacattggaactgagacacggtccagactcctacgggaggcagcagtgaggaatattggacaatggccgagaggctgatccagccatgccgcgtgcgggaagacggccctatgggttgtaaaccgcttttgttggagagcaataagttctacgtgtagagcgatgagagtatccagcgaataagca

SEQ ID NO: 1389 - DNA, 490 bp, Unknown
  Ascusbbf_9686, encodes 16S rRNA
agagtttgatcctggctcaggacgaacgctggcggcatgcctaacacatgcaagtcgaacggacggaagtagcaatactgaagttagtggcgaacgggtgagtaacacgtgagcaacctgccctatacactgggatagcagttggaaacgactgataataccggataagaccacgctgtcgcatggcagaggggtcaaagcgatttagcggtataggatgggctcgcgtccaattagctagttggtgaggtaacggcccaccaaggcgacgattggtagccgacttgagagagtgatcggccacactggaactgagacacggtccagactcctacgggaggcagcagtggggaatattgggcaatggaggaaactcttacccagcaatgccgcgtgagggatggaggtcctatggattgtaaacctctttgattagggacaaagaaagtgatggtacctaaagaacaagccccggctaactatgtgccag

SEQ ID NO: 1390 - DNA, 490 bp, Unknown
  Ascusbbf_19646, encodes 16S rRNA
agagtttgatcatggctcaggacgaacgctggcggcatgcttaacacatgcaagtcgaacgggcgtatttggttatagcgatataattggatacgtttagtggcgaacgggtgagtaacgcgtgagcaacctgccttgtacaccgggataacagaccgaaaggactgctaataccggatgagaccacagaggggcatccctcaggggtcaaagtgatttagcggtacaagatgggctcgcgtcctattaggtagttggtgagataacagcccaccaagccgatgataggtagccgacttgagagagtgatcggccacaatggaactgagacacggtccatactcctacgggaggcagcagtggggaatattgggcaatgggcgaaagccttacccagcaatgccgcgtgaatgatgaaggtcttcggattgtaaatttcttttattggtgacgaacaaaatgacggtagccgatgaataagccccggcta

SEQ ID NO: 1391 - DNA, 490 bp, Unknown
  Ascusbbf_16407, encodes 16S rRNA
agagtttgatcatggctcaggatgaacgctagcggcaggcttaacacatgcaagtcgaggggcagcgggtgtagcaatacatgccggcgaccggcgaaagggtgagtaacgcgtgagcaacgtgcccgtatgtgggggatagtcgatggaaacgtcgcgtaataccccgtaacacatggtctcgcatgggactgtgttgaaagatttattgcatacggatcggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggaagacggccctatgggttgtaaaccgcttttgcgagggagcaataagagccacgtgtgactcgatgagagtacctcgcgaataagcatc

SEQ ID NO: 1392 - DNA, 490 bp, Unknown
  Ascusbbf_202577, encodes 16S rRNA
agagtttgatcctggctcaggacgaacgctggcggcgtgcctaatacatgcaagtcgtacgcacagaagctggaaacttgtttccagtggacgtgagtggcgcacgggtgagtaacacgtgggaaacctacccttcagcgggggataaccgtcggaaacgatggctaataccgcataggtctttgagtcacctgacttaaagaggaaagacggcttcggctgtcactgaaggatggtcctgcggtgcattagctagttggtaaggtaacggcttaccaaggcgatgatgcatagccgacctgggagggtgatcggccacattgggactgagacacggcccaaactcctacgggaggcagcagtagggaatcttccgcaatggacgaaagtctgacggagcaacgccgcgtgtgtgaagaaggtcttcggatcgtaaagcactgttattagagaagaacaaccggtagagtaactgttaccggcttgacgg

SEQ ID NO: 1393 - DNA, 490 bp, Unknown
  Ascusbbf_39084, encodes 16S rRNA
agagtttgatcatggctcagaacgaacgctggcggcgcgtcttaagcatgcaagtcggacggcaagatgccttcgggcatcctagagtggcgaacgggtgagtaacacgtaagtgatctgccccgcagttggggatagcctgtggaaacacagggtaataccggatgagatgtcaatgattgaactatgacatgaaagtggctacggccacgctgtgggatgagcttgcggctcattagctagttgggggtgtaacggaccaccaaggcgacgatgagtagccggcctgagagggtgaacggccacattgggactgagacacggcccagactcctacgggaggcagcagctaagaatattccgcaatgggggaaaccctgacggagcgacgccgcgtgaacgatgaaggcagagatgttgtaaagttcttttatcactggagaataaccggggcagggaatggctccgggatgacgtcaggtgatgaata

SEQ ID NO: 1394 - DNA, 490 bp, Unknown
  Ascusbbf_226008, encodes 16S rRNA
agagtttgatcatggctcaggatgaacgctagctacaggcttaacacatgcaagtcgaggggcatcgggaagttagcttgctaactttgccggcgaccggcgcacgggtgagtaacgcgtatccaacctaccctgcagtcagggatagcccggcgaaagtcggattaatacctgatgcagtcagaagagggcatctgattttgacgaaagatttcatcgctgcgggatggggatgcgtaggattaggcaggcggcggggcaacggcccaccgcgccgacgatccttaggggttctgagaggaaggtcccccacactggtactgagacacggaccagactcctacgggaggcagcagtgaggaatattggtcaatgggcggtagcctgaaccagccaagtagcgtgcaggacgacggccctacgggttgtaaactgcttttatgcggggataaagtgcgcgacgtgtcgcgttttgtaggtaccgcatgaa

SEQ ID NO: 1395 - DNA, 490 bp, Unknown
  Ascusbbf_10878, encodes 16S rRNA
agagtttgatcctggctcaggatgaacgctggcggcgtgcttaacacatgcaagtcgaacgagggttaccggttgaaattttcgaatggaaacgggtaatacctagtggcggacgggtgagtaacgcgtggggaacctgccccattccgggggataccagttggaaacgactgttaataccgcataagcgcacagtactgcatggtacggtgtgaaaaaccacggtggaatgggatggccccgcgtctgattagccagttggcagggtaacggcctaccaaagcgacgatcagtagccggcctgagagggcgaccggccacattgggactgagacacggcccaaactcctacgggaggcagcagtggggaatattgcacaatggggggaaccctgatgcagcgacgccgcgtgagtgaagaagtatttcggtatgtaaagctctatcagcagggaagaagatgacggtacctgcacaagaagccccggct

SEQ ID NO: 1396 - DNA, 490 bp, Unknown
  Ascusbbf_29980, encodes 16S rRNA
agagtttgatcatggctcaggatgaacgctggcggcgtgcttaacacatgcaagtcgaacgaagccaaaaggaagcttgctttctttgaagcttagtggcggacgggtgagtaacgcgtgaggaacctgcccttcagtggggaataacagccggaaacgactgctaataccgcataacgtcatcggaccgcatgatctggtgaccaaaggatttattcgctgaaggatggcctcgcgtccgattaggcagttggtgaggtaacggcccaccaaacctacgatcggtagccgaactgagaggttgatcggccacattgggactgagacacggcccagactcctacgggaggcagcagtggggaatattgggcaatgggcgaaagcctgacccagcaacgccgcgtgaaggatgacggtcttcggattgtaaacttctttgattggggaagaacaaaatgacctacccaaagaacaagtcacggctaactac

SEQ ID NO: 1397 - DNA, 490 bp, Unknown
  Ascusbbf_279149, encodes 16S rRNA
agagtttgatcatggctcagaacgaacgctggcagcgtggattaggcatgcaagtcgaacgggatccggaaggtagcaatatcggccggtgagagtggcggaagggcgaggaacacgtgggcaacctgtctctgaggtggggaaaaccgctggaaacggcggctaataccgaatgtagcgcccgctcgcatgagcggagcgccaaagggggcgaaagctccccctctccgaggggcccgcgcaccatcagcttgttggcggggtaacggcccaccaaggctcacggttagctggtctgagaggatggccagccgcactgggactgagatactgcccagactcctacgggaggctgcagtcgaggatcatttgcaatgggcgaaagcctgacaatgcgacgctgcgtggaggatgaaggccctcgggttgtaaactcctgtcatgggggaaaaggaaaccctgcccaatacgcagggaatttgatggtacc

SEQ ID NO: 1398 - DNA, 490 bp, Unknown
  Ascusbbf_41338, encodes 16S rRNA
agagtttgatcatggctcaggacgaacgctggcggcgtgcttcatacatgcaagtcgaacgataaggtctcttcggagatacataagtggcggacgggtgagtaatgtgtagagaatctgccctggagtgggggacaacagttggaaacgactgctaataccgcatatgagcgtacctgcaatggtattcttgaaaactacggtgctccaggatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgattgaataagcccttcggggtgtaaagatctgtcagtagggacgaaacttgacggtacctacagaggaagcatcggctaactccgtgccagcagccgcg

SEQ ID NO: 1399 - DNA, 490 bp, Unknown
  Ascusbbf_2802, encodes 16S rRNA
agagtttgatcctggctcaggacaaacgctggcggcgtgcttaacacatgcaagtcgaacggagtacccgagaaagaagcttcggcagattgatcggaatacttagtggcggacgggtgagtaacacgtgagtaacctgcccttgagtgggggataacactccgaaaggagtgctaataccgcataacatggatatgttgcatggcaaatccatcaaagatttattgctcagggatgggctcgcgcccgattaggtagttggtgaggtaaaggctcaccaagccgacgatcggtagccggactgagaggttgaacggccacattgggactgagacacggcccagactcctacgggaggcagcagtggggaatattgcacaatgggggaaaccctgatgcagcgacgccgcgtgaaggaagaaggtcttcggattgtaaacttttgtcttcggggacgaaaagaatgacggtacccggggaggaagccacg

SEQ ID NO: 1400 - DNA, 490 bp, Unknown
  Ascusbbf_363159, encodes 16S rRNA
agatttgatcatggctcaggatgaacgctggcggcgtgcttaatacatgcaagtcgaacggggattatttcattgaagcttcggcagatctggtttaatcctagtggcggacgggtgagtaacgcgtgggtaacctgccttatacagggggataacagtcagaaatggctgctaataccgcataagcgcacagggccgcatggcccagtgtgaaaaactgaggtggtataagatggacccgcgttggattagccagttggcagggtaacggcctaccaaagcaacgatccatagccggcctgagagggtgaacggccacattgggactgagacacggcccagactcctacgggaggcagcagtggggaatattgcataatgggggaaaccctgatgcagcgacgccgcgtgaaggaagaagtatctcggtatgtaaacttctatcagcagggaagaaaatgacggtacctgactaagaagccccagctaa

SEQ ID NO: 1401 - DNA, 490 bp, Unknown
  Ascusbbf_4665, encodes 16S rRNA
agagtttgatcctggctcaggatgaacgctggcggcatgcctaacacatgcaagtcgaacggagttattagacggaagccttcgggtggaagattaataacttagtggcggacgggtgagtaacgcgtgagtaacctgcctctcagagggggataacgttctgaaaagaacgctaataccgcatataatcaagaaaccgcatgattttttgatgaaaggagcaatccgctgagagatggactcgcgtctgattagctagatggtggggtaacggcctaccatggcgacgatcagtagccggactgagaggttgaacggccacattgggactgagacacggcccagactcctacgggaggcagcagtgggggatattgcgcaatgggggaaaccctgacgcagcaatgccgcgtgaaggaagaaggttttcggattgtaaacttcttttgttaaggacgaagaatgacggtacttaacgaataagctccgg

SEQ ID NO: 1402 - DNA, 488 bp, Unknown
  Ascusbbf_5611, encodes 16S rRNA
agagtttgatcctggctcagaacgaacgctggcggcaggcttaacacatgcaagttgagcgggattggttagtagcttgctactgatcatgagagcagcgcactggtgagtaacacgtgggaacatgcctttaggtgggggacaacagttggaaacgactgctaataccgcatacgcccttagggggaaagatttatcgcctagagattggcccgcggaagattaggtagtaggtggggtaacggcctacctagccgacgatctatagctggtctgagaggacgatcagccacattggaactgagacacggtccagactcctacgggaggcagcagtgaggaatattgggcaatggagggaactctgacccagccatgccgcgtgagtgaagaaggttttcggattgtaaagctctttcgggtgagaagatgatgacggtatcaccagaagaagcaccggctaacttcgtgccagcagccgcggtaat

SEQ ID NO: 1403 - DNA, 490 bp, Unknown
  Ascusbbf_3888, encodes 16S rRNA
agagtttgatcatggctcaggatgaacgctggcggcgcgcctaacacatgcaagtcgaacgaaatgagtagcttcggttacgagtttagtggcggacgggtgagtaacgcgtggataatttgcctttcagtgggggatagctgagagaaatctcaattaataccgcataacataatttgttcgcatgagtgagttattaaagatgcaaatcgctggaagagaagtctgcgtctgattagcttgttggggtggtaacggcacaccaaggcgatgatcagtaaccggtttgagagagtgaacggtcacattgggactgagatacggcccagactcctacgggaggcagcagtggggaatattgcgcaatggaggaaactctgacgcagcgacgccgtgtgaaggatgaaggccttcgggttgtaaacttttatcgattgtgaaaagcaaggatggtagcaaagtaagaagctccggctaactacgtgccagc

SEQ ID NO: 1404 - DNA, 490 bp, Unknown
  Ascusbbf_64696, encodes 16S rRNA
agagtttgatcctggctcaggatgaacgccggcggtgtgcctaatacatgcaagtcgagcgcactggcccaactgatatgacgtgcttgcactgatttgacgatggatcaccagtgagcggcggacgggtgagtaacacgtgggcaacctgccctggagcgggggataacatttggaaacagatgctaataccgcataataatcaaaaccacatggttttgatttcaaagatggtttcggctatcactccaggatgggcccgcggtgcattagcttgttggtaaggtaacggcttaccaaggccatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaaactctgttgttgaagaagaacgtgcgtgagag

SEQ ID NO: 1405 - DNA, 490 bp, Unknown
  Ascusbbf_18758, encodes 16S rRNA
agagtttgatcatggctcagattgaacgctggcggcaggcctaacacatgcaagtcgagcggtaacaggggaagcttgcttctcgctgacgagcggcggacgggtgagtaatgtatggggatctgcccgatagagggggataactactggaaacggtggctaataccgcataatctcttaggagcaaagcaggggaccttcgggccttgcgctgtcggatgaacccatatgggattagctagtaggtaaggtaatggcttacctaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccctagggttgtaaagtactttcagtcgggaggaaggcgttgatgttaataccatcaacgattgacgttaccgacagaagaa

SEQ ID NO: 1406 - DNA, 490 bp, Unknown
  Ascusbbf_20515, encodes 16S rRNA
agagtttgatcctggctcaggatgaacgctagctacaggcttaacacatgcaagtcgaggggcagcatgaggccagcttgctggtcttgatggcgaccggcgcacgggtgcgtaacacgtatccaaccttcccagcgctcagggatagccttccgaaaggaagattaacacctgatggtctcgcggcggggcatcccgttgcgagtaaagtattacggcgttggatggggatgcgtccgattaggtagcaggcggggtaacggcccacctggcctacgatcggtaggggttctgagaggaaggtcccccacactggaactgagacacggtccagactcctacgggaggcagcagtgaggaatattggtcaatgggcggaagcctgaaccagccaagtagcgtgagggacgacggccctacgggttgtaaacctcttttgtttgggaataaagtgcgggacgcgtcccgctttgcatgtaccatgcgaata

SEQ ID NO: 1407 - DNA, 490 bp, Unknown
  Ascusbbf_13034, encodes 16S rRNA
agagtttgatcctggctcaggatgaatgctggcggcatgcctaatacatgcaagtcgagcggcagcgagggtctcatcctgttcttgaagctttcgagaatagaatgagatctgtcggcgagcggcggacggctgagtaacgcgtgggaacggaccccaaactgagggataactagtcgaaagattagctaataccgcatgtgatcttcggattaaagtcttcggacggtttgggactggcctgcgtacgattagatagttggtgaggtaatggctcaccaagtcgacgatcgttagatggtttgagaggatgatcatccagactgggactgagacacggcccagactcctacgggaggcagcagtagggaatctttcacaatgggcgaaagcctgatggagcaatgccgcgtgcaggacgaaggccttcgggttgtaaactgcttttataagcgaggaatatgacggtaacttatgaataaggatcggc

SEQ ID NO: 1408 - DNA, 490 bp, Unknown
  Ascusbbf_18478, encodes 16S rRNA
agagtttgatcctggctcaggacgaacgctggcggcgtgcttcatacatgcaagtcgaacgagaatcagaagcttgcttctgaggaaagtggcggacgggtgagtaatatgtagagaatctgccctttagcgggggacaacagttggaaacgactgctaataccccatatgagcgtatctgagatgatattcttgaaaactccggtgctagaggatgagtctgcatctgattagctagttggcggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgaccgatgaagcccttcggggtgtaaaggtctgtcagtggggacgaaacttgacggtacccacagaggaagcatcggctaactccgtgccagcagccg

SEQ ID NO: 1409 - DNA, 490 bp, Unknown
  Ascusbbf_63596, encodes 16S rRNA
agagtttgatcatggctcagaacgaacgctggcggcgtgcttaacacatgcaagtcgaacgagaaaggggcttcggccctgagtagagtggcgcacgggtgagtaacacgtgaataatctacctgaggatctgggataacattccgaaaggagtgctaataccggataagcccacgacttcttcggaaggtgcgggaaaaggtgggacttgttcctactgtcttcagatgagttcgcggcccattagctagttggtgaggtaaaggctcaccaaggcgacgatgggtagctggtctgagaggatgatcagccacactggaactgagacacggtccagactcctacgggaggcagcagtggggaattttgcgcaatgggcgaaagcctgacgcagcaacgccgcgtgagtgatgaaggctttcgagtcgtaaagctctgtcagaggggaagaacaaccttaagttgaataagcttaaggtctgacggtacc

SEQ ID NO: 1410 - DNA, 488 bp, Unknown
  Ascusbbf_67306, encodes 16S rRNA
agagtttgatcctggctcagaacgaacgctggcggcaggcttaacacatgcaagttgaacgggattttgagatagcttgctattttgaatgagagtggcgcacgggtgagtaatacgtgggaacatacctactagttcggaacaactgatggaaacgtcagctaataccggataagccctgagggggaaagattcatcgctagtagaatggcccgcggcagattaggcagttggtggggtaaaggcctaccaaacctacgatctgtagctggtctgagaggacgatcagccacattgggactgagacacggcccagactcctacgggaggcagcagtgaggaatattgggcaatgggggaaaccctgacccagccatgccgcgtgagtgaagaaggttttcggattgtaaagctctttcgggagagaagatgatgacggtatctccagaagaagccccggcaaacttcgtgccagcagccgcggtaat

SEQ ID NO: 1411 - DNA, 490 bp, Unknown
  Ascusbbf_320014, encodes 16S rRNA
agagtttgatcctggctcagaacgaacgctggcggcatggattaggcatgcaagtcgaacgggagcagtaatgctccagtggcgcaagggtgaggaacgcgtgagtgacttacccgcaagtttggaacagctcctggaaacgggaattaataccggatgtggtcgatgagctgcatggcttaccgattaaagcagtaatgcgcttgcggatgggctcgcgtcccattagctagttggtgaggtaacggcccaccaaggccatgatgggtagctggtctgagaggacgaccagccacactgggactgagaactgcccagactcctacgggaggctgcagtcgagaattttgggcaatggacgaaagtctgacccagcaatgccgcgtgcgggatgaaggtcttcggattgtaaaccgctgtttggagggacgaaaattgacggtacttccagagaaagccacggctaactacgtgccagcagccgcggtaa

SEQ ID NO: 1412 - DNA, 490 bp, Unknown
  Ascusbbf_19979, encodes 16S rRNA
agagtttgatcatggctcaggacgaacgctggcggtatgcctaacacatgcaagtcgaacgaaaaacgagggcttgctctcgtttttagtggcgcacgggtgagtaacgcgtgagtaatctgccttaaagtgggggacaacatttggaaacgaatgctaataccgcgtaatatacagttttcgcatgaattttgtattatagatttatcgctttaagatgagctcgcgtccgattagcttgttggcgaggtaaatgctcaccaaggcgacgatcggtagccgggttgagagactggtcggccacattggaactgagacacggtccagactcctacgggaggcagcagtggggaatattgcacaatgggggaaaccctgatgcagcaataccgcgtgagggacgaaggctctagggttgtaaacctctgtttaaagggatgaatttctgacagtacctttagaggaagctccggctaactacgtgccagca

SEQ ID NO: 1413 - DNA, 490 bp, Unknown
  Ascusbbf_56917, encodes 16S rRNA
agagtttgatcctggctcagattgaacgctggcggcatgccttacacatgcaagtcgaacggtaacggaccttcgggtgccgacgagtggcgaacgggtgagtaatacatcggaacgtgcccgatcgtgggggataacgaggcgaaagctttgctaataccgcatacgatctacggatgaaagcaggggaccgcaaggccttgcgcggacggagcggccgatggcagattaggtagttggtgggataaaagcttaccaagccgacgatctgtagctggtctgagaggatgatcagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaagccttcttctaatacaggagggtcatgacggtaccgtaagaataagcaccg

SEQ ID NO: 1414 - DNA, 490 bp, Unknown
  Ascusbbf_132123, encodes 16S rRNA
agagtttgatcatggctcaggacgaacgctggcggcgtgcctaacacatgcaagtcgaacgagaatcatatgacggaggcttcggccaactgagtatgaggaaagtggcgaacgggtgagtaacgcgtgaggaacctgcctcggagtgggggacaacagttggaaacgactgctaataccgcataatgtgcctgaagggcatccttcgggtaccaaagctttatgtgctctgagatggcctcgcgtctgattagatagttggcggggtaacggcccaccaagtctgcgatcagtagccgggttgagagactgaacggccacattgggactgagatacggcccagactcctacgggaggcagcagtggggaatattgggcaatgggggaaaccctgacccagcaacgccgcgtgaaggaagaaggctttcgggttgtaaacttcttttaccagggacgaaggacgtgacggtacctggagaaaaagccacg

SEQ ID NO: 1415 - DNA, 490 bp, Unknown
  Ascusbbf_34608, encodes 16S rRNA
agagtttgatcatggctcaggatgaacgctggcggcgtgcttaacacatgcaagtcgaacgggatacttacagtggagacttcggttgaagcagtaaattatctagtggcggacgggtgagtaacgcgtgggtaacctgcccattagaggaggataacagggagaaattcttgctaatactccatatgcttacggtatcgcatgatacagtgaggaaagaattttgctaatggatggacccgcgtttgattagccagttggtggggtaacggcctaccaaagctacgatcaatagccggcctgagagggtgatcggccacattgggactgagacacggcccaaactcctacgggaggcagcagtggggaatattgcacaatggggggaaccctgatgcagcaacgccgcgtgagtgaagaagtatttcggtatgtaaagctctatcgatgggaaataagatgaaggtacccaaataagaagccccggcta

SEQ ID NO: 1416 - DNA, 490 bp, Unknown
  Ascusbbf_116382, encodes 16S rRNA
agagtttgatcctggctcaggatgaacgctggcggcgtgcctaacacattcaagtcgaacggagttattgcggtgaggccctcgggcggaactgttttaacttagtggcggacgggtgagtaacgcgtgagcaacctgcctttgcaaccgggataacagccggaaacggctgctaatacgggatgacgtataactgccgcatggtggatataccaaagatccgttgtgcaaagatgggctcgcgtctgattagatagttggcggggtaacggcccaccaagtcgacgatcagtagccggactgagaggttgaacggccacattggaactgagatacggtccagactcctacgggaggcagcagtggggaatattgggcaatggacgaaagtctgacccagcgacgccgcgtgagggaagaaggtcttcggattgtaaacctctgttgatagggaagaagcaagtgacggtacctatcgaggaagtcacgg

SEQ ID NO: 1417 - DNA, 490 bp, Unknown
  Ascusbbf_51067, encodes 16S rRNA
agagtttgatcatggctcagaatgaacgttggcggcatggattaggcatgcaagtcgtgcgagaagctcccttcggggagtggaaagcggcgaaagggagagtaacgcgtgggtatctgccctcaggtctgggatagcggcgggaaactgccggtaataccagataatgtcttcggactaaaggtgtgattccgcctgtggatgggcccgcgtcctattagcttgttggtgaggtaatggctcaccaaggccgcgatgggtaccgggcgtgagagcgtggcccggctcactgggactgagacactgcccagacacctacgggtggctgcagtcgagaatcttcggcaatgggcgaaagcctgaccgagcgatgccgcgtgcgggatgaaggccctcgggttgtaaaccgctgtcagaggggaggaaatattggggggttctccccccagtttgacctagcctcgaaggaaggacgggctaagttcgtgcc

SEQ ID NO: 1418 - DNA, 490 bp, Unknown
  Ascusbbf_175287, encodes 16S rRNA
agagtttgatcctggctcaggatgaacgctagcggcaggcctaacacatgcaagtcgaggggcagcgcggtgtagcaatacactggcggcgaccggcgcacgggtgcgtaacgcgtatgcaacccacccgcgacaggggcataacggggggaaacccccactaattccccgtaaggccgcgtccccgcatggggatgcggcgaaagccttcgggcggttgcggacgggcatgcgtgacattagctagttggcggggcaacggcccaccaaggctgcgatgtctaggggagctgagaggctaatcccccacactggtactgagacacggaccagactcctacgggaggcagcagtgaggaatattggtcaatggtcggaagactgaaccagccatgccgcgtgggggaaggaggccctatgggtcgtaaaccccttttagccgggagtaataagggtcctgcggggcctgatgagagtaccggcggaataa

SEQ ID NO: 1419 - DNA, 490 bp, Unknown
  Ascusbbf_61831, encodes 16S rRNA
agagtttgatcatggctcaggatgaacgctagcggcaggcttaacacatgcaagtcgaggggcagcgcgttgtagcaatacaatggcggcgaccggcgcaagggtgcgtaacgcgtgagcaatctgcccgtgtcagggggataagcgatggaaacgtcgtctaataccgcataacaacctgggaggcatcttccgggcttgaaagatacgtcggacacggatgagctcgcgagacattagttagttggcggggtaacggcccaccaagaccgcgatgtctaggggaactgagaggttggtcccccacactggaactgagacacggtccagactcctacgggaggcagcagtgaggaatattggacaatggccggaaggctgatccagccatgccgcgtgaaggataaggtcctatggattgtaaacttcttttgagtgggagcaataagggtgtcgtgacacccgatgagagtaccattcgaataagcat

SEQ ID NO: 1420 - DNA, 490 bp, Unknown
  Ascusbbf_28126, encodes 16S rRNA
agagtttgatcatggctcaggatgaacgctggcggcgtgcctaacacatgcaagtcgaacgatgaaatacggagacgagttttcggacgagaggaagtatggaatagtggcggacgggtgagtaacgcgtggataatctgccccatacagggggatagcagttggaaacgactgataacaccgcataagcgcacggagaggcatctctttgtgtgaaaatctacggaggtaagggatgagtccgcgtccgattagccagttggcggggtaagagcccaccaaagcgacgatcggtagccggcctgagagggcggacggccacattgggactgagacacggcccagactcctacgggaggcagcagtgggggatattgcacaatggggggaaccctgatgcagcgacgccgcgtgggtgaagaagtatttcggtatgtaaagccctatcagcagggaagaaagtgacggtacctgagtaagaagccccggc

SEQ ID NO: 1421 - DNA, 490 bp, Unknown
  Ascusbbf_288952, encodes 16S rRNA
agagtttgatcctggctcaggatgaacgctggcggcatgcctaagacatgcaagtcgaacgaggtggccctttgaaggatgcgtgcttgcacaattctggaaaaggattttccacctagtggcagacgggtgagtaacacgtgggtgacctacctctaagttggggataacagttggaaacgattgctaataccgaatgagatataactgtcatggttatattgaaaggagctttcaagcttcgcttagaaatgggcctgcggcgtattaactagttggtggggtaatggcctaccaaggtaacgatgcgtagccggactgagaggttgaacggccacactgggactgagacacggcccagactcctacgggagacagcagttaggaatattcgtcaatgggggaaaccctgaacgagcaatgccgcgtgagtgatgaaggtctttggattgtaaaactctgttgtatggaaaaaacggctaggttagga

SEQ ID NO: 1422 - DNA, 490 bp, Unknown
  Ascusbbf_736674, encodes 16S rRNA
agagtttgatcctggctcaggatgaacgctggcggcgtgcctaacacatgcaagtcgaacggacctatcatttaacagagacttcggttgaagttggttttaggttagtggcggacgggtgagtaacgcgtggagaacctgccctgtactgggggataacagtgagaaatcactgctaataccgcataagcgcacggaaccgcatggttttgtgtgaaaaactccggtggtacaggatggctccgcgttggattagcctgttggcggggtaacggcccaccaaagctacgatccatagccggcctgagagggtgaacggccacattgggactgagacacggcccagactcctacgggaggcagcagtggggaatattgcacaatggggggaaccctgatgcagcgacgccgcgtgaaggaagaagtatctcggtatgtaaacttctatcagcagggaagaaaatgacggtacctgactaagaagccccgg

SEQ ID NO: 1423 - DNA, 490 bp, Unknown
  Ascusbbf_281557, encodes 16S rRNA
agagtttgatcatggctcaggacgaacgctggcggcgtgcctaacacatgcaagtcgaacgagaaatatggaaaggatcccttcggggagaatagaaatatggacagtggcggacgggcgagtaacgcgtgagtaacctgcccataagcgggggatagccgatggaaacgtcgagtaataccccatgatgtatatatatcgcatggtatatatatcaaagatttatcgtttatggatggactcgcgtctgattagatagttggtgaggtaacggctcaccaagtcgacgatcagtagccgaactgagaggttgatcggccgcattgggactgagacacggcccagactcctacgggaggcagcagtgggggatattgcgcaatggggggaaccctgacgcagcaacgccgcgtgcaggaagaaggtcttcggattgtaaactgttgtcgcaagggaagaagaaagtgacggtaccttgtgagaaagtcac

SEQ ID NO: 1424 - DNA, 490 bp, Unknown
  Ascusbbf_1459368, encodes 16S rRNA
agagtttgatcatggctcagaacgaacgctggtggcgtgtcttatacatgcaagtcgagcgaggcagcgatgccgagcggcgaacgggtgagtaacgcgtaagcgatctgcctcatatcaggaaatacccgtgccaacgcgcggttaatgtccaggagggtggccagctgcatggctggttgactagagatttatcggtgtgggatgagcttgcgtccgattagctagttggcggggcaacggcccaccaaggcgacgatcggtagccggcctgagagggtgatcggccacattgggactgagatacggcccagactcctacgggaggcagcagtagggaatattgcacaatgggggaaaccctgatgcagcaacgccacgtgtgggaagaagcatttcggtgtgtaaaccactgtcatgagggaataaggcccgttttaggacgggattgaatgtaccttgagaggaaacaccggcaaacttcgtgcca

SEQ ID NO: 1425 - DNA, 490 bp, Unknown
  Ascusbbf_143119, encodes 16S rRNA
agagtttgatcatggctcagattgaacgctggcggcatgctttacacatgcaagtcggacggcagcgaggaagtgcttgcacttctgtcggcgagtggcgaacgggtgagtaatgcattggaacgtaccgagtagtgggggataactgtccgaaaggatagctaataccgcatacgacctgagggtgaaagcgggggactcttagagcctcgcgctatttgagcggccaatgtctgattaggtagttggtggggtaaaggcctaccaagccgacgatcagtagcgggtctgagaggatgatccgccacactgggactgagacacggcccagactcctacgggaggcagcagtggggaattttggacaatgggggcaaccctgatccagccatgccgcgtgtctgaagaaggccttcgggttgtaaaggacttttgtcggggaagaaaaggaattggttaatacccagttctgatgacggtacccgaagaa

SEQ ID NO: 1426 - DNA, 490 bp, Unknown
  Ascusbbf_113346, encodes 16S rRNA
agagtttgatcatggctcaggatgaacgctggcggcgtgcttaatacatgcaagtcgaacgaagcatgttgacggaatcccctcggggaggaagatgacatgacttagtggcggacgggtgagtaacgcgtgggcaatctgccctgtacagggggacaacagttggaaacgactgctaataccgcataagcgcacgatgaccgcatggtcaggtgtgaaaaggagcaatccggtacaggatgagcccgcgtccgattagccagttggcggggtaacggcccaccaaagctacgatcggtagccgacttgagagagtgatcggccacattgggactgagacacggcccagactcctacgggaggcagcagtagggaatattgcacaatgggggaaaccctgatgcagcgacgccgcgtgagtgaagaagcatttcggtgcgtaaagctctatcagcagggaagatgatgacggtacctgactaagaagccc

SEQ ID NO: 1427 - DNA, 490 bp, Unknown
  Ascusbbf_281856, encodes 16S rRNA
agagtttgatcatggctcagattgaacgctagcgggatgccttacacatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgtaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgttccgggttaataccccgggaaactgacggtacctgcagaataagcac

SEQ ID NO: 1428 - DNA, 490 bp, Unknown
  Ascusbbf_300189, encodes 16S rRNA
agagtttgatcatggctcaggatgaacgctagctacaggcttaacacatgcaagtcgaggggcagcatggacttagcttgctaagtccgatggcgaccggcggacgggtgagtaacgcgtatccaaccttcccgcgagtaggggatagcccggagaaatccggattaataccctatgtgcccgagagatgacatcagaccccgggcaaagattcatcgctcgcggatggggatgcgtccgattaggcagcaggcggggtgacggcccacctggccttcgatcggtaggggttctgagaggaaggtcccccacactggtactgagacacggaccagactcctacgggaggcagcagtgaggaatattggtcaatgggcgagagcctgaaccagccaagtagcgtgcaggacgacggccctacgggttgtaaactgcttttaccaggggataaaagtcgccacgcgtggcgttttgcaggtacctggtgaat

SEQ ID NO: 1429 - DNA, 490 bp, Unknown
  Ascusbbf_96807, encodes 16S rRNA
agagtttgatcatggctcaggatgaacgctggcggcgcgcctaacacatgcaagtcgaacgaagcatttatacggatcccttcggggtgaaggatttatgacttagtggcggacgggtgagtaacgcgtggggaacctgccccgtacagggggataacagttagaaatgactgctaataccgcataagcgcacacgaaggcatcttcgagtgtgaaaagccgagacggtacgggagggccccgcgtctgattagctggttggtggggtaacggcctaccaaggcgacgatcagtagccgaactgagaggttgatcggccacattgggactgagacacggcccagactcctacgggaggcagcagtgggggattttgcacaatggggggaaccctgatgcagcgacgccgcgtgagtgaagaagtatttcgatacgtaaagctctatcagcagggaagaaaatgacggtacctgactaagaagccccggct

SEQ ID NO: 1430 - DNA, 490 bp, Unknown
  Ascusbbf_140446, encodes 16S rRNA
agagtttgatcatggctcaggatgaacgctggcggcgtgcttaacacatgcaagtcgaacgaggctcatctgtggaagttttcggatggaaacggatgtgaccgagtggcggacgggtgagtaacgcgtggggaacctgccccattccgggggataccagttggaaacgactgttaataccgcataagcgcacgggaaggcatcttccagtgtgaaaaactgaggtggaatgggatggccccgcgtctgattagccagttggcagggtaacggcctaccaaagcgacgatcagtagccggcctgagagggcgaccggccacattgggactgagacacggcccaaactcctacgggaggcagcagtggggaatattgcacaatggggggaaccctgatgcagcgacgccgcgtgagtgaggaagtatttcggtatgtaaagctctatcagcagggaagaagatgacggtacctgcacaagaagccccggct

SEQ ID NO: 1431 - DNA, 490 bp, Unknown
  Ascusbbf_197210, encodes 16S rRNA
agagtttgatcatggctcagaacgaacgctggcggcgcgtcttaagcatgcaagtcggacggcaagatcggtgcttgcactgatcctagagtggcggactggtgagtaacgcgtgggtgacgtaccctccggacggggatagctactagaaatagtagataataccggatacggtgcactgtgtcagaggcagtgcaggaaaggttcttttgaaccgccgggggagcggcccgcgtgccattagctagttggtggggtaacggcttaccaaggcaacgatggctacccggcctaagagggggatcgggcacattgggactgagatacggcccagactcctacgggaggcagcagctaagaatattccgcaatgggggaaaccctgacggagcgacgccgcgtggacgatgaaggccggaaggttgtaaagtccttttaggtacgaggaataagtagagtgagagaaacgctttacggtgacggtagtacc

SEQ ID NO: 1432 - DNA, 490 bp, Unknown
  Ascusbbf_65378, encodes 16S rRNA
agagtttgatcatggctcaggatgaacgctggcggcgtgcttaacacatgcaagtcgaacgaggtccatggagcttgctccggaagatctagtggcgaacgggtgcgtaacacgtgagaaacctgccccggtctctgggataacagttggaaacgactgctaataccggatgccatcgctccgccgcatgatggagcgatgaaagatttatcggatcgggagggtctcgcggcctatcagcttgttggagaggtaacggctcaccaaggcatcgacgggtagctggtctgagaggatgatcagccacactgggactgagacacggcccagactcctacgggaggcagcagtggggaatcttgcacaatgggcgaaagcctgatgcagcaacgccgcgtgcgggaagaaggccctagggttgtaaaccgctttcagcagggaagaaaatgacggtacctgcagaagaaggtgcggccaactacgtgccagc

SEQ ID NO: 1433 - DNA, 490 bp, Unknown
  Ascusbbf_705281, encodes 16S rRNA
agagtttgatcctggctcaggatgaacgctggcggcgtgcttaacacatgcaagtcgaacggagcacccatgaaggagttttcggacaacagattggaatgcttagtggcggacgggtgagtaacgcgtgaggaacctgcctcggagtggggaataacacagtgaaaattgtgctaataccgcataacgcagttgagtcgcatggctctgactgccaaagatttatcgctctgagatggcctcgcgtctgattagcttgttggcggggtaacggcccaccaaggcgacgatcagtagccggactgagaggttgatcggccacattgggactgagacacggcccagactcctacgggaggcagcagtggggaatattgggcaatgggcgcaagcctgacccagcaacgccgcgtgaaggaagaaggctttcgggttgtaaacttcttttaagagggacgaaacaaatgacggtacctcttgaataagccac

SEQ ID NO: 1434 - DNA, 490 bp, Unknown
  Ascusbbf_695310, encodes 16S rRNA
agagtttgatcatggctcaggatgaacgctggcggcgtgcctaacacatgcaagtcgagcggagttaacagaagattcttcgaatgattttgtcaacttagcggcggatgggtgagtaacacgtgggtaatctgccctgcacagggggataacagctggaaacggctgttaataccgcatatgcacacgttatcgcatgatagagtgtggaaagatttatcggtgcaggatgagcccgcgtcggattaacttgttggcagggtaacggcctaccaaggtgatgatccgtagccggcctgagagggcgaccggccacattgggactgagacacggcccaaactcctacgggaggcagcagtggggaatattgcacaatgggcgcaagcctgatgcagcgacgccgcgtgaaggaagacgtatttcggtatgtaaacttctatcagcggggaagaagatgacggtacccgactaagaagccccggctaacta

SEQ ID NO: 1435 - DNA, 489 bp, Unknown
  Ascusbbf_77108, encodes 16S rRNA
agagtttgatcctggctcagaacgaacgctggcggcaggcttaacacatgcaagttgaacgggattgttccggtagcttgctactggagcatgagagtagcgcactggtgagtaacacgtgggaacgcacccattggtgggggatagcaattggaaacgattgataataccgcataagccctaagggggaaagattgattgccgatggaacggcccgcggaagattaggtagttggtggggtaaaggcctaccaagcctacgatctatagctgatctgagaggatgaacagccacattggaactgagacacggtccagactcctacgggaggcagcagtgaggaatattgggcaatggaggaaactctgacccagccatgccgcgtgagtgagaaggtcttcggattgtaaagctcttttatgcaggaagatgatgacagtactgcaagaaaaagcaccggcaaacttcgtgccagcagccgcggtaat

SEQ ID NO: 1436 - DNA, 490 bp, Unknown
  Ascusbbf_62751, encodes 16S rRNA
agagtttgatcatggctcaggatgaacgctagcggcaggcctaacacatgcaagtcgagcgggatccaccttcgggtggtgagagcggcgcacgggtgcgtaacgcgtatacaacctaccttttgctacgggatagcccagagaaatttggattaacaccgtatagtataatttcccggcatcgggggcttattaaaggctacggcaaaagatgggtatgcgtcctattagctagatggtgtggtaacggcataccatggcaacgataggtaggggccctgagagggggatcccccacactggtactgagacacggaccagactcctacgggaggcagcagtgaggaatattggacaatgggcgcaagcctgatccagccatgccgcgtgcaggaagactgccctatgggttgtaaactgcttttatacgggaagaaacaccccctcgtgagggggcttgacggtaccgtaggaataaggatcggctaac

SEQ ID NO: 1437 - DNA, 490 bp, Unknown
  Ascusbbf_90854, encodes 16S rRNA
agagtttgatcatggctcaggatgaacgctggcggcgtgcttaacacatgcaagtcgaacggacatatgtcaccgctgttgatttagcttgctattgacgcagcaccggcatatgttagtggcggacgggtgagtaacgcgtgggcaacctgcctttatccgggggataacagttagaaatgactgctaataccgcataagcgcacggtaccgcatggtacagtgtgaaaaactccggtggatagagatggacccgcgttagattagccagttggcggggtaacggcccaccaaagcgacgatctatagccggcctgagagggcgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaaaggacggtacctgcac

SEQ ID NO: 1438 - DNA, 490 bp, Unknown
  Ascusbbf_137298, encodes 16S rRNA
agagtttgatcatggctcaggatgaacgctggcggcgtgcttaatacatgcaagtcgaacgagcagagatattcgtatcgaagcgagtggcggacgggtgagtaacgcgtgggaaacctgccctataccgggggataacagttggaaacgactgctaataccgcataagcgcacggtgtcgcatgacattgtgtgaaaaactccggtggtataggatggtcccgcgtctgattagctagttggtgaggtaacggcccaccaaggcgacgatcagtagccgacctgagagggtgaccggccacattgggactgagacacggcccaaactcctacgggaggcagcagtagggaatattggacaatgggggcaaccctgatccagcgacgccgcgtgagtgaagaagtatttcggtatgtaaagctctatcagcagggaagaaaatgacggtacctgactaagaagcaccggctaaatacgtgccagcagccg

SEQ ID NO: 1439 - DNA, 490 bp, Unknown
  Ascusbbf_155325, encodes 16S rRNA
agagtttgatcatggctcagagcgaacgttagcggcgcgcctaacacatgcaagtcgcacggggtagcaatacccagtggcgcacgggtgcgtaacacgtagataacctgccctgaagagggggataacgttccgaaaggagcgctaataccgcataacgccgagttgggtttgcctgattcggacaaaggctgggaccagcaatggccagtcgctttaggaggggtctgcggcccatcagctagttggtaaggtaaaggcttaccaaggcaaagacgggtagctggtctgagaggatgatcagccacactggtactggaacacggaccagactcctacgggaggcagcagtggggaatcttggtcaatgggcgcaagcctgaaccagcgacgccgcgtgagtgatgaaggccttcgggttgtaaagctctgtggggagggacgaaagactgaggtctaataggcttcaggttgacggtacctccttagc

SEQ ID NO: 1440 - DNA, 470 bp, Unknown
  Ascusbbf_81569, encodes 16S rRNA
agagtttgatcatggctcagaacgaacgctggcggcaggcctaacacatgcaagtcgagcgctccagcaatggagagcggcagacgggtgagtaacgcgtgggaaccttcccagtggtacggaatagctcagggaaacttggggtaataccgtatacgccccttgggggaaagatttatcgccattggatgggcccgcgttggattagctagttggtgaggtaacggctcaccaaggcgacgatccatagctggtctgagaggatgaccagccacactgggactgagacacggcccagactcctacgggaggcagcagtggggaatattggacaatgggcgcaagcctgatccagccatgccgcgtgagtgacgaaggtcttcggattgtaaagctcttttggcggggacgataatgacggtacccgcagaataagccccggctaacttcgtgccagcagccgcggtaat

SEQ ID NO: 1441 - DNA, 359 bp, Unknown
  Ascusbbf_394497, encodes 16S rRNA
agagtttgatcatggctcagaacgaacgctggcggcgcgtcttaagcatgcaagtcggacggcagggcaccttcgggtgtccgagagtggcgaacgggtgagtaacacgtaagtgatctgccctgcagttggggatagcctgtggaaacacagggtaataccggatgagatgtcaatgattgaactatgacatgaaagtggctatggccacgctgcaggatgagcttgcggctcattagctagttgggggtgtaacggaccaccaaggcgacgatgagtagccggcctgagagggtgaacggccacattgggactgagacacggcccagactcctacgggagccagcagccgcggtaat

SEQ ID NO: 1442 - DNA, 490 bp, Unknown
  Ascusbbf_1067063, encodes 16S rRNA
agagtttgatcatggctcaggatgaacgctagcggcaggcttaacacatgtaagtcgaggggcagcgcgggtagcaatacctggcggcgaccggcggaagggtgcgtaacgcgtgagcaacctgcccgtatcagggggataagcgatggaaacgccgtctaataccccataacaacagaggctgcatgacctttgtttgaaagattcgtcggatacggatgggctcgcgagacattagctagttggagtggtaacggcacaccaaggcgacgatgtctaggggttctgagaggaaggtcccccacattggaactgagacacggtccaaactcctacgggaggcagcagtgaggaatattggtcaatggccgcaaggctgaaccagccatgccgcgtgcgggaataaggccctatgggtcgtaaactgcttttgtggtggagcaataagacgtacgtgtacgtcgatgagagtacatcacgaataagcatc

SEQ ID NO: 1443 - DNA, 490 bp, Unknown
  Ascusbbf_1149773, encodes 16S rRNA
agagtttgatcctggctcagaacgaacgctggcggcgcgtcttaagcatgcaagtcgagcgagctacttcggtagcgagcggcgcacgggtgagtaacgcgtagatgatctacccttgagacggagatacctctgggaaactggagttaatacccgataacgcacattggttggttccgatgtgttaaagcggtgcaagtcgcacttgaggatgagtctgcggcctatcagctagttggtggggtaacggcctaccaaggcgaagacgggtagctgatctgagaggatgatcagccacattgggactgagacacggcccaaactcctacgggaggcagcagtagggaatattgcgcaatggggggaaccctgacgcagcgacgccgcgtgagtgatgacggcctttttggttgtaaagctctgtaaagagggaaaaatgttgcagtgaagagctgcaattgatggtacctctaaagtaaggaccggctaa

SEQ ID NO: 1444 - DNA, 490 bp, Unknown
  Ascusbbf_398561, encodes 16S rRNA
agagtttgatcatggctcaggatgaacgctagcgataggcttaacacatgcaagtcgaggggcagcataattttagcttgctaagattgatggcgaccggcgcacgggtgcgtaacgcgtatgcaacttgcctgtcagagggggataacccggagaaattcggactaataccgcatatacttattttgttgcatgacagattaaggaaagatttattgctgacagataggcatgcgttccattagttagttggtgaggtaacggctcaccaagacgacgatggatagggggactgagaggttgaccccccacactggtactgagatacggaccagactcctacgggaggcagcagtgaggaatattggtcaatgggcgaaagcctgaaccagccaagtcgcgtgaaggatgacggttctatggattgtaaacttcttttgtacaggattaaaagcttctacgtgtagggggaattgcagttactgtacga

SEQ ID NO: 1445 - DNA, 490 bp, Unknown
  Ascusbbf_282286, encodes 16S rRNA
agagtttgatcatggctcaggacgaacgctggcggcgtgcttcacacatgcaagtcgaacggaaaggcccagcttgctgggtgctcgagtggcgaacgggtgagtaacacgtgggtaacctgcccccatcttcgggataactgttggaaacgatggctaataccggatactactactggtcgcatggcctggtggtggaaagcttttgcggttggggaggggctcgcggcctatcagctggttggtggggtgatggcctaccaaggcggtgacgggtagccggcctgagagggcggtcggtcacattgggactgagatacggcccagactcctacgggaggcagcagtggggaattttgcacaatgggcggaagcctgatgcagcgacgccgcgtgagggatgacggctttcgggttgtaaacctcttttatccatgacgaaggtcgggtttttgcttggctgacggtagtggttgaataagcgccggct

SEQ ID NO: 1446 - DNA, 490 bp, Unknown
  Ascusbbf_698042, encodes 16S rRNA
agagtttgatcctggctcagaatgaacgctggcggcatggattaggcatgcaagtcgaacgccccgggcttgcccggggagtggcgaaagggtgcgcaacgcgtggggaacccgcccccgggcccgggacaagcgctggaaacggcgtctgatacgggatgcggacccgcctggcatcaggcggcgtccaaagattcatcgcccggggagggccccgcgtcccattagcttgttggcggggtgacggcccaccaaggcttcgacgggtaggtggtctgagaggatggtcacccacactgggactgagacactgcccagactcctgcgggaggctgcagtcgagaatcttccgcaatgggcgaaagcctgacggagcgatgccgcgtaagggacggaggccttcgggtcgtgaacctctgtcacccgggacgaaggacgacggtaccgggagaggaagccacggctaactacgtgccagcagccgcggtaa

SEQ ID NO: 1447 - DNA, 490 bp, Unknown
  Ascusbbf_131099, encodes 16S rRNA
agagtttgatcatggctcaggatgaacgctggcggcgtgcctaatacatgcaagtcgagcgagattctgtcagatgagacttcggtggattcagacggatgaaagcggcggacgggtgagtaacgcgtaggcaacctgccccatgcacagggatagccactggaaacggtgattaatacctgataatgcggaccgtatgcatatacggactgccaaagatttatcggcaagggatgggcctgcgtctgattagctggttggtgaggtaacggctcaccaaggcgacgatcagtagccgacctgagagggtgatcggccacattggaactgagacacggtccaaactcctacgggaggcagcagtagggaatcttgcacaatgggcgaaagcctgatgcagcaacgccgcgtgaaggaagaaggccttcgggttgtaaacttcttttctcggggaagaaacaaatgacggtacctgaggaataagccccgg

SEQ ID NO: 1448 - DNA, 490 bp, Unknown
  Ascusbbf_557339, encodes 16S rRNA
agagtttgatcctggctcaggacgaacgctggcggcgtgcttcatacatgcaagtcgaacgagaatctggagcttgcttcagaggaaagtggcggacgggtgagtaatatgtagagagtctgccctttagcgggggacaacagttggaaacgactgctaataccccatatgcgcgtagttgagatactattcgtgaaaactccggtgctaaaggatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgaccgatgaagcccttcggggtgtaaaggtctgtcagtggggacgaaacttgacggtaccctcagaagaagcaccggctaactccgtgccagcagccg

SEQ ID NO: 1449 - DNA, 468 bp, Unknown
  Ascusbbf_332159, encodes 16S rRNA
agagtttgatcctggctcagaacgaacgctggcggcaggcttaacacatgcaagtcgagcgccccgcaaggggagcggcagacgggtgagtaacacgtggggatctgcccaatggtacggaatagctccgggaaactggaattaataccgtatgagcccgcaaggggaaagatttatcgccattggatgaacccgcgtcggattagctagttggtgtggtaaaggcgcaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgccgacgaagataatgacggtagtcggagaagaagccccggctaacttcgtgccagcagccgcggtaat

SEQ ID NO: 1450 - DNA, 481 bp, Unknown
  Ascusbbf_1333948, encodes 16S rRNA
agagtttgatcctggctcagaacgaacgctggcggcacgcttaacacatgcaggtcggacggagtgtaagggcttgcgcttacacttagtggcggacgggtgagtaacacgtgggaacatatcctgtagtggtggatagctctgggaaactggaggtaatacagcataagctcgagagaggaaagagagattgctataggggtggcccgcggctgatttggtagttggtggggtaaaggcctaccaagccgaggatcagtagctggcctgagaggatggacagccacactgaaactgagatacggctcagactcctacgggaggcagcagtggggaatattggacaatgggggcaaccctgatccagcgatgccgcgtgagtgaagaaggtcttaggattgtaaagctcttttgacagggaagatgatgacggtacctgtagaataagcaccggctaactctgtgccagcagccgcgtaat

SEQ ID NO: 1451 - DNA, 490 bp, Unknown
  Ascusbbf_72466, encodes 16S rRNA
agagtttgatcatggctcaggacgaacgctggcggcgtgcttaacacatgcaagtcgagcggtaaggccctttcgggggtacacgagcggcgaacgggtgagtaacacgtgagtgacctgccctaaactttgggataacagtcggaaacgattgctaatactggatatgacctttcatcgcatggtggggggtggaaagcttttgcggtttgggatggactcgcggcctatcagcttgttggtgcggtagtggcgtaccaaggcttcgacgggtagccggcctgagagggcgaccggccacattgggactgagatacggcccaaactcctacgggaggcagcagtgggaatattgcacaatgggcgcaagcctgatgcagcaacgccgcgtgtgggatgacggccttcgggttgtaaaccactttcgacagggacgaagcgtgagtgacggtacctgtagaagaagcaccggccaactacgtgccagcag

SEQ ID NO: 1452 - DNA, 490 bp, Unknown
  Ascusbbf_190139, encodes 16S rRNA
agagtttgatcatggctcaggatgaacgctggcggcgtgcataacacattcaagtcgaacggaacaagcccttcgggacttgtttagtggcggacgggtgagtaacgcgtgagcaacctgcctctttgtacgggataacgtcgggaaactgacgctaatacggtatgacgcataggattcgcatgggttttatgccaaagatttattgcagagagatgggctcgcgtccgattagatagttggtgaggcaacggctcaccaagtcgacgatcggtagccggactgagaggttgaacggccacattggaactgagaaacggtccagactcctacgggaggcagcagtggggaatattgggcaatgggcgaaagcctgacccagcgacgccgcgtgaaggaagacggtcctcggattgtaaacttcttttataagggacgaaatatgacggtaccttatgaataagccacggctaactacgtgccagcagcc

SEQ ID NO: 1453 - DNA, 490 bp, Unknown
  Ascusbbf_721072, encodes 16S rRNA
agagtttgatcctggctcagaatgaacgttggcggcgtggattaggcatgcaagtcgagcggcaaggtttccttcgggagaccctagagcggcggaagggataggacagtatagataacgtgcctcttagctcaggatagcgtctggaaacgggcgataatactgaatgacgtgtacgcacgaaaggtgtaattccgctaagagatcggtctatatcctattagctagttggtaaggtaacggcttaccaaggcgatgatgggtacggggcgtgagagcgtgaccccgatcactgggactgagacactgcccagacgcctacgggcggctgcagtcgagaatcttcggcaatggacgcaagtctgaccgagcgacgccgcgtgtatgatgaaggtcttcggattgtaaagtactgtcgattaggcggaaggagtaagggcaaacctttacttttgacctattatttgaggaaggacgggctaagttcgtg

SEQ ID NO: 1454 - DNA, 490 bp, Unknown
  Ascusbbf_452876, encodes 16S rRNA
agagtttgatcatggctcaggacgaacgctggcggcgtgcctaatacatgcaagttgaacgcttctttcttatcgaacttcggttcaccaagaaagaggagtagcgaacgggtgagtaacacgtgggtaacctgcccatcagcgggggataacacttggaaacaggtgctaataccgcataatgctttttctcacatgagagaaagctgaaaggcgcttttgcgtcactgatggatggacccgcggtgcattagctagttggtagggtaacggcctaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaataaggatgagaagagaatgttcatcccttga

SEQ ID NO: 1455 - DNA, 490 bp, Unknown
  Ascusbbf_194417, encodes 16S rRNA
agagtttgatcatggctcaggataaacgctggcggcgtgcctaatacatgcaagttgagcggatggcttcggccattagcagcgaacgggtgagtaacacgtaggcaacctgccctgttgactgggataactgaccgaaaggtttgctaataccggataataatatatatcgcatgatatatagatgaaagttgggacacaacacaacaggatgggcctgcggcgcattagctagatggtgagatagcagcccaccatggtaatgatgcgtagccgatctgagaggatgtacggccacattggaactgagacacggtccagactcctacgggaggcagcagtagggaattttcggcaatggagggaactctgaccgagcaacgccgcgtgaacgaagaaggccttcgggtcgtaaagttttgttattgaggatgaaagatgcttatagggaatgataagtaagtgacagtacttgatgaggaagtcacgg

SEQ ID NO: 1456 - DNA, 490 bp, Unknown
  Ascusbbf_896931, encodes 16S rRNA
agagtttgatcctggctcaggatgaacgctagcgacaggcctaacacatgcaagtcgaacgagcgaaagagtgcttgcactctctagctagtggcggacgggtgagtaacacgtgagcaatctgcctttcggtgggggataccaattggaaacgattgttaataccccataacatagataagccgcatgacctatctatcaaagatttattgccggaagatgagctcgcgtctgattaggtagttggtgaggtaacggcccaccaagccgacgatcagtagccggactgagaggttgaacggccacattgggactgagacacggcccagactcctacgggaggcagcagtggggaatattgcacaatgggcgaaagcctgatgcagcgatgccgcgtgagggaagaaggttttaggattgtaaacctctgtctttggggacgataatgacggtacccaaggaggaagctccggctaactacgtgccagca

SEQ ID NO: 1457 - DNA, 490 bp, Unknown
  Ascusbbf_357446, encodes 16S rRNA
agagtttgatcatggctcagaacgaacgctggcggcgcgtcttaagcatgcaagtcgaacggcaaggggagcttgctccccctagagtggcggactggtgagtaacacgtgggtgacatgcccttcggttgggaatagctactagaaatagtagataatgccgaatacggttgcactttttagagaggtgtaaagaaaggagcttcggctccgccggaggattggcccgcggcccattagctagttggtgaggtaaaggcccaccaaggcaatgatgggtatccggcctgagagggtgatcggacacattgggactgagatacggcccagactcctacgggaggcagcagctaagaatattccgcaatggacgaaagtctgacggagcgacgccgcgtggatgattgaaggccgaaaggttgtaaaatccttttggatcggaagaataagtacgggagggaatgcctgtatggtgacggtacgatccgaa

SEQ ID NO: 1458 - DNA, 490 bp, Unknown
  Ascusbbf_965240, encodes 16S rRNA
agagtttgatcatggctcagaatgaacgctggcggcatggattaggcatgcaagtcgaacggcagggcagcgatgcccgagagtggcgaaagggtgagcaacgcgtggggaacctgccccggggaccggaacaagcctgtgaaaacgggtctgaaaccggatgaggccccgcaccgcatggtgcggcggcgaaatattcatagccccgggagggccccgcgtcccattagcttgttggcggggtgacggcccaccaaggcgacgacgggtaggtggtctgagaggatggtcacccacactgggactgagacactgcccagactcctacgggaggctgcagtcgagaatcttccgcaatgggcgcaagcctgacggagcgatgccgcgtgggggaggaaggccttcgggttgtaaacccctgtcggacgggacgaaaccaaacgacggtaccgtccaaggaagccacggctaactacgtgccagcagccgc

SEQ ID NO: 1459 - DNA, 490 bp, Unknown
  Ascusbbf_1888766, encodes 16S rRNA
agagtttgatcatggctcaggatgaacgctagcggcaggcttaacacatgcaagtcgaggggcagcgggtgtagcaatacatgccggcgaccggcgcaagggtgcgtaacgcgtgagcgacatgcccgtgacctggggataaccgatggaaacgtcgcctaacccccaatacgatacacattcgcatggacgtgtattgaaaaccttggtggtcacggattggctcgcgtcccattaggtagacggcggggtaacggcccaccgtgccgacgatgggtaggggttctgagaggaaggtcccccacaatggaactgagacacggtccatactcctacgggaggcagcagtgaggaatattggtcaatgggcggaagcctgaaccagccatgccgcgtgcgggacgacggccctacgggttgtaaaccgcttttgtgtgtgagcaataagggcgcttcgtgcgtccgatgagagtagcatacgaataagcat

SEQ ID NO: 1460 - DNA, 490 bp, Unknown
  Ascusbbf_149918, encodes 16S rRNA
agagtttgatcctggctcaggacgaacgctggcggcgtgcttaacacatgcaagtcgagcggtaaggctccttcgggagtacacgagcggcgaacgggtgagtaacacgtgagcaatctgcccttcacatcggaataaccctgggaaactggggctaataccgaatatcacttccggtggcatcatcggaagttgaaagctccggcggtgaaggatgagctcgcggcctatcagcttgttggtgaggtaaaggctcaccaaggcaacgacgggtagccggcctgagagggtgaccggccacactgggactgagacacggcccagactcctacgggaggcagcagtggggaatattggacaatgggcggaagcctgatccagcaacgccgcgtgagggatgacggccttcgggttgtaaacctctttcagcagggacgaagcgaaagtgacggtacctgcagaagaagcaccggccaactacgtgccagca

SEQ ID NO: 1461 - DNA, 490 bp, Unknown
  Ascusbbf_1505869, encodes 16S rRNA
agagtttgatcatggctcaggatgaacgctagctacaggcttaacacatgcaagtcgaggggcagcatgggtgtggctttccacacctgatggcgaccggcgcacgggtgagtaacgcgtatccaaccttccccccggtaggggacagcccggtgaaaaccggattaataccctatgccgtcacaccggggcatcttaatgtgacgaaagatttatcgcctggggatggggatgcgtctgattaggcagtaggcggggcaacggcccacctagccaccgatcagtaggggttctgagaggaaggtcccccacattggaactgagacacggtccaaactcctacgggaggcagcagtgaggaatattggtcaatgggcggaagcctgaaccagccaagtagcgtgagggatgacggccctacgggttgtaaacctcttttatgcggggataaccgcctccacgggtgggggcctgcaggtaccgcatgaat

SEQ ID NO: 1462 - DNA, 374 bp, Unknown
  Ascusbbf_1336907, encodes 16S rRNA
agagtttgatcctggctcaggatgaacgctggcggcgtgcttaacacatgcaagtcgaacgaggattgtcggttgaagttttcggatggaaactggcaataccgagtggcggacgggtgtgtaacgcgtgggggacctgccccattccgggggataccagttggaaacgactgttaataccgcataagcgcacggcatcgcatgatgcagtgtgaaaaactgaggtggaatgggatggccccgcgtctgattagccagttggcagggtaacggcctaccaaagcgacgatcagtagccggcctgagagggcgaccggccacattgggactgagacacggcccaaactcctacgggagccagcagccgcggtaat

SEQ ID NO: 1463 - DNA, 490 bp, Unknown
  Ascusbbf_304145, encodes 16S rRNA
agagtttgatcctggctcagaatgaacgctggcggcgtgcttaacacatgcaagtcgagcgtgaaagtccttcgggatgagtaaagcggcggacgggtgagtaacgcgtgagaatctgccctacagtgaagaataccttcgagaaattgaagttaatactgcatacgtccctacggggagaaaggtggctttatgctatcgctgaaggatgagcttgcgtactattagctagttggtggggtaatggcctaccaaggcattgatggttaaccggcctgagagggtgtacggtcacattggaactgagacacggtccagactcctacgggaggcagcagtgaggaatattgcacaatgggcgaaagcctgatgcagcgacgccgcgtggaggatgaaggtcttcggattgtaaacttctgttaagtgggaagaaaaaagcattcttaatacgaatgcagatgacggtaccactagagaaagcaccggctaa

SEQ ID NO: 1464 - DNA, 490 bp, Unknown
  Ascusbbf_1824635, encodes 16S rRNA
agagtttgatcatggctcaggacgaacgctggcggcgtgcctaatacatgcaagtcgagcgagggtcttcggaccctagcggcggacgggtgagtaacacgtaggcaacctgcccataagactgggataacatagggaaacttatgctaataccggatagagtcttctcccgcatgagagaagacggaaaggtggcgcaagctaccacttgtggatgggcctgcggcgcattagctagttggtggggtaacggcccaccaaggcgacgatgcgtagccgacctgagagggcgaccggccacactgggactgagacacggcccagactcctacgggaggcagcagtagggaattttccacaatggacgaaagtctgatggagcaacgccgcgtgaacgatgaaggtcttcggattgtaaagttctgttgtcagggacgaacaagtaccgttcgaacagggcggtaccttgacggtacctgacgagaaagcc

SEQ ID NO: 1465 - DNA, 490 bp, Unknown
  Ascusbbf_1158615, encodes 16S rRNA
agagtttgatcctggctcaggacgaacgctggcggcgtgcctaatacatgcaagtcgagcgaacagatgaggagcttgctcctctgacgttagcggcggatgggtgagtaacacgtgggcaacctgccctgtagttggggataactccgggaaaccggggctaataccgaataattagtttcttcgcatgatgaaactctgaaagacggcttcggctgtcactacgggatgggcccgcggcgcattagctagttggtggggtaatggcctaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgaagaaggttttcggatcgtaaagctctgttgtgagggaagaacaagtacaggagtaactgtctgtaccttgacggtacc

SEQ ID NO: 1466 - DNA, 490 bp, Unknown
  Ascusbbf_1552770, encodes 16S rRNA
agagtttgatcatggctcaggatgaacgctggcggcgtgcctaacacattcaagtcgaacgaactgtagaaatacagtgagtggcggacgggtgagtaacgcgtaagcaatctgccttcgtgtgcggaataacaaccggaaacagttgctaataccgcatgatgcaacagaatcgcatggttttattgccaaagatttatcgcacgaagatgagcttgcgtccgattagatagttggcggggcaacggcccaccaagtcaacgatcggtagccggactgagaggttgaacggccacattggaactgagagacggtccagactcctacgggaggcagcagtggggaatattgggcaatggacgaaagtctgacccagcgacgccgcgtgagggaagaaggtcttcggattgtaaaccttagtcaacagggacgaagcaagtgacggtacctgtggaggaagccacggctaactacgtgccagcagccgcgg

SEQ ID NO: 1467 - DNA, 490 bp, Unknown
  Ascusbbf_161303, encodes 16S rRNA
agagtttgatcatggctcaggacgaacgctggcggcgtgcttaacacatgcaagtcgaacgaagcagaggggcttgcccctttgacttagtggcggacgggtgagtaacgcgtgagcaacctgcctctatctgggggataacacagagaaatttgtgctaataccgcatattatctttggaaggcatcttccttagatgaaagatttatcggatagagatgggctcgcgtcccattagatagttggtgaggtaacggcccaccaagtcgacgatgggtagccgacctgagagggtgatcggccacattggaactgagaaacggtccagactcctacgggaggcagcagtgaggaatattgggcaatggaggcaactctgacccagcaacgccgcgtgaatgatgaaggtcttcggattgtaaagttctgtgatgggggacgaagaaagtgacggtaccccaagagcaagccacggctaactacgtgccag

SEQ ID NO: 1468 - DNA, 470 bp, Unknown
  Ascusbbf_94624, encodes 16S rRNA
agagtttgatcatggctcagaatgaacgctggcggcaggcctaaaacatgcaagtcgaacgctctagcaatagagagtggcgcacgggtgagtaacacgtgggaatatgccttttggtacggaacaacgtctggaaacggacgctaataccgtatggtccctccggggtaaagatttatcgccaaaagattagcccgcgtctgattagctagttggtgaggtaatggctcaccaaggcgacgatcagtagctggtctgagaggacgatcagccacactgggactgagacacggcccagactcctacgggaggcagcagttaggaatattggacaatgggcgcaagcctgatccagccatgccgcgtgagtgatgaaggccttcgggttgtaaagctctttagtccacgaatataatgactgtagtggaagaataagccccggctaacttcgtgccagcagccgcggtaat

SEQ ID NO: 1469 - DNA, 490 bp, Unknown
  Ascusbbf_247390, encodes 16S rRNA
agagtttgatcatggctcaggatgaacgctggcggcgtgcataacacattcaagtcgaacggcgaagcaccttcgggtgcggagcagtggcggacgggtgagtaacgcgtgagcaacctgccgtacagagggggataacacagggaaacttgtgctaataccgcataacgcacggacatcgcatggtgagcgtgccaaagagaaattgctgtacgatgggctcgcgtatgattagacagttggcggggtaacggcccaccaaatcaacgatcattagccgaactgagaggttgaacggccacattggaactgagaaacggtccagactcctacgggaggcagcagtggggaatattgggcaatgggcgaaagcctgacccagcgacgccgcgtgagggaagaaggtcttcggattgtaaacctctttcagcagggaagaaggaagtgacggtacctgcagaagaagtcacggctaactacgtgccagcag

SEQ ID NO: 1470 - DNA, 490 bp, Unknown
  Ascusbbf_326410, encodes 16S rRNA
agagtttgatcctggctcaggatgaacgctagcggcaggcttaacacatgcaagtcgaggggcagcgcgagagtagcaatacgcttggcggcgaccggcggaagggtgcgtaacgcgtgagcaacatgcccgtcacagggggataacagttggaaacgactcctaataccccataacacaagggatgacatcttcccttgttgaaagttacggcggtgacggattggctcgcgtgacattagctagtcggcggggtaacggcccaccgaggcgacgatgtctaggggttctgagaggaaggtcccccacactggaactgagacacggtccagactcctacgggaggcagcagtgaggaatattggtcaatgggcggaagcctgaaccagccatgccgcgtgaaggaataaggccctatgggtcgtaaacttcttttgtggtggagcaataagtgttacgtgtagcacgatgagagtacatcacgaataag

SEQ ID NO: 1471 - DNA, 490 bp, Unknown
  Ascusbbf_221468, encodes 16S rRNA
agagtttgatcatggctcaggacgaacgctggcggcgtgcttaacacatgcaagtcgagcggaaaggccctttcgggggtactcgagcggcgaacgggtgagtaacacgtgagtaatctgccctgtgctctgggatagccaccggaaacggtgattaataccggatatgacgtgctcctgcatgggagtgtgtggaaagttttttcggcatgggatgtgctcgcggcctatcagcttgttggtgaggtaatggcttaccaaggctttgacgggtaaccggcctgagagggtgaccggtcacactgggactgagacacggcccagactcctacgggaggcagcagtggggaatattggacaatgggcggaagcctgatccagcaacgccgcgtgagggatgacggccttcgggttgtaaacctctttcagtaccggcgaaggctctgctttttggtggggttgacggtaggtacagaagaaggaccggcca

SEQ ID NO: 1472 - DNA, 490 bp, Unknown
  Ascusbbf_1651205, encodes 16S rRNA
agagtttgatcctggctcaggatgaacgctggcggcgtgcttaacacatgcaagtcgaacgggaagacttttaggaagatttcggttggaataaaagtattctagtggcggacgggtgagtaacgcgtaaacaatctgccttagagagggggataacagatagaaatatttgctaataccgcataagaccacgtttaggcatctagatggggtaaaaggagaaatccactttaagatgagtttgcgtactattagttagttggtgaggtaacggcccaccaagacgaggatggttagccggcctgagagggtgaccggccacattggaactgagatacggtccagactcctacgggaggcagcagtgaggaatattgggcaatgggcgaaagcctgacccagcaacgccgcgtgaaggaagaaggttttaggattgtaaacttctgttatgggggaaaaagaaagtgatggtaccccatgagaaagctac

SEQ ID NO: 1473 - DNA, 490 bp, Unknown
  Ascusbbf_1351760, encodes 16S rRNA
agagtttgatcatggctcagaacgaacgctggcagcgtggattaggcatgcaagtcgaacgggatcgggaagatagcaatatcggcccgtgagagtggcggaagggcgaggaacacgtgagcaacctgtccaggagacggggaaaacctcgggaaactgaggctaataccggatgcggcgtcccggcacatgccgggagcgccaaagggggcgaaagctcccgctccacgaggggctcgcgcaccatcagcttgttggcggggtaacggcccaccaaggcttacggttagctggtctgaggggatggccagccgcactgggactgagatactgcccagactcctacgggaggctgcagtcgaggatcattcgcaatgggggaaaccctgacgatgcgacgctgcgtggaggatgacggccttcgggttgtaaactcctgtcatgaaggaaaaggcgaggggacccaacacgtcccttagttgatggtact

SEQ ID NO: 1474 - DNA, 367 bp, Unknown
  Ascusbbf_436647, encodes 16S rRNA
agagtttgatcatggctcaggacgaacgctggcggcgtgcttaacacatgcaagtcgaacgaggtttactgaagagcttgctctgaggtagaccgagtggcggacgggtgagtaacgcgtgaggaacctgtcttacacagggggataacgcaccgaaaggtgtgctaataccgcataagaccacactttcgcatggaagaggggtcaaaggagcgatccggtgtaaggtggactcgcgtcccattaggcagttggcggggtaacggcccaccaaaccgacgatgggtagccgacctgagagggtgatcggccacattggaactgagacacggtccaaactcctacgggagccagcagccgcggtaat

SEQ ID NO: 1475 - DNA, 490 bp, Unknown
  Ascusbbf_1749388, encodes 16S rRNA
agagtttgatcctggctcaggatgaacgctggcggcgtgcctaacacatgcaagtcgagcgagatgctgttgaacagagattcgtcaacggaatggagcggaaagcggcggacgggtgagtaacgcgtaggcaacctgccccttacacagggatagccattggaaacgatgattaaaacctgatgataccggaagatgacatcttcatccggtcaaagatttatcggtaagggatgggcctgcgtctgattagatagttggtgaggtaacggcccaccaagtcaacgatcagtagccgacctgagagggtgatcggccacattggaactgagacacggtccaaactcctacgggaggcagcagtggggaatattacacaatgggggaaaccctgatgcagcaacgccgcgtgaaggatgaaggtcttcggatcgtaaacttctgtccttgaggaagataatgacggtactcttggaggaagccccggcta

SEQ ID NO: 1476 - DNA, 490 bp, Unknown
  Ascusbbf_1891572, encodes 16S rRNA
agagtttgatcatggctcaggatgaacgctggcggcgtgcttaatacatgcaagtcgaacgaagcactttccccggactttttcggaacgaagggggttgtgacttagtggcggacgggtgggtaacgcgtggataacctgccccatgcagggggacaacagctggaaacggctgctaataccgcataagcgcacagtgaggcatctcacggtgtgaaaagatttatcggcatgagatggatccgcgtctgattagccagttggcggggtaacggcccaccaaagcgacgatcagtagccgacttgagagagtgatcggccacattgggactgagacacggcccagactcctacgggaggcagcagtagggaatattgcacaatgggggaaaccctgatgcagcgacgccgcgtgagtgatgaagtatttcggtacgtaaagctctatcagcagggaagatgatgacggtacctgactaagaagccccgg

SEQ ID NO: 1477 - DNA, 490 bp, Unknown
  Ascusbbf_418089, encodes 16S rRNA
agagtttgatcatggctcaggatgaacgctggcggcgtgcttaacacatgcaagtcgaacggacatggcaccggagcagaagagttcgcttggacgctccaccgtcatgttagtggcggacgggtgagtaacgcgtgagcaaccaaccctatgcagggggataacagttagaaatgactgctaataccgcataagcccacactgccgcatggcagagggggaaaagatttatcggcataggacgggctcgcgtccgattagttagttggtggggtaacggcctaccaagaccgcgatcggtagccggcctgagagggtgatcggccacattgggactgagacacggcccaaactcctacgggaggcagcagtggggaatattgcacaatgggggaaaccctgatgcagcaacgccgcgtgagtgaagaagtatttcggtatgtaaagctctatcaatggggaagaaaacgacggtacccatataagaagc

SEQ ID NO: 1478 - DNA, 490 bp, Unknown
  Ascusbbf_740125, encodes 16S rRNA
agagtttgatcctggctcaggacgaacgctggcggcgtgcctaacacatgcaagtcgagcggagttatttgacggaaagcttcggccggaaggcgaataacttagcggcggacgggtgagtaacgcgtgagcaacctgtcctctacagggggataagacagcgaaagttgttctaataccgcataagaccacgcagtcgcatggctgaggggtcaaaggagtaatccggtagagggtgggctcgcgtccgattagatagttggtgaggtaacggcccaccaagtcaacgatcggtagccgacctaagagggtgatcggccacattgggactgagacacggcccagactcctacgggaggcagcagtggggaatattgggcaatgggcgaaagcctgacccagcaacgccgcgtggaggaagaaggtcttcggatcgtaaactcctgtcctaaaggacgagaggaagacggtactttaggaggaagccccg

SEQ ID NO: 1479 - DNA, 490 bp, Unknown
  Ascusbbf_518109, encodes 16S rRNA
agagtttgatcctggctcaggacgaacgctggcggcgtgcctaacacatgcaagtcgaacggaactttgcgctgaacatgagattagcttgctaaaggattattcttgtaaagtttagtggcggacgggtgagtaacgcgtgaggaacctgccttacagagggggacaacagttggaaacgactgctaataccgcataacatagctgtgggacatcccatagttatcaaaggagcaatccgctgtaagatggcctcgcgtccgattagatagttggcggggtaacggcccaccaagtcgacgatcggtagccggactgagaggttgaacggccacattgggactgagacacggcccagactcctacgggaggcagcagtgggggatattgcacaatggaggaaactctgatgcagcaacgccgcgtgagggaagaaggttttcggattgtaaacctctgttttcagtgacgaaacaaatgacggtagctg

SEQ ID NO: 1480 - DNA, 490 bp, Unknown
  Ascusbbf_1882384, encodes 16S rRNA
agagtttgatcatggctcaggatgaacgctggcggcgtgcctaacacatgcaagtcgaacggttaaggccccctcgggggcgcataaagtggcgaacgggtgagtaacacgtgaccaacctgcccccgtcaccgggataacgtcgggaaaccgacgctaataccggatactcaggggcccccgcatggggggcccgggaaagcccaggcggacggggatggggtcgcggcccattaggtagacggcggggtgacggcccaccgtgccgacgatgggtagccgggttgagagaccgaccggccacattgggactgagacacggcccagactcctacgggaggcagcagtggggaattttgcgcaatgggcgaaagcctgacgcagcaacgccgcgtgcgggacggaggccttcgggtcgtaaaccgctttcagcagggaagaccacgactgtacctgcagaagaagccccggctaaatacgtgccagcagc

SEQ ID NO: 1481 - DNA, 490 bp, Unknown
  Ascusbbf_743988, encodes 16S rRNA
agagtttgatcctggctcagattgaacgctggcggcatgcttaacacatgcaagtcgaacggcagcacggtctagcttgctagatgggtggcgagtggcgaacgggtgagtaacgcgtaggaatatgccttgaagagtgggataacctggggaaactcaggctaataccgcataatctcgcgagaggaaagctggggaccttcgggcctggcgctttaagattagcctgcgtccgattagctagttggtggggtaagggcctaccaaggcgacgatcggtagctggtctgagaggatggccagccacactgggactgagacacggcccagactcctacgggaggcagcagtggggaatattggacaatggggggaaccctgatccagcaatgccgcgtgtgtgaagaaggcctatgggttgtaaagcactttcagtggggaggagtattgattggttaagagctgattaataggacgttacccacagaag

SEQ ID NO: 1482 - DNA, 490 bp, Unknown
  Ascusbbf_1840597, encodes 16S rRNA
agagtttgatcatggctcaggatgaacgctagcggcaggcctaacacatgcaagtcgaggggcagcgcgggatagcaatatcctggcggcgaccggcagaagggtgcgtaacgcgtgagcgacatgcccgtcatcgggggacaagcgctggaaacggcgtctaataccccatatgcctggggagtgcatgcttccttggtgaaagtttcgacggtgacggattggctcgcgtctgattagctagtcggcggggtaacggcccaccgaggcgacgatcagtaggggttctgagaggaaggtcccccacactggaactgagacacggtccagactcctacgggaggcagcagtgaggaatattggtcaatgggcggaagcctgaaccagccatgccgcgtgcaggaataaggccctatgggtcgtaaactgcttttgcgatggagcaataaggtccacgcgtggaccgacgagagtacatcgcgaataagca

SEQ ID NO: 1483 - DNA, 490 bp, Unknown
  Ascusbbf_917077, encodes 16S rRNA
agagtttgatcatggctcaggacgaacgctggcggcatgcctaatacatgcaagtcgagcgaacgattagaagcttgcttctaatcgttagcggcggacgggtgagtaacacgtgggcaacctaccttacagatggggataactccgggaaaccggggctaataccgaataatccattctctcgcatgagtgaatgttgaaagacggcttttagctgtcactgttagatgggcccgcggcgcattagctagttggtggggtaatggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgtctgtaccttgacggtacct

SEQ ID NO: 1484 - DNA, 490 bp, Unknown
  Ascusbbf_1889275, encodes 16S rRNA
agagtttgatcctggctcaggatgaacgctggcggcgtgcttaacacatgcaagtcgaacgattaaaccacttcggtggatatagagtggcgaacgggtgagtaacacgtgggcaacctgcccctcacaccgggacaactattggaaacgatagctaataccggatactccgatcgcgtggcatcacgctttcgggaaagcccagacggtgagggatgggcccgcggtccattagctcgttggtggggtaacggcccaccaagacgacgatggatagccgggttgagagaccgaccggccacattgggactgagacacggcccagactcctacgggaggcagcagtggggaattttgcgcaatggggggaaccctgacgcagcaacgccgcgtgcgggatgaaggccttcgggttgtaaaccgctttcagcagggaagaagatgacggtacctgcggaagaagctccggctaactacgtgccagcagccg

SEQ ID NO: 1485 - DNA, 490 bp, Unknown
  Ascusbbf_1721767, encodes 16S rRNA
agagtttgatcatggctcaggatgaacgctggcggcgtgcctaacacatgcaggtcgaacggggcataggccttcgggtttatgcttagtggcggacgggtgagtaacgcgtgagcaacctgcccttcagtgggggacaacagctggaaacggctgctaataccgcatgacgtaccgggggggcatccctctggtaccaaagatttattgctgaaggatgggctcgcgtctgattagatagttggcggggtaacggcccaccaagtcgacgatcagtagccggactgagaggttgaacggccacattgggactgagatacggcccagactcctatgggaggcagcagtgggggatattgggcaatgggcgaaagcctgacccagcaacgccgcgtgaaggaagaaggccttcgggttgtaaacttcttttaagagggacgaaggacgtgacggtacctcatgaataagccacggctaactacgtgccagc

SEQ ID NO: 1486 - DNA, 490 bp, Unknown
  Ascusbbf_65881, encodes 16S rRNA
agagtttgatcctggctcaggatgaacgctagcggcaggcttaacacatgcaagtcgaggggcagcgcgaggtagcaatactttggcggcgaccggcgcaagggtgcgtaacgcgtgagcaatctgcccgtatcagggggataagcgatggaaacgtcgtctaataccgcataacagacgaggaggcatctccttgttttgaaagcttcggtggatacggatgagctcgcgagacattagttagttggcggggtaacggcccaccaagaccgcgatgtctaggggaactgagaggttggtcccccacactggaactgagacacggtccagactcctacgggaggcagcagtgaggaatattggacaatggccggaaggctgatccagccatgccgcgtgcaggaataaggtcctatggattgtaaactgcttttgagagggagcaataagtgctacgtgtagcacgatgagagtacctttcgaataagca

SEQ ID NO: 1487 - DNA, 490 bp, Unknown
  Ascusbbf_109662, encodes 16S rRNA
agagtttgatcctggctcaggacgaacgctggcggcgtgcctaacacatgcaagtcgaacggagcaccctggaagataacttcggtttgattctaggaatgcttagtggcggacgggtgagtaacgcgtgagtaacctgccttggagagggggataacacagagaaatttgtgctaataccgcatattgtagcgaattcgcatgtttttgctatgaaagatttatcgctccaagatggactcgcgtccgattagctagtaggcggggtaatggcccacctaggcgacgatcggtagccggactgagaggttgaacggccacattgggactgagatacggcccagactcctacgggaggcagcagtggggaatattggtcaatgggggcaaccctgaaccagcaacgccgcgtgaaggaagaaggtcttcggatcgtaaacttttgtcgtataggacgaagaaagtgacggtactatacaagaaagccacg

SEQ ID NO: 1488 - DNA, 490 bp, Unknown
  Ascusbbf_41720, encodes 16S rRNA
agagtttgatcatggctcaggacgaacgctggcggcgtgcgtaacacatgcaagttgagcgacgacgttctgaagtggcaacacggagggacgagcggagcagcggacgggtgagtacaacatgagaagctgtcctgtggcgggggacaacgtctggaaacggacgctaataccgcataagccgagaggtaaaagcagagatgtgccacgggaggtgctcgtgtcctatcagctagttggtgaggtaacggctcaccaaggcgatgacgggtagccggcctgagagggtgtacggccacactgggactgagatacggcccagactcctacgggaggcagcagtggggaatattgggcaatgggaggaatcctgacccagcgacgccgcgtgaacgaagaaggccttcgggtcgtaaagttcttttatgcgggaagaaggaagtgacggtaccgcatgaataagccccggctaactacgtgccagcagccg

SEQ ID NO: 1489 - DNA, 490 bp, Unknown
  Ascusbbf_26150, encodes 16S rRNA
agagtttgatcctggctcaggacgaacgctggcggcgtgcctaacacatgcaagtcgagcgagaattcttgatttgattctttcgggatgacgattaagaaggaaagcggcggacgggtgagtaacgcgtgagtaacctgccccatagaacggaatagcctagtgaaaactggaataatgccgtatgaagcagcagcaccgcatgatgcagctgttaaagatttatcgctatgggatggactcgcgtctgattagatagttggcggggtaacggcccaccaagtcgacgatcagtagccgaactgagaggttgatcggccacattgggactgagacacggcccagactcctacgggaggcagcagtgggggatattgcacaatgggggaaaccctgatgcagcaacgccgcgtgaaggaagaaggtcttcggattgtaaacttttgtctttagggaagaaacaaatgacggtacctaaggaggaagccac

SEQ ID NO: 1490 - DNA, 490 bp, Unknown
  Ascusbbf_397572, encodes 16S rRNA
agagtttgatcctggctcaggatgaacgctggcggcgtgcataacacattcaagtcgaacgaagcgcagagacggaaggccttcgggccggaagattctgtgacttagtggcggacgggtgagtaacgcgtgagcaacctgcctgtgatagagggataacacatggaaacgtgtgctaataccacatgaggcgcagatatcgcatggtgactgcgttaaagatttatcgattgcagatgggctcgcgtatgattaggcagttggtgaggcaacggctcaccaaaccgacgatcattagccgaactgagaggttgaacggccacattggaactgagaaacggtccagactcctacgggaggcagcagtggggaatattgggcaatgggcgaaagcctgacccagcgacgccgcgtgagggaagaaggtcttcggattgtaaacctctttcagtagggaagaagaaagtgacggtacctacagaagaagtca

SEQ ID NO: 1491 - DNA, 490 bp, Unknown
  Ascusbbf_114778, encodes 16S rRNA
agagtttgatcatggctcagattgaacgctagcgggatgctttacacatgcaagtcgaacggcagcgcggacttcggtctggcggcgagtggcgaacgggtgagtaatgtatcggaacgtacccagtagcgggggataactactcgaaagagtggctaataccgcatacgccctacgggggaaagggggggatcgcaagacctctcactattggagcggccgatatcggattagctagttggtggggtaacggcctaccaaggcaacgatccgtagctggtttgagaggacgaccagccacactgggactgagacacggcccagactcctacgggaggcagcagtggggaattttggacaatgggggcaaccctgatccagccatcccgcgtgtgcgacgaaggccttcgggttgtaaagcacttttggcaggaaagaaatcgcccgggctaacactccgggtggatgacggtacctgcagaataagcac

SEQ ID NO: 1492 - DNA, 490 bp, Unknown
  Ascusbbf_473279, encodes 16S rRNA
agagtttgatcctggctcagattgaacgctggcggcatgctttacacatgcaagtcgtacggcagcgcgggcttcggcctggcggcgagtggcggacgggtgagtaagacatcggaacgtgccacggggtgggggacaaccagccgaaaggttggctgataccgcatggcatccacggattaaagccggggacccttcggggcctggcgccctgtgagcggccgatggctgattagcttgttggtggggtaatggcctaccaaggcgacgatcagtagctggtctgagaggacggccagccacattgggactgagacacggcccaaactcctacgggaggcagcagtggggaattttggacaatggggggaaccctgatccagcaatgccgcgtgagtgaagaaggccttcgggttgtaaagctcttttgccagggaagaaaaggcggaggttaagagcttccgctgctgacggtacctggagaataagc

SEQ ID NO: 1493 - DNA, 474 bp, Unknown
  Ascusbbf_196354, encodes 16S rRNA
agagtttgatcatggctcaggatgaacgctggcggcatgcttaacacatgcaagtcggacgggaagtggtgtttccagtggcggacgggtgagtaacgcgtaagaacctgcccttgggaggggaacaacagctggaaacggctgctaataccccgtaggctgaggagcaaaaggaggaatccgcccgaggaggggctcgcgtctgattagctagttggtgaggcaatagcttaccaaggcgatgatcagtagctggtccgagaggatgatcagccacactgggactgagacacggcccagactcctacgggaggcagcagtggggaattttccgcaatgggcgaaagcctgacggagcaatgccgcgtggaggaagaaggcccacgggttgtaaacttcttttcccggagaagaagcaatgacggtatctggggaataagcatcggctaactctgtgccagcagccgcggtaat

SEQ ID NO: 1494 - DNA, 490 bp, Unknown
  Ascusbbf_243112, encodes 16S rRNA
agagtttgatcatggctcaggacgaacgctggcggcgtgcttaacacatgcaagtcgaacgctgaagcccgagcttgctcgggtggatgagtggcgaacgggtgagtaacacgtgagtaacctgcccatgtctctgggataagcgctggaaacggcgtctaatactggatacgagcatccactgcatggtgaggtgttggaaagatttatcggacatggatggactcgcggcctatcagcttgatggtgaggtaatggctcaccatggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttgtcagggaagaagccttcgggtgacggtacctggagaaaaagcaccggctaactacgt

SEQ ID NO: 1495 - DNA, 484 bp, Unknown
  Ascusbbf_54785, encodes 16S rRNA
agagtttgatcatggctcaggataaacgctggcggcgtgcttcaggcatgcaagtcgaacggaccttcgggtcagtggcggacgggtgagtaacacgtgagcaacctgcccagaagtggggaataacttgccgaaaggtgagctaataccgcatatggtgactcctccttggagggttcactaaaggcttcggccgcttttggaggggcttgcgctcgattagctagttggtggggtaaaggcctaccaaggcaacgatcgatagctggtctgagaggacggtcagccacacggggactgagatacggccccgactcctacgggaggcagcagctaggaatcttgggaatgggcgaaagcctgacccagcaacgccgcgtgggcgatgaaggccttagggtcgtaaagcccttttgtgagggacgatgatgacggtacctcacgaataagccacggctaactacgtgccagcagccgcggtaat

SEQ ID NO: 1496 - DNA, 490 bp, Unknown
  Ascusbbf_1367198, encodes 16S rRNA
agagtttgatcatggctcaggatgaacgctggcggcgtgcctaacacatgcaagtcgaacggagtcattttggaaagtccttcgggactggaattcttgacttagtggcggacgggtgagtaacgcgtgagcaatctgcccttaggtgggggataacagccggaaacggctgctaataccgcataatgcatcgagatcgcatggttttgacgccaaagatttattgcctttggatgagctcgcgtctgattagctagttggtgaggtaacggcccaccagggcgacgatcagtagccggactgagaggttgaacggccacattgggactgagacacggcccagactcctacgggaggcagcagtggggaatattgcgcaatgggggcaaccctgacgcagcaacgccgcgtgattgaagaaggccttcgggttgtaaagatctttaatcagggacgaattttgacggtacctgaagaataagctccggct

SEQ ID NO: 1497 - DNA, 490 bp, Unknown
  Ascusbbf_241992, encodes 16S rRNA
agagtttgatcatggctcaggacgaacgctggcggcgtgcttaacacatgcaagtcgaacgaggtccatggagcttgctccagaagacctagtggcgaacgggtgcgtaacacgtgagaaacctatcccggacttgggaataacagttggaaacggctgctaataccgaatacctccgcagcgtcgcatggcgcagcgaagaaagcgtatgcggtttgggagggtctcgcggcctatcagctagttggtgaggtaacggctcaccaaggcatcgacgggtagctggtctgagaggatgatcagccacactgggactgagacacggcccagactcctacgggaggcagcagtggggaatattgcacaatgggcgcaagcctgatgcagcaacgccgcgtgcgggaagaaggccctagggttgtaaaccgctttcagcagggaagaaaatgacggtacctgcagaagaaggtgcggccaactacgtgccagc

SEQ ID NO: 1498 - DNA, 490 bp, Unknown
  Ascusbbf_198371, encodes 16S rRNA
agagtttgatcatggctcagggtgaacgctggcggcgtgcctaagacatgcaagtcgagcggggcaggtttatacctgttcagcggcggacgggtgagtaacgcgtgggtgacctacccggaagaggcggacaacctggggaaacccaggctaatccgccatgtggtcctgtcctgtggggcaggactaaagggtggatagcccgcttccggatgggcccgcgtcccatcagctagttggtggggtaaaggcccaccaaggcgacgacgggtagccggtctgagaggatggccggccacaggggcactgagacacgggccccactcctacgggaggcagcagttaggaatcttccgcaatggacggaagtctgacggagcgacgccgcttggaggaggaagcccttcggggtgtaaactcctgaactggggacgaaagccctgtgtagggggatgacggtacccaggtaatagcgccggccaactccgtg

SEQ ID NO: 1499 - DNA, 490 bp, Unknown
  Ascusbbf_742074, encodes 16S rRNA
agagtttgatcctggctcaggacgaacgctggcggcgtgcttaacacatgcaagtcgagcggggattatccgacagaagtccttcgggatggaagatgggtaattctagcggcggacgggtgagtaacgcgtgaacaatctgtcccagacagggggataacacttggaaacaggtgctaataccgcataagaccacgaagtcgcatggctttgaggtaaaaggagtgatccggtttggggtgagttcgcgtccgattagctagttggcggagtaacggcccaccaaggcgacgatcggtagccgacctgagagggtgatcggccacattggaactgagacacggtccaaactcctacgggaggcagcagtgggaatattgggcaatgggcgaaagcctgacccagcaacgccgcgtgagggaagaaggttttcggattgtaaacctctgtcctcagggacgaaggaagtgacggtacctgaggaggaagc

SEQ ID NO: 1500 - DNA, 490 bp, Unknown
  Ascusbbf_384817, encodes 16S rRNA
agagtttgatcctggctcaggacgaacgctggcggcgtgcctaaaacatgcaagtcgaacgaggtccacccagtggcaacactggtgaagacctagtggcgaacgggtgagtaacacgtgaggaacctgccccgaagaccggaataaccctccgaaaggagagctaataccggataccccctggagatcgcatggtcaccagaggaaatgcattgtgcttcgggagggcctcgcggcctatcagcttgttggtgaggtaacggctcaccaaggcatcgacgggtagctggtctgagaggacgaccagccacactgggactgagacacggcccagactcctacgggaggcagcagttaggaatcttgcgcaatgggcgaaagcctgacgcagcaacgccgcgtgggggatgaaggccttcgggttgtaaacccctttcagtagggacgaattcagacggtacctacagaagaagcaccggccaactacgtg

SEQ ID NO: 1501 - DNA, 490 bp, Unknown
  Ascusbbf_447944, encodes 16S rRNA
agagtttgatcctggctcaggacgaacgctggcggcgtgcctaatacatgcaagtcgaacgcttcctaccggtgcttgcaccgggaaagaagagtggcggacgggtgagtaacacgtgggtaacctacctacaagcgggggataacattcggaaacggatgctaataccgcatagatctttttgtctcctggcagaaagaagaaagacggtttcggctgtcacttgtagatggacccgcggcgcattagttagttggtgaggtaatggctcaccaagacgatgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagagaagaacaaggatgagagtaactgctcgtcccttgacggtat

SEQ ID NO: 1502 - DNA, 471 bp, Unknown
  Ascusbbf_1343606, encodes 16S rRNA
agagtttgatcctggctcagaacgaacgctggcggcaggcttaacacatgcaagtcgagcgccccgcaaggggagcggcagacgggtgagtaacgcgtgggaatctacccatctctacggaataactcagggaaacttgtgctaataccgtatacgcccttcgggtgaaagatttatcggagatggatgagcccgcgttggattagatagtgtttgaggtaacgccccaccaagtcaacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcaaggaagaaaaaaatgacggtacgtgactaagaagccccggctaactacgtgccagcagccgcggtaat

SEQ ID NO: 1503 - DNA, 470 bp, Unknown
  Ascusbbf_1680420, encodes 16S rRNA
agagtttgatcctggctcagagcgaacattggcggtaggcttaacacatgcaagtcgagcgaggcgtaatagtcgagcggcgaacgggtgagtaatacatggaaatctaccctgaagtgggggataacgtccagaaatggacgctaataccgcataatccatattgggaaagcgttgcagcgctttaggatgagtccatggccgattagcttgttgttgaggtaatggctcaccaaggcgacgatcagtagctggtctgagaggatgaccagccacactggaactgagacacggtccagactcctacgggaggcagcagtggggaatcttgcgcaatgggggcaaccctgacgcagccataccgcgtgagtgatgaaggtcttcggattgtaaagctctttcggcggggacgacgatgacggtacccgcaaaagaagtcacggctaacttcgtgccagcagccgcggtaa

SEQ ID NO: 1504 - DNA, 490 bp, Unknown
  Ascusbbf_11853, encodes 16S rRNA
agagtttgatcctggctcaggataaacgctggcggcgcacataagacatgcaagtcgaacggaagtcgttaaaaatgaattgacgatttatctgattgaagtttttaacaatggctttagtggcggactggtgagtaacacgtaaggaacctgcctatcagaggggaataacagtgagaaatcattgctaataccgcataagctagtagaatcgcatgattcagctagaaaaggagcaatccgctgatagatggccttgcgcctgattagctagttggtggggtaacggcctaccaaggcgacgatcagtagccggactgagaggttgaacggccacattgggactgagatacggcccagactcctacgggaggcagcagtcgggaatattgcgcaatggaggaaactctgacgcagtgacgccgcgtataggaagaaggttttcggattgtaaactattgtcgtgagggaagaaattgacagtacctca

SEQ ID NO: 1505 - DNA, 490 bp, Unknown
  Ascusbbf_22208, encodes 16S rRNA
agagtttgatcatggctcagaatgaacgctggcggcatggattaggcatgcaagtcgaacgggatccctcgggatctagtggcgaaagggtgagtaacacgtgagcaacctgcccccaaggctggaataagcactggaaacggtgtctaaaaccggatgaggcctctgtccacatggacagtcagccaaatatttataccctggggatgggctcgcggcccattagctagttggcggggtaacggcccaccaaggctgcgacgggtaggtggtctgagaggatggtcacccacactgggactgagacactgcccagactcctacgggaggctgcagtcgagaatcttccgcaatgggcgcaagcctgacggagcgatgccgcgtgagggacgaaggccttcgggtcgtaaacctctgtcaccgggaacgaaatcaatgacggtacccggaaaggaagccacggctaaccacgtgccagcagccgcggtaa

SEQ ID NO: 1506 - DNA, 486 bp, Unknown
  Ascusbbf_13196, encodes 16S rRNA
agagtttgatcctggctcagaacgaacgctggcggcacgcttaacacatgcaagtcggacgggatgaagttagtttactaatggaatttagtggcggactggtgagtataatacaggaatatgcccttaggaatgggatagctttgggaaactggaggtaataccatataaggtcgagagaggaaagcagagatgcgcctgaggattagcctgtatctgattaggaagttggcggggtaaaggcccaccaatccagtgatcagtagctgttctgagaggaagatcagccacattgggactgagatacggcccagactcctacgggaggcagcagtggggaatattggacaatggggggaaccctgatccagcgatgccgcgtgaatgaagaaggttttcggattgtaaagttcttttcttagggaagatgatgacggtacctgaggaataagcaccggcaaactctgtgccagcagccgcggtaat

SEQ ID NO: 1507 - DNA, 490 bp, Unknown
  Ascusbbf_204441, encodes 16S rRNA
agagtttgatcatggctcaggatgaacgctggcggcgtgcttaacacatgcaagtcgagcgagaactcgctcagccgattcttcggaagaaagcagagcgacggaaagcggcggacgggtgagtaacgcgtgggaaacctgccctgtgcagggggacagccgagggaaacttcgattaataccccataacaccaaagcatcgcatggtgcaatggtcaaagatttatcggcacaggatggtcccgcgtctgattagctggttggtgaggtagcggctcaccaaggcgacgatcagtagccggcctgagagggtgaacggccacattggaactgagacacggtccagactcctacgggaggcagcagtggggaatattgcacaatgggggaaaccctgatgcagcaacgccgcgtgaaggaagaaggccttcgggtcgtaaacttctgtccttggggaagaagaatgacggtacccttggaggaagccccg

SEQ ID NO: 1508 - DNA, 489 bp, Unknown
  Ascusbbf_14290, encodes 16S rRNA
agagtttgatcctggctcaggattaacgctggcggcgtgcctaacacatgcaagtcgaacggacgtcttcggacgtcagtggcgaacgggtgagtaacgcgtaggtaatgtgcctctgcgctgcgaataacagcctgaaaaggctgctaatacggaatggtcctctcggggggcatcccccttgaggtaaagatttatcgcgcggagatcagcctgcgtcctattagttagttggcggggtaacggcccaccaagacgacgatgggtaactggtctgagaggatgaacagtcacactggaactgagaacggtccagactcctacgggaggcagcagtgaggaattttgcgcaatggagggaactctgacgcagcaacgccgcgtgagtgatgacggccttcgggttgtaaagctctgtcgagagggacgagtagggacggtacctctcaagaaagccccggctaactatgtgccagcagccgcggtaat

SEQ ID NO: 1509 - DNA, 490 bp, Unknown
  Ascusbbf_290865, encodes 16S rRNA
agagtttgatcatggctcaggataaacgctggcggcgtgcttaacacatgcaagtcgaacggggtgattctcccgaggattgacggtgcttgcacctgattgactcatttgaatcacttagtggcggacgggtgagtaacgcgtgggaaacctgccctatactgggggatagcagttggaaacgactgataataccgcataagcgcacagcaccgcatggtgcagtgtgaaaaactccggtggtataggatggtcccgcgtctgattagctagttggtgaggtaacggcccaccaaggcgacgatcagtagccggcctgagagggtgtacggccacattgggactgagacacggcccaaactcctacgggaggcagcagtggggaatattggacaatgggggcaaccctgatccagcgacgccgcgtgaacgaagaagtatctcggtatgtaaagttctatcagcagggaagataatgacggtacctgac

SEQ ID NO: 1510 - DNA, 490 bp, Unknown
  Ascusbbf_164313, encodes 16S rRNA
agagtttgatcctggctcaggatgaacgctagcggcaggcctaacacatgcaagtcgaggggcagcgggaggtagcaataccttgccggcgaccggcgcacgggtgcgtaacgcgtatgcaacctgcccgcatccggggtatagcccgccgaaaggcggattaatcccccgtggtcatctggggccgcatggttctggatggatagcttcggcggatgcggatgggcatgcgtcccattaggaagacggcggggtaacggcccaccgttcctacgatgggtagggggcctgagagggtagccccccacactggtactgagacacggaccagactcctacgggaggcagcagtgaggaatattggtcaatgggcggaagcctgaaccagccatgccgcgtgcgggaagaaggccctacgggtcgtaaaccgcttttgcccgggaagaataaggaccctgcggggttcgatgccggtaccgggcgaataagg

SEQ ID NO: 1511 - DNA, 490 bp, Unknown
  Ascusbbf_8626, encodes 16S rRNA
agagtttgatcatggctcaggatgaacgctggcggcgtgcctaacacatgcaagtcgagcgagaaactcatgaccaatacttcggttgcgtgattgagcggaaagcggcggacgggtgagtaacgcgtaggcaacctgccccttgcagagggatagcctcgggaaaccgggattaaaacctcataatgccgagagtcgacatcttctttcggccaaagatttatcggcaagggatgggcctgcgtctgattagctggttggtggggtaacggcctaccaaggcaacgatcagtagccgacctgagagggtgatcggccacattggaactgagacacggtccaaactcctacgggaggcagcagtggggaatattgcacaatgggcgaaagcctgatgcagcaacgccgcgtgaaggatgaaggcccttgggtcgtaaacttctgttctaagggaagataatgacggtaccttaggagcaagtcccggcta

SEQ ID NO: 1512 - DNA, 490 bp, Unknown
  Ascusbbf_58227, encodes 16S rRNA
agagtttgatcatggctcaggatgaacgctggcggcgtgcttaacacatgcaagtcgaacgaagctccatttaagatttcttcggaatgattttatggatgacttagtggcggacgggtgagtaacgcgtgaggaacctgccttgcagtggggaataacagttggaaacgactgctaataccgcataacacggagagatcgcatgttttctccgtcaaagatttatcgctgtgagatggcctcgcgtctgattagctggttggtgaggtaacggctcaccaaggcgacgatcagtagccggactgagaggttgatcggccacattgggactgagacacggcccagactcctacgggaggcagcagtggggaatattgggcaatgggcgcaagcctgacccagcaacgccgcgtgaaggaagaaggctttcgggttgtaaacttcttttaagtgggacgataatgacggtaccacttgaataagctccggc

SEQ ID NO: 1513 - DNA, 490 bp, Unknown
  Ascusbbf_494063, encodes 16S rRNA
agagtttgatcatggctcagattgaacgctggcggcaggcctaacacatgcaagtcgaacggtaacaggaagcagcttgctgcttcgctgacgagtggcggacgggtgagtaatgtctgggaaactgcccggtggagggggataactactggaaacggtagctaataccgcataacgtcgcaagaccaaagagggggaccttcgggcctcttgccaccggatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggattgtggttaataaccgcagtcattgacgttacccgcagaag

SEQ ID NO: 1514 - DNA, 490 bp, Unknown
  Ascusbbf_119781, encodes 16S rRNA
agagtttgatcctggctcaggacgaacgctggcggcgtgcttaacacatgcaagtcgaacgggggtaagagagaagcttgcttttttcttacccgagtggcgaacgggtgagtaacgcgtgaggaacctgtcttatacagggggataacgcatcgaaagatgtgctaataccgcataggaccacactgccgcatggcagaggggtgaaaggagcgatccggtgtaaggtggactcgcgtctgattagatagttggtgaggtaacggctcaccaagtcaacgatcagtagccgacctgagagggtgatcggccacattgggactgagacacggcccagactcctacgggaggcagcagtggggaatattgggcaatgggcgcaagcctgacccagcaacgccgcgtgaaggaagaaggttttcggattgtaaacttctgtccttggtgaagaggagaagacggtagccaaggaggaagccccggctaacta

SEQ ID NO: 1515 - DNA, 490 bp, Unknown
  Ascusbbf_35741, encodes 16S rRNA
agagtttgatcatggctcaggatgaacgctggcggcgtgcctaacacatgcaagtcgagcgagaaacctgcaaatgaagtttcgacagattttacaggcggaaagcggcggacgggtgagtaacgcgtaggcaacctgccccttgcacagggatagcctcgggaaaccgggattaaaacctgataacaccgcactttcacatgtaagagcggtcaaagatttatcggcaagggatgggcctgcgtctgattagttagttggtggggtaacggctcaccaaggcaatgatcagtagccgacctgagagggtgatcggccacattggaactgagacacggtccaaactcctacgggaggcagcagtggggaatattgcacaatgggcgaaagcctgatgcagcaacgccgcgtgagcgaagaaggcggaatcgtcgtaaagctctgtccttggggaagaagaactgacggtacccttggaggaagccccggc

SEQ ID NO: 1516 - DNA, 490 bp, Unknown
  Ascusbbf_312893, encodes 16S rRNA
agagtttgatcctggctcaggacgaacgctggcggcgtgcctaatacatgcaagtcgagcggacttgatggagagcttgctctcctgatggttagcggcggacgggtgagtaacacgtaggcaacctgcctgcaagaccgggataacccacggaaacgtgagctaataccggatatctcatttcctctcctgagggaatgatgaaagacggagcaatctgtcacttgcggatgggcctgcggcgcattagctagttggtgaggtaacggctcaccaaggcgacgatgcgtagccgacctgggagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccgatagagtaactgctatcggagtgacggta

SEQ ID NO: 1517 - DNA, 490 bp, Unknown
  Ascusbbf_117616, encodes 16S rRNA
agagtttgatcctggctcaggatgaacgctggcggcgtgcctaatacatgcaagtcgaacgagaatagcttgctattcgagtggcgaacgggtgagtaacacgttggtaatctgccctttagttggggatacccggacgaaagtctggctaataccgtaatatgatatgaggtgggattccttatattgaaaggtccgtttggatcgctaatggatgagcctgcgtctgattagctagttggtgagataatagcccaccaaggcgaggatcagtagccgaactgagaggttgatcggccacaatggaactgagacacggtccatactcctacgggaggcagcagtagggagttttcgtcaatgggcgcaagcctgaacgagcaacgccgcgtgagtgatgaaggtcttcggattgtaaagctcttttatattggaaaaatggctagaagaggaaatgcttttagtttgatggtactttatgaataagcaa

SEQ ID NO: 1518 - DNA, 490 bp, Unknown
  Ascusbbf_56610, encodes 16S rRNA
agagtttgatcctggctcaggattaacgctagcggtatgcctaatacatgcaagtcgagcgggagcagcaatgctctagcggcaaacgggtgagtaatacgtatctaatctgccctttagaaaggaacaacagatcgaaagatttgctaataccttataggacattaactcgcatgagataatgtttaaagttccgttcggaacgctttaggatgagggtgcggcttatcagatagttggtgaggtaatggcccaccaagtctatgacgagtagctatgctgagaggtagaatagccacaaggggactgagacacggcccctactcctacgggaggcagcagtagggaatttttcacaatgggcgaaagcctgatggagcaataccgcgtgaatgatgaaggtcttcggattgtaaaattcttttataagggacgaacgatatgaacaggaaatggttcgtaagtgactgtaccttttgaataagtaacg

SEQ ID NO: 1519 - DNA, 490 bp, Unknown
  Ascusbbf_427579, encodes 16S rRNA
agagtttgatcctggctcaggacgaacgctggcggcgtgcttaacacatgcaagtcgaacgaagcatagagactgaagttttcggatggaagaatctatgacttagtggcggacgggtgagtaacgcgtgagcaacctgcctgtaagagggggacaacagctggaaacggctgctaataccgcataagaccacaccaccgcatggtggaggggtaaaagagatatcgcttacagatgggctcgcgtcctattaggtagttggtgaggtaaaggctcaccaagccgacgataggtagccgacctgagagggtgatcggccacactggaactgagacacggtccagactcctacgggaggcagcagtggggaatattgggcaatgggggcaaccctgacccagcaacgccgcgtgagggatgaaggccttcgggttgtaaacctctgtccttggggacgaagaagatgacggtacccagggaggaagctccg

SEQ ID NO: 1520 - DNA, 490 bp, Unknown
  Ascusbbf_231857, encodes 16S rRNA
agagtttgatcctggctcaggatgaacgctggcagtgtgccttagacatgcaagtcggacgggggttttcttgttgatcctttcggggtgatgcttgattactctagtggcgtacgggtgagtaacacgtgggtgacctgccctcaagtgggggataactctgggaaactggggctaatcccgcatgtgctggcttttgtcagtaaaggctcttcggagttgcttggggatgggcccgcggcctatcagcttgttggtgtggtaatggcgcaccaaggcgatgacaggtagccggcctgagagggtgtacggccacaggggcactgagatacgggccccactcctacgggaggcagcagttaggaattttcgacaatgggggaaaccctgatcgagcgacactgcgtgagggatgaaggtcttaggatcgtaaacttctaatagagggacgatagtgacggtacctcttgattagcaccggctaactccg

SEQ ID NO: 1521 - DNA, 490 bp, Unknown
  Ascusbbf_13407, encodes 16S rRNA
agagtttgatcatggctcagaacgaacgctggcggcgtggattaggcatgcaagtcgtacgcgaaagcagacttcggtttgtgagtagagtggcgaactggtgagtacaaggtgactaacctgcccttaagtgggggataacttcgtgaaaacggagctaataccgcatggtctcttagccttacggggttacgagtaaagcagtaatgcgcttaaggatggggtcacctcccattagcttgttggtgaggtaacggctcaccaaggctgcgatgggtagctggactgagaggttggccagccacactgggactgagatacggcccagactcctacggggggcagcagtctagaggcttcgacaatgaccgaaaggttgatcgagcgacgccgcgtgcgggatgaaggtcttcggattgtaaaccgcttttgtttgtgaagaaggcctgtatcgtgaatatgggattgacggtagcaaacgaataagccc

SEQ ID NO: 1522 - DNA, 490 bp, Unknown
  Ascusbbf_89719, encodes 16S rRNA
agagtttgatcatggctcagaacgaacgctggcggcgcgtcttaagcatgcaagtcgaatggcaagatcggtgcttgcactgatcctagaatggcggactggtgagtaacgcgtgggtgacgtaccttttggatggggatagctcctggaaacaggagataataccgaatacgctgcatgggaacagaggccatgcaggaaaggatcttttgattcgccgaaagagcggcccgcgggctattagcttgttggcggggtaacggcccaccaaggcgatgatagctacccggcctaagagggtgatcgggcacattgggactgagatacggcccagactcctacgggaggcagcagctaagaatattccgcaatggaggaaactctgacggagcgacgccgcgtggacgaggaaggccggaaggttgtaaagtccttttaagcatgaagaataaggaagatgagagaaacgttttctggtgacggtagtgct

SEQ ID NO: 1523 - DNA, 490 bp, Unknown
  Ascusbbf_79432, encodes 16S rRNA
agagtttgatcctggctcagaacgaacgctggcggcgcgtcttaagcatgcaagtcgaacggcaagctaccttcgggtagcctagagtggcggactggtgagtaacacgtgggtgacatgccttcaggactggaatagcctgcagaaatgcagggtaatgccggatacggtgcaggacgttaggggtcctgcaagaaaggagcatttgctccgccgggagattggcccgcggcccattagctagttggtgaggtaaaggcccaccaaggcaatgatgggtatccggcctgagagggtgatcggacacattgggactgagatacggcccagactcctacgggaggcagcagctaagaatattccgcaatggaggaaactctgacggagcgacgccgcgtggatgattgaaggccgaaaggttgtaaaatccttttgaaccggaagaataagcgcaggagggaatgcctgcgtggtgacggtacggttcgaa

SEQ ID NO: 1524 - DNA, 490 bp, Unknown
  Ascusbbf_737130, encodes 16S rRNA
agagtttgatcatggctcaggatgaacgctggcggcgtgcataacacattcaagtcgaacgaagcgccgggacggaacccttcggggggaagacccgatgacttagtggcggacgggtgagtaacgcgtgagcaacctgcctgcgatagagggataacaccgggaaaccggtgctaataccacatgacgcagcggggtcacatggccctgttgttaaagatttatcgatcgcagatgggctcgcgtatgattaggcagttggtggggcaacggcccaccaaaccgacgatcattagccgaactgagaggttgaacggccacattggaactgagaaacggtccagactcctacgggaggcagcagtggggaatattgggcaatgggcgaaagcctgacccagcgacgccgcgtgagggaagaaggtcttcggattgtaaacctctttcagcagggaagaagaaagtgacggtacctgcagaagaagtcacg

SEQ ID NO: 1525 - DNA, 490 bp, Unknown
  Ascusbbf_333422, encodes 16S rRNA
agagtttgatcctggctcaggatgaacgctggcggcgtgcctaatacatgcaagtcgagcgagatactttcaaatgagacttcggtggattttggaagttgaaagcggcggacgggtgagtaacgcgtaggcaacctgccctttgcacagggatagccattggaaacgatgattaatacctgataacgcgggagcgatgcatatcgcttccgtcaaagattcatcggcaagggatgggcctgcgtctgattagctggttggtgaggtaacggcccaccaaggcgacgatcagtagccgacctgagagggtgatcggccacattggaactgagacacggtccaaactcctacgggaggcagcagtagggaattttgcacaatgggcgcaagcctgatgcagcaacgccgcgtgaaggatgaaggccttcgggttgtaaacttcttttctcggggaagaaacaaatgacggtacctgaggaataagccccgg

SEQ ID NO: 1526 - DNA, 490 bp, Unknown
  Ascusbbf_1850418, encodes 16S rRNA
agagtttgatcatggctcaggatgaacgctggcggcatgcctaagacatgcaagtcgaacgaagtggcccattgatttgacggaagttggagtgcttgcacaaagacggaagactttgatttggattttccacttagtggcgcaagggtgagtaacacgtaggttatctgccttcgagtctggaataacagttagaaatgattgctaatgccggattatatataaagcgatacgttactttatattaaaaggagcctttaaagcttcgcttgaagatgagcctgcggcgtattagctagttggtgaggtaatggcccaccaaggcaacgatgcgtagccgacctgagagggtgatcggccacactgggactgagacacggcccagactcctacgggagacagcagttaggaatattcgtcaatgggggaaaccctgaacgagcaatgccgcgtgaaggatgaaggtcctatggattgtaaacttctgttg

SEQ ID NO: 1527 - DNA, 490 bp, Unknown
  Ascusbbf_16828, encodes 16S rRNA
agagtttgatcatggctcaggacgaacgctggcggcgtgcctaacacatgcaagtcgaacggagatgcattgaatgaagatttcggttggatttcgatacatcttagtggcggacgggtgagtaacgcgtgagtaacctgccgatgagagtggaataacgttctgaaaaggacgctaataccgcataatgtagagcggccgcatgaccattctaccaaagattttatcgctcatcgatggactcgcgtccgattagctagttggtggggtaacggctcaccaaggcgacgatcggtagccggactgagaggttgaacggccacattgggactgagacacggcccagactcctacgggaggcagcagtgggggatattgcgcaatgggggcaaccctgacgcagcaacgccgcgtgaaggaagacggttttcggattgtaaacttcttttgttaaggacgaagaaagtgacggtacttaacgaataagctc

SEQ ID NO: 1528 - DNA, 490 bp, Unknown
  Ascusbbf_1420019, encodes 16S rRNA
agagtttgatcatggctcaggacgaacgctggcggcgtgcttaacacatgcaagtcgaacggggcgatttgaaagcttgcttttgatgagcctagtggcaaacgggtgagtaacgcgtaggcaacctgccctcaggatggggacaacggcccgaaaggaccgctaataccgaatgacataccatgtccgcatggacgaggtatcaaaggcggagcaatccgtcacctgaggatgggcctgcgtctgattaggtagttggtgaggtaacggcccaccaagccgacgatcagtagccggtctgagaggatgaacggcaacattgggactgagacacggcccagactcctacgggaggcagcagtggggaatcttccgcaatgggcgaaagcctgacggagcaacgccgcgtgagtgaagaaggtcttcggatcgtaaagctctgttgtcggggacgaaggggcagatcaggaaatgggtctgcttagacggt

SEQ ID NO: 1529 - DNA, 490 bp, Unknown
  Ascusbbf_6407, encodes 16S rRNA
agagtttgatcatggctcaggatgaacgctagcggcaggcttaacacatgcaagtcgaggggcagcgggtgtagcaatacatgccggcgaccggcgaaagggtgagtaacgcgtgagcaacgtgcccgtatgtgggggatagtcattggaaacgatgcgtaataccccgtaacacatcttcccgcatgaggagatgttgaaagattgattgcatacggatcggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggaagacggccctatgggttgtaaaccgcttttgcgagggagcaataaggtccacgtgtgggccgatgagagtacctcgcgaataagcatc

SEQ ID NO: 1530 - DNA, 490 bp, Unknown
  Ascusbbf_3612, encodes 16S rRNA
agagtttgatcctggctcaggacgaacgctggcggcgtgcttcatacatgcaagtcgaacgagaatcttaacttcggttgagaggaaagtggcggacgggtgagtaatgtgtagagaatctacccttgagtgggggacaacagctggaaacggttgctaataccccatatgagattagttgagatattaatcttgaaaactccggtgctcaaggatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgattgattaagcccttcggggtgtaaagatctgtcagtagggacgaacaatgacggtacctacagaggaagcaccggctaactccgtgccagcagccg

SEQ ID NO: 1531 - DNA, 490 bp, Unknown
  Ascusbbf_22814, encodes 16S rRNA
agagtttgatcatggctcaggacgaacgctggcggcgtgcttaacacatgcaagtcgaacgaggttaagtgaaggaaagcttcggctggaatttatttaaccgagtggcggacgggtgagtaacgcgtgaggaacctgtcttctacagggggataacggtccgaaaggattgctaataccgcataagaccacggaatcgcatggttcaggggtcaaaggagaaatccggtagaaggtggactcgcgtcccattagatagttggtgaggtaacggcccaccaagtcgacgatgggtagccgacctgagagggtgatcggccacattggaactgagatacggtccagactcctacgggaggcagcagtggggaatattgggcaatgggcgaaagcctgacccagcaacgccgcgtgagggaagaaggtcttcgggttgtaaacctctgtccttggtgaaaaggaaggatggtagccaaggaggaagctccgg

SEQ ID NO: 1532 - DNA, 490 bp, Unknown
  Ascusbbf_16733, encodes 16S rRNA
agagtttgatcctggctcaggatgaacgctagcgacaggcctaacacatgcaagtcgaggggcagcgggaaggaagcttgcttcctttgccggcgaccggcgcacgggtgagtaacgcgtatgcaacctggccgcagttgcgggatagccttccgaaagggagattaacaccgcatgaggccggagaggggcatccctttccggtgaaaagtcaatgactgcggatgggcatgcgtccgattagccagccggcggggtaacggcccaccggggcgacgatcggtaggggttctgagaggaaggtcccccacattggaactgagacacggtccaaactcctacgggaggcagcagtgaggaatattggtcaatggacggaagtctgaaccagccaagtcgcgtgaaggaagaatgtcctatggattgtaaacttcttttgggaggggataaaggtctccacgtgtggagatttgcaggtacctcccgaata

SEQ ID NO: 1533 - DNA, 490 bp, Unknown
  Ascusbbf_98593, encodes 16S rRNA
agagtttgatcctggctcagggtgaacgctggcggcgtgcctaagacatgcaagtcgtgcgggccgcggggttttactccgtggtcagcggcggacgggtgagtaacgcgtgggtgacctacccggaagagggggacaacccggggaaactcgggctaatcccccatgtggacccgccccttggggtgtgtccaaagggctttgcccgcttccggatgggcccgcgtcccatcagctagttggtggggtaatggcccaccaaggcgacgacgggtagccggcctgagagggtggccggccacaggggcactgagacacgggccccactcctacgggaggcagcagttaggaatcttccgcaatgggcgcaagcctgacggagcgacgccgcttggaggaagaagcccttcggggtgtaaactcctgaacccgggacgaaacccccgacgaggggactgacggtaccggggtaatagcgccggccaactcc

SEQ ID NO: 1534 - DNA, 490 bp, Unknown
  Ascusbbf_57435, encodes 16S rRNA
agagtttgatcctggctcagagtgaacgctggcggcgtggctaagacatgcaagtcgggcggttgtgcgccttcgggtgtacaatagcggcaaacgggtgagtaacacgtaagtaacctgcccttaagactgggatagcccagcgaaagttggggtaataccggatgaggacctttagtgcatgctaagggatcgaaaggtatgtgaagacgcttaaggaggggcttgcggcctatcagctagttggtggtgtaacggacccccaaggcgaagacgggtagccggtctgagaggacgaacggccacattggaactgagacatggtccagacatctacggatggcagcagtttcgaattattcacaatgggcgaaagcctgatggtgcgacgtcgcgtggaggaagaaggtctttggattgtaaactcctgtcattagggagcaaagtgcaagtgcagagcttgttttgagttaacctaaagaggaagcag

SEQ ID NO: 1535 - DNA, 490 bp, Unknown
  Ascusbbf_466455, encodes 16S rRNA
agagtttgatcatggctcaggacgaacgctggcggcgtgcctaacacatgcaagtcgagcggggattattcagaggagagcttcggcaggaatcgggataattccagcggcggacgggtgagtaacgcgtgaacgatctgtcccagacagggggataacacttggaaacaggtgctaataccgcataagaccacggagctgcatggctttggggtaaaaggagcgatccggtttggggtgagttcgcgtctgattagctggttggtgaggtaacggcccaccaaggcgacgatcagtagccgacctgagagggtgatcggccacattggaactgagacacggtccaaactcctacgggaggcagcagtgggaatattgggcaatgggcgaaagcctgacccagcaacgccgcgtgagggaagaaggttttcggattgtaaacctctgtccttggtgacgaaggaagtgacggtagccaaggaggaagccc

SEQ ID NO: 1536 - DNA, 490 bp, Unknown
  Ascusbbf_139603, encodes 16S rRNA
agagtttgatcctggctcaggacgaacgctggcggcgtgcttaacacatgcaagtcgagcggaaaggccccttcgggggtactcgagcggcgaacgggtgagtaacacgtgagtaacctgccccgaactctgggataagcctgggaaactgggtctaatactggatggtcatctcctgctgcatggtgggaggtggaaagtgtttagcggttcgggatgggctcgcggcctatcagcttgttggtgaggtaatggctcaccaaggcttttacgggtagccggcctgagagggcgaccggccacactgggactgagatacggcccagactcctacgggaggcagcagtggggaatattgcgcaatgggcggaagcctgacgcagcaacgccgtgtgagggatgacggccttcgggttgtaaacctctttcaccagggacgaagcttttgtgacggtacctggggaagaagcgccggccaactacgtgccag

SEQ ID NO: 1537 - DNA, 490 bp, Unknown
  Ascusbbf_17898, encodes 16S rRNA
agagtttgatcctggctcaggataaacgctggcggcgcacataagacatgcaagtcgaacggacgactttgatttgttttacttatcaaagaagttagtggcggactggtgaggaacacgtaaataatctgcctataagaggggaacaacagtgagaaatcactgctaataccgcataattcataactatcgcatgatagatatggaaaaggagcaatccgcttatagatgagtttgcgtctgattagctagttggtgtggtaaaggcataccaaggcaacgatcagtagccgtgctgagaggcagaacggccacattgggactgagatacggcccagactcctacgggaggcagcagtcgggaatattgcgcaatggaggaaactctgacgcagtgacgccgcgtataggaagaaggttttcggattgtaaactattgtagacagggaagaaaacagacagtacctgtaaagtaagctccggctaacta

SEQ ID NO: 1538 - DNA, 490 bp, Unknown
  Ascusbbf_67732, encodes 16S rRNA
agagtttgatcctggctcaggatgaacgctggcggcgtgcctaacacatgcaagtcgagcgagaaacctgtaattgacgcttcggttgattttacaggcggaaagcggcggacgggtgagtaacgcgtaggcaacctgccctttgcacagggatagcctcgggaaaccgggattaaaacctgatgataccgagacaccacatggtgttccggccaaagatttatcggcaaaggatgggcctgcgtctgattagttagttggtgaggtaacggctcaccaaggcaatgatcagtagccgacctgagagggtgatcggccacattggaactgagacacggtccaaactcctacgggaggcagcagtggggaatattgcacaatgggcgaaagcctgatgcagcaacgccgcgtgagcgaagaaggcggaatcgtcgtaaagctctgtccttggggaagaaaacaatgacggtacccttggaggaagccccgg

SEQ ID NO: 1539 - DNA, 490 bp, Unknown
  Ascusbbf_251159, encodes 16S rRNA
agagtttgatcatggctcaggatgaacgctggcggcgtgcctaacacatgcaagtcgagcgagaaaccattttcggagatttcggttgaagaagatggcggaaagcggcggacgggtgagtaacgcgtaggcaacctgcctcatgcagagggatagcctcgggaaaccgggattaaaacctcataacgcggtgagttcacatgaacacagcgccaaagatttatcggcatgagatgggcctgcgtctgattagctagttggtggggtaacggctcaccaaggcgacgatcagtagccgacctgagagggtaatcggccacattggaactgagacacggtccaaactcctacgggaggcagcagtggggaatattgcacaatgggcgaaagcctgatgcagcaacgccgcgtgagcgaagaaggcctttgggtcgtaaagctctgtcggtagggaagaaacaaatgacggtacctaccgaggaagccccgg

SEQ ID NO: 1540 - DNA, 490 bp, Unknown
  Ascusbbf_368, encodes 16S rRNA
agagtttgatcatggctcaggatgaacgctagcgacaggcctaacacatgcaagtcgaggggcagcgggagtgaagcttgcttcacttgccggcgaccggcgcacgggtgagtaacgcgtatgcaacctgcctgtaacagggggataacccggagaaatccggactaagaccgcataacgctgagaagccgcatgacttttcagccaaatattcataggttacagatgggcatgcgtccgattagccagttggcggggtaacggcccaccaaagcgacgatcggtaggggttctgagaggaaggtcccccacattggaactgagacacggtccaaactcctacgggaggcagcagtgaggaatattggtcaatggacggaagtctgaaccagccatgtcgcgtgaaggatgaaggtactatgtattgtaaacttcttttgcctgggggtaaagtgggtcacgcgtggcctattgcaagtaccaggcgaat

SEQ ID NO: 1541 - DNA, 490 bp, Unknown
  Ascusbbf_7947, encodes 16S rRNA
agagtttgatcatggctcaggatgaacgctagcggcaggcttaacacatgcaagtcgaggggcagcgggttgtagcaatacaatgccggcgaccggcgaaagggtgagtaacgcgtgagcaacatgcccgatactggaggatagtcgatggaaacgtcgcgtaatactccgtaacaacagagaccgcatgatctttgtttaatagatttatcggtatcggattggctcgcgtcccattaggcagttggcggggtaacggcccaccaaaccgacgatgggtaggggttctgagaggaaggtcccccacattggaactgagacacggtccagactcctacgggaggcagcagtgaggaatattggtcaatggccgagaggctgaaccagccatgccgcgtgcgggaggacggccctatgggttgtaaaccgcttttgttggggagcaataaggagcacgtgtgcttcgatgagagtacccagcgaataagca

SEQ ID NO: 1542 - DNA, 490 bp, Unknown
  Ascusbbf_1346, encodes 16S rRNA
agagtttgatcatggctcaggatgaacgctggcggcgtgcctaacacatgcaagtcgaacggagcttaatggaaggagacttcggtcaacggaagataagcttagtggcggacgggtgagtaacgcgtgagcaacctgcctcagagtgggggacaacagctggaaacggctgctaataccgcataaaattgttagaaggcatcttctgataatcaaagcttaatgtgctctgagatgggctcgcgtctgattagatagttggtggggtaacggcctaccaagtcgacgatcagtagccggactgagaggttgaacggccacattgggactgagatacggcccagactcctacgggaggcagcagtggggaatattggtcaatgggggaaaccctgaaccagcaacgccgcgtgaaggaagaaggctttcgggttgtaaacttcttttatctgtgacgatagtgacggtagcagatgaataagccacggct

SEQ ID NO: 1543 - DNA, 490 bp, Unknown
  Ascusbbf_1482665, encodes 16S rRNA
agagtttgatcatggctcagattgaacgctggcggcatgccttacacatgcaagtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtgaggtaaaggctcaccaaggcgacgatcagtagctggtctgagaggacgatcagccacactgggactgagacacggcccagactcctacgggaggcagcagtggggaatgttggacaatgggggcaaccctgatccagcaatgccgcgtgtgtgaagaaggccttcgggttgtaaagcacttttgtccggaaagaaatcgcacttactaatattaggtgtggatgacggtaccggaagaat

SEQ ID NO: 1544 - DNA, 490 bp, Unknown
  Ascusbbf_31821, encodes 16S rRNA
agagtttgatcatggctcaggatgaacgctagctacaggcttaacacatgcaagtcgaggggcatcatggaagtagcttgctacttctgatggcgaccggcgaatgggtgagtaacgcgtatccaacctggcctatgctctgggatagcccttagaaatgaggattaatacgagatggtctcctttgatcgcctgagattaggagtaaagacttgtcggcataggatggggatgcgttccattagatagttggcggggtaacggcccaccaagtcgatgatggataggggttctgagaggaaggtcccccacattggtactgagacacggaccaaactcctacgggaggcagcagtgaggaatattggtcaatgggcggaagcctgaaccagccaagtagcgtgaaggaagacggccctacgggttgtaaacttcttttgtcggggaataaccgtcggcacgtgtgccgacctgcatgtacccggtgaat

SEQ ID NO: 1545 - DNA, 490 bp, Unknown
  Ascusbbf_378541, encodes 16S rRNA
agagtttgatcctggctcaggataaacgctggcggcgcacataagacatgcaagtcgaacggaagtcgtcataatgattctgatatagatatgaagatttatctgatttgaaattgaagttgacttatgacaatggctttagtggcggactggtgagtaacgcgtaagcaatctgcctattagaggggaataacagtgagaaatcactgctaataccgcatatgccatagttatcgcatgataatagtgggaaaggagcaatccgctaatagatgagcttgcgtctgattagctagttggtggggtaacggcctaccaaggcgacgatcagtagccggactgagaggttgaacggccacattgggactgagatacggcccagactcctacgggaggcagcagtcgggaatattgcgcaatggaggaaactctgacgcagtgacgccgcgtataggatgaaggttttcggattgtaaactattgtcgttag

SEQ ID NO: 1546 - DNA, 490 bp, Unknown
  Ascusbbf_53912, encodes 16S rRNA
agagtttgatcctggctcaggacgaacgctggcggcgtgcctaacacatgcaagtcgaacgaagcattggaagcttgcttttgatgcttagtggcggacgggtgagtaacgcgtgagcaacctgcctttcagagggggataacgtttggaaacgaacgctaataccgcataacatatctgggtcgcatgattgagatatcaaaggagcaatccgctgaaagatgggctcgcgtccgattagctagttggcgggataacagcccaccaaggcgacgatcggtagccggactgagaggtcgaacggccacattgggactgagacacggcccagactcctacgggaggcagcagtgggggatattgcacaatggaggaaactctgatgcagcaacgccgcgtgagggaagaaggatttcggtttgtaaacctctgtcattggtgacgataatgacggtagccgatgaggaagctccggctaactacgtgccag

SEQ ID NO: 1547 - DNA, 490 bp, Unknown
  Ascusbbf_144284, encodes 16S rRNA
agagtttgatcctggctcaggatgaacgctagcggcaggcttaatacatgcaagtcgtgggacgatagcaatattggaccggcaaacgggtgcgtaacacgtacacaactttccgtcaagtgggggatagcctaaagaaatttggattaataccccatagaataatgatgtggcatcatattattattaaagctccggcgcttgatgatgggtgtgcggctgattaggtagttggcggggtaacggcccaccaagccttcgatcagtagctgatgtgagagcatgatcagccacacgggcactgagacacgggcccgactcctacgggaggcagcagtaaggaatattggtcaatgggcgcaagcctgaaccagccatgccgcgtggaggatgaaggtcctctggattgtaaacttcttttatttgggacgaaaacgggatattcttatcttcttgacggtaccagatgaataagcaccggctaactccg

SEQ ID NO: 1548 - DNA, 490 bp, Unknown
  Ascusbbf_172151, encodes 16S rRNA
agagtttgatcatggctcaggatgaacgctagcggcaggcctaacacatgcaagtcgaggggtagacatcttcggatgttgagaccggcgcacgggtgcgtaacgcgtatgcaatctaccttatactgagggatagcccggagaaatccggattaataccttatagtttttagagatagcattgtctttaaaataaagatttattggtataagatgagcatgcgtcccattagttagttggtaaggtaacggcttaccaagacgatgatgggtaggggtcctgagagggagatcccccacactggtactgagacacggaccagactcctacgggaggcagcagtgaggaatattggtcaatggagggaactctgaaccagccatgccgcgtgcaggaagaatgtcctatggattgtaaactgcttttatacgggaagaaaaagagctacgtgtagtttattgacggtaccgtaagaataaggatcggcta

SEQ ID NO: 1549 - DNA, 490 bp, Unknown
  Ascusbbf_3873, encodes 16S rRNA
agagtttgatcatggctcaggacgaacgctggcggcatgcctaacacatgcaagtcgaacggagatagaaatatcttagtggcgaacgggtgagtaacacgtgagcaacctgcctcatacacagggataacagttagaaatgactgctaataccggataagaccacagtccggcatcggacaggggtcaaagtgctttagcggtatgagatgggctcgcgtccaattagctagttggtgaggtaacggcccaccaaggcgacgattggtagccgacctgagagggtgatcggccacattggaactgagacacggtccaaactcctacgggaggcagcagtggggaatattgggcaatgggcgaaagccttacccagcaatgccgcgtgagtgatgaaggtcttatggattgtaaagctctttgattagggacgaataaatgacggtacctaaagaacaagccccggctaactatgtgccagcagccgcgg

SEQ ID NO: 1550 - DNA, 490 bp, Unknown
  Ascusbbf_14922, encodes 16S rRNA
agagtttgatcatggctcaggataaacgctggcggcgtgcctaatacatgcaagtcgatcgctggaattccagcttgctggaatgaaggagaggcgaacgggtgagtaatacataagcaacctgcccacgaagactgggataattcctggaaacggggactaataccggataggtagtgtgatcgcatgatcgcactattaaaggttcaagacactggtggatgggcttatggcgcattagctggttggtgaggtaacggcccaccaaggcgatgatgcgtagccggcctgagagggtgaacggccacattgggactgagacacggcccagactcctacgggaggcagcagtagggaattttcggcaatgggcgcaagcctgaccgagcaacgccgcgtgagtgaagacggccttcgggttgtaaagctctgttgtaagggaagaattggcatgagagaatcgtgcagtgacggtaccttaccagaaagc

SEQ ID NO: 1551 - DNA, 490 bp, Unknown
  Ascusbbf_22470, encodes 16S rRNA
agagtttgatcatggctcagaatgaacgttggcggcgtggattaggcatgcaagtcgagcggcaaggtttttttcggaagaccctagagcggcggaagggataggagagtatagattacgtgcctcttagctcaggatagcgtctggaaacgggcgataatactgaatgacgtgtacgcacgaaaggtgtaaatccgctaggagatcggtctatatcctattagctagttggtaaggtaacggcttaccaaggcgatgatgggtacggggcgtgagagcgtgaccccgatcactgggactgagacactgcccagacgcctacgggcggctgcagtcgagaatcttcggcaatggacgaaagtctgaccgagcgacgccgcgtgtatgatgaaggtcttcggattgtaaagtactgtcgattaggcggaaggagcgagagcgaactctcgcttttgacctattatttgaggaaggacgggctaagttcgtg

SEQ ID NO: 1552 - DNA, 490 bp, Unknown
  Ascusbbf_1424286, encodes 16S rRNA
agagtttgatcctggctcaggattaacgctggcggcatgcctaagacatgcaagtcgaacgagagggcccattgacattcatcgaaagttgaagtgcttgcactgatgctggacttgtttagatttggattttccctctagtggcaaacgggtgagtaacacgtgggttacctgcctcttagaccgggataccgattggaaacgatcgttaataccggatgttctctacggagtaaaggagcctttaaagcttcgctaagagatgggcctgcggcgtattagctagttggtggggtaatggcctaccaaggcgacgatgcgtagccgtactgagaggttaaacggccacactgggactgagacacggcccagactcctacgggagacagcagttaggaatattcgtcaatgggggaaaccctgaacgagcaatgccgcgtgagtgatgaaggtcctttggattgtaaaactctgttgttatggaaaaatg

SEQ ID NO: 1553 - DNA, 490 bp, Unknown
  Ascusbbf_51209, encodes 16S rRNA
agagtttgatcatggctcaggatgaacgctggcggcgtgcctaatacatgcaagtcgaacgagggtgcttgcaccctagtggcgaacgggtgagtaacacgtaggtaacctgccttttagtttgggatacccagaggaaactttggctaataccggatatgaattcgagaggcatctcttgaatttgaaaggggctcttggccccgctttaagatggacctgcggcgcattagctagttggtgagataacagcccaccaaggcgaggatgcgtatccgatctgagaggatgaccggacacattggaactgagacacggtccaaactcctacgggaggcagcagtaaggagttttcggcaatgggggaaaccctgaccgagcaacgccgcgtgagtgatgacggccctatgggttgtaaagctctgttgtaagagacgaatggtagagtcaggaaatgggctttgcttgacggtatcttaccagaaagcca

SEQ ID NO: 1554 - DNA, 490 bp, Unknown
  Ascusbbf_428240, encodes 16S rRNA
agagtttgatcatggctcaggacgaacgctggcggcgtgcctaatacatgcaagtcgaacgagaatttcttacaccgagtgcttgcactcaccgtaagaaattcgagtggcggacgggtgagtaacacgtgggtaacctgcccaaaagaaggggataacatttggaaacaaatgctaataccgtataaccatgatgaccgcatggtcattatgtaaaaggtggttctgctatcgcttttggatggacccgcggcgtattaactagttggtagggtaacggcctaccaaggtgatgatacgtagccgagttgagagactgatcggccacaatgggactgagacacggcccatactcctacgggaggcagcagtagggaatcttccacaatgggcgcaagcctgatggagcaacgccgcgtgaatgaagaaggtcttcggatcgtaaaattctgttgttagagaagaatatgagtaatagtaactgattatt

SEQ ID NO: 1555 - DNA, 484 bp, Unknown
  Ascusbbf_51358, encodes 16S rRNA
agagtttgatcctggctcagaacgaacgctggcggcaggcttaacacatgcaagtcgagcgcccttttcggagggagcggcagacgggtgagtaacacgtgggaatctacccatctctagggaataactcagggaaacttgtgctaataccctatacgcccccctttggagacattgggggggaaagatttatcggagatggatgagcccgcgttggattagctagttggtgaggtaatggctcaccaaggcgacgatccatagctggtctgagaggatgatcagccacactgggactgagacacggcccagactcctacgggaggcagcagtggggaatattggacaatgggcgcaagcctgatccagccatgccgcgtgtgtgatgaaggccttagggttgtaaagcactttcaccgatgaagataatgacggtagtcggagaagaagccccggctaacttcgtgccagcagccgcggtaat

SEQ ID NO: 1556 - DNA, 490 bp, Unknown
  Ascusbbf_7174, encodes 16S rRNA
agagtttgatcctggctcaggatgaacgctagctacaggcttaacacatgcaagtcgaggggtaacgtgaggaaagcttgctttccttgacgacgaccggcgcacgggtgagtaacgcgtatccaacctgccccagagtcagggataaccttccgaaagggagcctaatacctgatgtagtgcgatgatggcatcagagtttcactaaagatttatcgctctgggatggggatgcgtctgattaggtagtaggcggggtaacggcccacctagccatcgatcagtaggggttctgagaggaaggtcccccacattggtactgagacacggaccaaactcctacgggaggcagcagtgaggaatattggtcaatgggcgcgagcctgaaccagccaagtagcgtgcaggaagactgccctatgggttgtaaactgcttttatgaggggataaagtcggccacgtgtggccgtttgcaggtacctcatgaat

SEQ ID NO: 1557 - DNA, 490 bp, Unknown
  Ascusbbf_42674, encodes 16S rRNA
agagtttgatcatggctcaggatgaacgctggcggcgtgcttaacacatgcaagtcgaacggacttgtgacaccgtctcggatttagcttgctattgaagagacaccgttgcaagttagtggcggacgggtgagtaacgcgtgggcaacctgcctttatccgggggataacagttagaaatgactgctaataccgcataagcgcacggtaccgcatggtacagtgtgaaaaactccggtggatagagatggacccgcgttagattagccagttggcggggtaacggcccaccaaagcgacgatctatagccggcctgagagggcgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaaaggacggtacctgcac

SEQ ID NO: 1558 - DNA, 490 bp, Unknown
  Ascusbbf_710013, encodes 16S rRNA
agagtttgatcctggctcaggatgaacgctggcggcatgcctaagacatgcaagtcgaacggagtgacccattgaagttggagtgcttgcacaaagacggatttggattttcactcagtggcagacgggtgagtaacgcgtgggtaatctacctcaaagtctgggataacttctggaaacggatgctaataccggataacccatagatagataactatttatgttgaaaggagctttcgcttcgctttgagatgagcttgcgttgtattagctagttggtggggtaatggcctaccaaggcaacgatgcatatccgagctgagaggctgatcggacacattgggactgagacacggcccagactcctacgggagacagcagttaggaatattcgtcaatgggggaaaccctgaacgagcaatgccgcgtgaatgatgacaatcctctggattgtaaaattctgttgtaaaggacgaaccactactatagg

SEQ ID NO: 1559 - DNA, 490 bp, Unknown
  Ascusbbf_64941, encodes 16S rRNA
agagtttgatcatggctcaggatgaacgctggcggcgtgcttaacacatgcaagtcgaacggagtacatcaaccgagaccttcgggtctcatctgttgtacttagtggcggacgggtgagtaacgcgtgagcaaccaaccttatgcagagggataacaattagaaatgattgctaataccgcataagaccacagcaccgcatgatgcagtgggaaaaactccggtggcataagacgggctcgcgttcgattagcttgttggtgaggtaacggctcaccaaggcgacgatcgatagccggactgagaggtcgaccggccacattgggactgagacacggcccagactcctacgggaggcagcagtggggaatattgcacaatgggggaaaccctgatgcagcgacgccgcgtgagtgatgaagtatttcggtatgtaaagctcttttagtagggaagaagatgacggtacctacagaaacagccccggcta

SEQ ID NO: 1560 - DNA, 470 bp, Unknown
  Ascusbbf_52352, encodes 16S rRNA
agagtttgatcatggctcagaacgaacgctggcggcaggcctaacacatgcaagtcgaacgccctggcaacagggagtggcagacgggtgagtaacgcgtgggaatctaccttgtggtacggaacaaccaagggaaactttggctaataccgtatgagcccttcgggggaaagatttatcgccataagatgagcccgcgtaggattagctagttggtgaggtaatggctcaccaaggcgacgatccttagctggtctgagaggatgaccagccacactgggactgagacacggcccagactcctacgggaggcagcagtggggaatattggacaatgggcggaagcctgatccagccatgccgcgtgtgtgatgacggccttagggttgtaaagcactttcgccgatgaagataatgactgtagtcggagaagaagccccggctaacttcgtgccagcagccgcggtaat

SEQ ID NO: 1561 - DNA, 490 bp, Unknown
  Ascusbbf_97283, encodes 16S rRNA
agagtttgatcctggctcaggatgaacgctagcggcaggcttaatacatgcaagtcgaggggcagcagctttatagcaatatagaggctggcgaccggcaaacgggtgcggaacacgtacacaaccttcctttaagagggggatagcccatagaaatgtggattaataccccgtaatattattgaagtggcatcactttataattatagttacgacgcttgaagatgggtgtgcggctgattaggtagttggcggggtaaaggcccaccaagccttcgatcagtagctgatgtgagagcatgatcagccacacgggcactgagacacgggcccgactcctacgggaggcagcagtaaggaatattggtcaatggacgcaagtctgaaccagccatgccgcgtgaaggatgaaggtcctctggattgtaaacttcttttatagggggcgaaaaaagggaattctttctcacttgacagtaccctatgaata

SEQ ID NO: 1562 - DNA, 490 bp, Unknown
  Ascusbbf_1883489, encodes 16S rRNA
agagtttgatcctggctcagaacgaacgctggcggcgcgtcttaagcatgcaagtcgggcgggatcgtggtgcttgcaccgcgtgagagcggcggactggcgaggagcgcgtgggtgacgcaccccccggacggggacagccggcagaaatgccgggtgataccggatgaggtcccccttgttggaggagggggaggaaaggggcttcggccccgccgggggagcggcccgcgtcccatcagcctgtaggcggtgtaacggaccacctaagctatgacgggtacccggactgagaggtcggacgggcgcattgggactgagatacggcccagactcctacgggaggcagcagctaagaatagtccgcaatggggggaaccctgacggagcgacgccgcgtgggcgatgaaggccggaaggttgtaaagcccttttatgcgcgaggaataaggaggggaggcaatgcccctctggtgactgtagcgcatga

SEQ ID NO: 1563 - DNA, 490 bp, Unknown
  Ascusbbf_342868, encodes 16S rRNA
agagtttgatcatggctcaggatcaacgctggcggcgtgcctaatgcatgcaagtcgaacggggtcaccttcgggtggctcacgtggcggacgggtgaggaacacgtggggaatctgccgcacgctcgggggtagcccgcggaaacgcggggtaattccggatggactggatgaccgggtagggtgattcaggaaagggcttcggcccggcgagcgaggagcctgcgtccgattagctagttggtggggtaacggcctaccaaggcgatgatcggtagctggtctgagaggacgatcagccacacggggactgagacacggccccgactcctacgggaggcagcagcaaggaattttccgcaatgggcgcaagcctgacggagcaacgccgcgtgcgggatgacgcctttcggggtgtaaaccgctgttcgtggggacgaagcactgacggtacccacggaggaaggcccggctaactacgtgccagcag

SEQ ID NO: 1564 - DNA, 490 bp, Unknown
  Ascusbbf_77907, encodes 16S rRNA
agagtttgatcatggctcaggacgaacgctggcggcgtgcctaatacatgcaagtcgagcgaatctgagggagcttgctcccaaagattagcggcggacgggtgagtaacacgtgggcaacctgcctgtaagactgggataactccgggaaaccggggctaataccggataatatctatttatacatataattagattgaaagatggttctgctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatcggagtaactgccggtaccttgacggtacctaa

SEQ ID NO: 1565 - DNA, 490 bp, Unknown
  Ascusbbf_79893, encodes 16S rRNA
agagtttgatcctggctcaggatgaacgctagcggcaggcttaacacatgcaagtcgaggggcagcgcgggtagcaatacctggcggcgaccggcgaaagggtgagtaacgcgtgagcaacgtgcccgtatgtgggggatagtcattggaaacgatgcgtaataccccgtaacacaaatcttcgcatggggatttgttgaaagatttattgcatacggatcggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggatgacggccctatgggttgtaaaccgcttttgcgagggagcaataagtgttacgtgtagcacgatgagagtacctcgcgaataagcatc

SEQ ID NO: 1566 - DNA, 490 bp, Unknown
  Ascusbbf_43064, encodes 16S rRNA
agagtttgatcatggctcaggatgaacgctagcggcaggcttaacacatgcaagtcgaggggcagcgggaggagtgcttgcacttcttgccggcgaccggcgcacgggtgagtaacacgtatgcaacctgcctccgtcagggggacaacccggcgaaagccgggctaatcccgcgtatattccgtgagggcatccttacggaaggaaaggcttcggccggacggggatgggcatgcggcgcattaggtagtcgggggtgtaacggaccaccgagccgacgatgcgtaggggttctgagaggaaggtcccccacactggtactgagacacggaccagactcctacgggaggcagcagtgaggaatattggtcaatggtcggaagactgaaccagccaagccgcgtgaaggaagaaggtgctcggcatcgtaaacttcttttgtcagggaacaaagggcggtacgtgtaccgctgtgagtgtacctgaagaa

SEQ ID NO: 1567 - DNA, 490 bp, Unknown
  Ascusbbf_418828, encodes 16S rRNA
agagtttgatcatggctcaggatgaacgctggcggcgtgcttaacacatgcaagtcgaacgggaaagcgccctcgggcgcgagtacagtggcgaacgggtgagtaacacgtgaccaacctgccccccgcaccgggatagccgggcgaaagcccgggtaataccggatgaccccgcaccgcggcatcgcggcgcgggcaaagcccagacggcgggggatggggtcgcggcccattagctagtcggcggggtaacggcccaccgaggcgacgatgggtagccgggttgagagaccgaccggccacattgggactgagacacggcccagactcctacgggaggcagcagtggggaatattgcgcaatgggggaaaccctgacgcagcaacgccgcgtgcgggatggaggccttcgggttgtaaaccgctttcagcagggaagaacaaagacggtacctgcagaagaagctccggctaaatacgtgccagcagc

SEQ ID NO: 1568 - DNA, 490 bp, Unknown
  Ascusbbf_1017, encodes 16S rRNA
agagtttgatcatggctcagattgaacgctggcggcaggcttaacacatgcaagtcgagcggggaaaggtagcttgctacctgacctagcggcggacgggtgagtaatgcttaggaatctgcctattagtgggggacaacattccgaaaggaatgctaataccgcatacgccctacgggggaaagcaggggatcttcggaccttgcgctaatagatgagcctaagtcagattagctagttggtggggtaaaggcctaccaaggcgacgatctgtagcgggtctgagaggatgatccgccacactgggactgagacacggcccagactcctacgggaggcagcagtggggaatattggacaatgggcgaaagcctgatccagccatgccgcgtgtgtgaagaaggccttttggttgtaaagcactttaagcgaggaggaggctacttagattaatactctaggatagtggacgttactcgcagaataagca

SEQ ID NO: 1569 - DNA, 490 bp, Unknown
  Ascusbbf_1371617, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaccaggggtataacggagcgaaatttccactaatcccccatattgttattctttcgcatgttaggataacgaaagcttcggtggttacggatgggcatgcgtgacattagctagttggtaaggtaacggcttaccaaggcgacgatgtctaggggagctgagaggcttatccacaaaactggaaatgcgaaacggaccagactcctacgggaggcagcagtgaggaatattggtcaatgggcggaagtctgaaccagccatgccgcggggaggaagaaggtcctatgggttgtaaactccttttgttcgagagtaataagggctttgcgaagcccgatgagagtatcggacgaataagc

SEQ ID NO: 1570 - DNA, 490 bp, Unknown
  Ascusbbf_8722, encodes 16S rRNA
agagtttgatcatggctcaggatgaacgctagcggcaggcctaatacatgcaagtcgaacggtaaacgccccttcgggggtgtgagagtggcgcacgggtgcgtaacgcgtatgcaacccacccgctgtcgggggatagcccggagaaattcgaattaataccccatgaggagtgtttgaggcatctcaggcatttcaaaactaaggtgacggcggacgggcatgcgtgccattagatagttggcggggtaacggcccaccaagtcgacgatggctaggggatctgagaggacggtcccccacactggtactgagacacggaccagactcctacgggaggcagcagtaagggatattggtcaatggggggaaccctgaaccagccatgccgcgtgagggaataaggccctacgggtcgtaaacctcttttgccgggggataaggacatccacgtgtgggtgtttgaaggtacccggagaataagcatcgg

SEQ ID NO: 1571 - DNA, 490 bp, Unknown
  Ascusbbf_18378, encodes 16S rRNA
agagtttgatcatggctcaggatgaacgctggcggcgtgcttaacacatgcaagtcgaacgggaactctgaactgaaggttcgctggatgtttagaaattctagtggcggacgggtgagtaacgcgtgggtaacctgcctataagacgtgaacaacagttagaaatgactgctaatacacgataagcacacagtatcgcatgatatagtgtgaaaagaatttcgcttatagatggacccgcgtttgattagccagttggtggggtaacggcctaccaaagcaacgatcaatagccggcctgagagggcgatcggccacattgggactgagacacggcccaaactcctacgggaggcagcagtggggaatattggacaatgggggcaaccctgatccagcaacgccgcgtgagtgatgaagtatcttggtatgtaaagctctatcagtaggtatgaaacaagacagcctaactaagaagccccggctaact

SEQ ID NO: 1572 - DNA, 490 bp, Unknown
  Ascusbbf_10121, encodes 16S rRNA
agagtttgatcctggctcaggacgaacgctggcggcgcgcctaacacatgcaagtcgaacgggattgtttacaatccagtggcggacgggtgagtaatgcatgagtaatctgcctgaaagagggggatagcttctggaaacagaagataataccgcatatttcaaaatttccgcatggtttttttggcaaaggagcaatccactttcagatgagctcatgtccgattagctagttggtagggtaaatgcctaccaaggcaacgatcggtagccgtactgagaggttctacggccacattgggactgagacacggcccagactcctacgggaggcagcagtgaggaatattgcgcaatggaggaaactctgacgcagcgacgccgcgtgagggaagaaggttttcgaattgtaaacctctgttctcagggaagataatgacggtacctgaggagtaagccccggctaactacgtgccagcagccgcggtaa

SEQ ID NO: 1573 - DNA, 490 bp, Unknown
  Ascusbbf_21927, encodes 16S rRNA
agagtttgatcatggctcaggatgaacgctagctacaggcttaacacatgcaagtcgaggggcagcatgaatcaagcttgcttgatttgatggcgaccggcgcacgggtgcgtaacgcgtatccaatctaccctattctcagggatagccttgcgaaagtaagattaatacctgatggtctcacgtcgccgcatggcgttgtgagtaaagatttatcggaatgggatggggatgcgtccgattagcttgacggcggggtaacggcccaccgtggcgacgatcggtaggggttctgagaggaaggtcccccacactggaactgagacacggtccagactcctacgggaggcagcagtgaggaatattggtcaatggccgtaaggctgaaccagccaagtagcgtgagggatgacggccctacgggttgtaaacctcttttgttggggaataaagtcaggtacgtgtacctgtttgtatgtaccttacgaat

SEQ ID NO: 1574 - DNA, 490 bp, Unknown
  Ascusbbf_44195, encodes 16S rRNA
agagtttgatcctggctcaggatgaacgctagctacaggcttaacacatgcaagtcgaggggcatcgcgggagttgcttgcaacttctggcggcgaccggcgcacgggtgagtaacgcgtatccaacctgccctttactacggtatagcccagcgaaagttggattaatcccgtatgttgtcgcgcgatggcatctgatcgcgacgaaaggttcaccggtagaggatggggatgcgtccgattaggtagtcggcgggttgacagcccaccgagccgacgatcggtaggggttctgagaggaaggtcccccacattggaactgagacacggtccaaactcctacgggaggcagcagtgaggaatattggtcaatgggcgcaggcctgaaccagccaagtagcgtgagggaagacggccctacgggttgtaaacctctttttcacggggataaagtgtgccacgtgtggcatattgcaggtaccgtgtgaat

SEQ ID NO: 1575 - DNA, 488 bp, Unknown
  Ascusbbf_24237, encodes 16S rRNA
agagtttgatcatggctcagaacgaacgctggcggcatggattaggcatgcaagtcgaacgaagcagcaatgcttagtggcggaagggtgaggaacgcgtgagcaatctgcccccaagttgggaataacagttggaaacgactgctaataccgaatgtggctgagagaccgcatgatctttcggctaaagatttatcgcttggggatgagctcgcgtcccattagctagttggtgaggtaacggcccaccaaggcgatgatgggtagctggtctgagaggatggtcagccacactgggactgagacactgcccagactcctacgggaggctgcagtcgagaatcttgggcaatgcgcgaaagcgtgacccagcaatgccgcgtgtgtgatgaaggtcttcggattgtaaaacactgtctcccgggacgaaagttgacggtaccggggaaggaagccacggctaactacgtgccagcagccgcggtaat

SEQ ID NO: 1576 - DNA, 490 bp, Unknown
  Ascusbbf_10429, encodes 16S rRNA
agagtttgatcatggctcaggacgaacgctggcggcgtgcttcatacatgcaagtcgaacgagaagtcaccttcgggtgatggaaagtggcggacgggtgagtaatacgtagggaatctgccctagagcgggggacaacagttggaaacgattgctaataccccatatgagcttggttgaaataccaatcttgaaaactccggtgctctaggatgagcctgcggctgattagcttgttggcggggtaaatgcccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgaatgttaagcccttcggggtgtaaagttctgtcagtggggacgaaacttgacggtacccacagaggaagcaccggctaactccgtgccagcagccgcgg

SEQ ID NO: 1577 - DNA, 490 bp, Unknown
  Ascusbbf_1341365, encodes 16S rRNA
agagtttgatcctggctcaggatgaacgctagcgataggcctaacacatgcaagtcgaggggcagcacatgacgtagcaatacagatggtggcgaccggcgcatgggtgagtaacacgtatgcaacctaccttcaacaggggaataacccgtcgaaagacggactaataccccataatacagggctccctcatgggaatatttgttaaagatttatcggttgaagatgggcatgcgttccattagctagttggtgaggtaacggctcaccaaggcaacgatggataggggaactgagaggttgagccccaacactggtactgagaaccggaccagactccgacggaaggcagcagtgaggaagattggtcaatggaggcaactctgaaccagccacgtcgcgtgaaggatgacggccctacgggttgtaaacttcttttgtaagggaataaagttagttacgtgtagctatttgcatgtaccttacgaat

SEQ ID NO: 1578 - DNA, 490 bp, Unknown
  Ascusbbf_35016, encodes 16S rRNA
agagtttgatcatggctcagattgaacgctggcggcaggcttaacacatgcaagtcgagcggggataggtagcttgctactgattcctagcggcggacgggtgagtaatacttaggaatctgcctattagtgggggacaacgttccgaaagggacgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggggcaaccctgatccagccatgccgcgtgtgtgaagaaggccttttggttgtaaagcactttaagcgaggaggaggcttacctggataatacctgggataagtggacgttactcgcagaataagc

SEQ ID NO: 1579 - DNA, 468 bp, Unknown
  Ascusbbf_12113, encodes 16S rRNA
agagtttgatcatggctcagaacgaacgctggcggcaggcttaacacatgcaagtcgagcgcctcgcaaggggagcggcagacgggtgagtaacgcgtgggaatgtacccttctctacggaataacacagagaaatttgtgctaataccgtatacgccctttgggggaaagatttatcggagaaggatcagcccgcgtaggattagctagttggtgtggtaatggcgcaccaaggcgacgatccttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcacccacgacgataatgacggtagtgggagaagaagccccggctaacttcgtgccagcagccgcggtaat

SEQ ID NO: 1580 - DNA, 489 bp, Unknown
  Ascusbbf_25048, encodes 16S rRNA
agagtttgatcatggctcagaacgaacgctggcggcatggattaggcatgcaagtcgaacggtgcagcaatgcatagtggcgcaagggtgaggaacacgtgagtaatctgccctcgagtttggaatagctcctggaaacgggaattaataccggatgttatcaggttgacgcatgttgaccggatgaaagcagagatgcgcttgaggatgagctcgcgtcccattagctggttggtgaggtaacggcccaccaaggcgatgatgggtagctggtctgagaggacgatcagccacactgggactgagaactgcccagactcctacgggaggctgcagtcgagaattttgggcaatgggcgaaagcctgacccagcaatgccgcgtgcgggatgaaggtcttcggattgtaaaccgctgtcaagagggacgaaaattgacggtacctctgaaggaagtcacggctaactacgtgccagcagccgcggtaat

SEQ ID NO: 1581 - DNA, 490 bp, Unknown
  Ascusbbf_125415, encodes 16S rRNA
agagtttgatcatggctcagaacgaacgctggcggcaggcctaacacatgcaagtcgagcgtgaaaggggcttcggccctgagtaaagcggcgcacgggtgagtaacacgtgaataatctgcccttgagaccgggataacagaccgaaaggactgctaataccggataagcccacagaccaaccgggtgtgtgagaaaagagcgggaatcttcggatccgttcacttaaggatgagttcgcgttccattagatagttggtgaggtaatggctcaccaagtcgacgatggatagctggtcttagaggatgatcagccacactggaactgagacacggtccagactcctacgggaggcagcagtggggaatcttgcgcaatggaggaaactctgacgcagccatgccgcgtgagcgatgaaggccttcgggttgtaaagctccgtctaaggggacgaatggtcaaggtgacaacaacgccttggcgtgacgg

SEQ ID NO: 1582 - DNA, 490 bp, Unknown
  Ascusbbf_112743, encodes 16S rRNA
agagtttgatcatggctcaggatgaacgctggcggcgtgcctaacacatgcaagtcgaacgggactgtttagtgacgatttcggtctgaactttacagtttagtggcggacgggtgagtaacgcgtggataacctgcctttcacagggggatagcagctggaaacggctggtaataccgcatacgcgagagatgccgcatgacatcactcggaaagatttatcggtgaaagatggatccgcgtctgattagccagttggcggggtaacggcccaccaaagcgacgatcagtagccggcctgagagggcggacggccacattgggactgagacacggcccagactcctacgggaggcagcagtgggggatattgcacaatgggcgcaagcctgatgcagcgacgccgcgtgagtgaagaagtatttcggtatgtaaagctctatcagcagggaagaaagacccgcaagggggatgacggtacctgactaag

SEQ ID NO: 1583 - DNA, 490 bp, Unknown
  Ascusbbf_84801, encodes 16S rRNA
agagtttgatcatggctcaggatgaacgctggcggcgtgcttaacacatgcaagtcgaacggagatatatttttgaagttttcggatggattgaatatatcttagtggcggacgggtgagtaacgcgtaaacaatctgccttagagagggggataacagatagaaatatttgctaataccgcataagaccacggttggcatcaaccaggggtaaaaggagcaatccgctttaagatgagtttgcgtactattagctagttggtgaggtaacggcccaccaaggcgacgatggttagccggcctgagagggtgaacggccacattggaactgagatacggtccagactcctacgggaggcagcagtgaggaatattgggcaatggaggaaactctgacccagcaacgccgcgtgaaggaagaaggttttaggattgtaaacttctgttgtagaggaaaaagaaagtgatggtactctgcgaggaagctacg

SEQ ID NO: 1584 - DNA, 490 bp, Unknown
  Ascusbbf_84524, encodes 16S rRNA
agagtttgatcatggctcaggatgaacgctagcgggaggcttaatacatgcaagtcgaacggcagcaggtccttcgggacgctggcgagtggcgaacgggtgagtaacgcgtacacgatctgcccataagtctgggatagtcactggaaacggtgaataataccggatgtggataaattgcttcatggtaatttatttaaaggctggtctgcttatggatgagtgtgcgtcctattagttagttggtgaggtaacggctcaccaagacgatgataggtagggggcgtgagagcgtggacccccacacgggtactgagacacggacccgactcctacgggaggcagcagtaaggaatattggacaatgggcgagagcctgatccagccatcccgcgtgcaggaagacggccctttgggttgtaaactgcttttataagggaagaacagccccgattgatcggggtatgacggtaccttaggaataagcacc

SEQ ID NO: 1585 - DNA, 490 bp, Unknown
  Ascusbbf_91325, encodes 16S rRNA
agagtttgatcctggctcaggacgaacgctggcggcgtgcctaacacatgcaagtcgaacgagaaatatgacattgattccttcgggatgatttggattatggacagtggcggacgggcgagtaacgcgtgagtaacctgcccataagagagggatagccgatggaaacgtcgagtaatacctcatattgtaatataatcgcatggttaaattatgaaagatttatcgcttatggatggactcgcgtctgattagatagttggtgaggtaacggctcaccaagtcgacgatcagtagccgaactgagaggttgatcggccgcattgggactgagacacggcccagactcctacgggaggcagcagtggggaatattgcgcaatgggggaaaccctgacgcagcaacgccgcgtgcaggaagaaggtcttcggattgtaaactgttgtcgcaagggaagaagaaagtgacggtaccttgtgagaaagtcac

SEQ ID NO: 1586 - DNA, 490 bp, Unknown
  Ascusbbf_108742, encodes 16S rRNA
agagtttgatcatggctcaggatgaacgctggcggcgtgcctaacacattcaagtcgaacggactgattcggtagtaatactgatgaaagttagtggcggacgggtgagtaacgcgtgaggaacctgcctctgtgagcgggataacgtccggaaacagacgctaataccgcatgaaccgacagtaccgcatggtacaatcggcaaatgaacttcgcacagagatggcctcgcgtccgattagatagttggcggggcaacggcccaccaagtctgcgatcggtagccggactgagaggttgaacggccacattggaactgagatacggtccagactcctacgggaggcagcagtggggaatattgggcaatgggcgaaagcctgacccagcgacgccgcgtgagggaagaaggtcttcggattgtaaaccttaaacaacggggacgaaacaaatgacggtacccgttaggaagccacggctaactacgtgc

SEQ ID NO: 1587 - DNA, 490 bp, Unknown
  Ascusbbf_34542, encodes 16S rRNA
agagtttgatcatggctcaggacgaacgctggcggcgtgcctaacacatgcaagtcgaacgggatatatgctttgagtttttcggaacgattagcatatcatctagtggcggacgggtgagtaacacgtgagtaatctgccttgtagagggggataacggctagaaatggtcgctaataccgcgtaaaatatatttagcgcatgctagatatatcaaagatttatcgctgcaagatgagctcgcgtctgattagatagttggcggggtaaaggcccaccaagtctacgatcagtagccgaactgagaggttgattggccacattgggactgagacacggcccagactcctacgggaggcagcagtgggggatattgcacaatgggggaaaccctgatgcagcaacgccgcgtgagggaagaaggttttcgaattgtaaacctctgtctttgaggatgataatgacagtactcaaagaggaagctccggct

SEQ ID NO: 1588 - DNA, 490 bp, Unknown
  Ascusbbf_109858, encodes 16S rRNA
agagtttgatcatggctcaggacgaacgctggcggcgtgcttaacacatgcaagtcgaacgaagtaagaaattacttagtggcggacgggtgagtaacgcgtgagtaacctgcccttatctggggaataacacagagaaatctgtgctaataccgcatgacatttaccgaaggcatcttaggtaaatcaaagatttatcggataaggatgggctcgcgtccaattaggtagtaggtgaggtaacggcccacctagccgacgattggtagccgacctgagagggtgatcggccacattggaactgagaaacggtccagactcctacgggaggcagcagtggggaatattgggcaatggaggcaactctgacccagcaacgccgcgtgaatgatgaaggtcttcggattgtaaagttctgtgatgggggacgaagaaagtgacggtaccccaatagcaagctacggctaactacgtgccagcagccgcggta

SEQ ID NO: 1589 - DNA, 472 bp, Unknown
  Ascusbbf_58318, encodes 16S rRNA
agagtttgatcctggctcagaacgaacgctggcggcgcgcttaacacatgcaagtcggacgctcattttcggatgggagtggcggacgggtgagtaacgcgtgggaacctgccctgaggtctgggacaaccgctggaaacggcggctaataccggatgtctcctacgggagaaagatttatcgccttgggaggggcccgcgttggattagctagttggtggggtaatggcccaccaaggctgcgatccatagctggtctgagaggatggccagccacactgggactgagacacggcccagactcctacgggaggcagcagtggggaatcttggacaatgggggcaaccctgatccagcgacgccgcgtgggtgatgaaggccttagggttgtaaagcccttttctcggggaagatgatgacggtacccgaggaataagcaccggctaactccgtgccagcagccgcggtaat

SEQ ID NO: 1590 - DNA, 490 bp, Unknown
  Ascusbbf_897048, encodes 16S rRNA
agagtttgatcatggctcaggacgaacgctggcggcgtgcctaatacatgcaagtagaacgctgaaggaggagcttgctcttctggatgagttgcgaacgggtgagtaacgcgtaggtaacctgcctggtagcgggggataactattggaaacgatagctaatactgcataatagtagatgttgcatgacatttacttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatctta

SEQ ID NO: 1591 - DNA, 472 bp, Unknown
  Ascusbbf_71974, encodes 16S rRNA
agagtttgatcctggctcagagcgaacgctggcggcaggcttaacacatgcaagtcgaacgctcgtcttcggacgggagtggcagacgggtgagtaacacgtgggaacgtaccctttggttcggaataacgcagggaaacttgcgctaataccggatacgcccttttggggaaaggtttactgccgaaggatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaat

SEQ ID NO: 1592 - DNA, 489 bp, Unknown
  Ascusbbf_52512, encodes 16S rRNA
agagtttgatcatggctcaggatgaacgctggcggcgtgcttaacacatgcaagtcgaacgagcgccttcgggcgcgagtggcggacgggtgagtaacgcgtgggtaacctgccctgtacaggggaataacagagagaaatctctgctaatgccgcataagcgcacggcactgcatggtgctgtgtgaaaagctccggcggtacaggatggacccgcgtctgattagctggttggcggggtaacggcccaccaaggcgacgatcagtagccggcctgagagggtgaacggccacattgggactgagatacggcccagactcctacgggaggcagcagtggggaatattgcacaatgggggaaaccctgatgcagcaacgccgcgtgagtgaagaagtatttcggtatgtaaagctctatcagcagggaagaagatgacggtacctgcacaagaagccccggctaactacgtgccagcagccgcggtaat

SEQ ID NO: 1593 - DNA, 490 bp, Unknown
  Ascusbbf_92402, encodes 16S rRNA
agagtttgatcatggctcaggattaacgctggcggcgtgcataacacattcaagtcgaacggagtgtagaaatacacttagtggcggacgggtgagtaacgcgtgagcaatctaccttccagtgcgggataacaaccggaaacagttgctaataccgcatgaaccggcagcatcgcatggtgcaaccggcaaaggcttgctgctggaagatgagcttgcgtccgattagatagttggcggggcagaggcccaccaagtcgacgatcggtagccggactgagaggttgaacggccacattggaactgagaaacggtccagactcctacgggaggcagcagtggggaatattgggcaatgggcgaaagcctgacccagcgacgccgcgtgagggaagaagatcttcggattgtaaaccttagtcaacagggacgaagcaagtgacggtacctgtggaggaagccacggctaactacgtgccagcagccgcgg

SEQ ID NO: 1594 - DNA, 490 bp, Unknown
  Ascusbbf_988909, encodes 16S rRNA
agagtttgatcatggctcaggatgaacgctagcggcaggcttaacacatgcaagtcgaggggcagcgtaaggatgtagcaatacaaccttgacggcgaccggcgcaagggtgcgtaacgcgtgagcaacttgcccgtatcaggggcataaccggtggaaacgccgactaattcccataacataccttgcggcatcgcagggtattgaaatctttggaggatacggatgggctcgcgtgacattaggcagttggcggggtaacggcccaccaaaccgacgatgtctaggggaactgagaggttaatcccccacactggaactgaacaacggtccagactcctacgggaggcagcagtgaggaatattggacaatggccggaaggctgatccagccatgccgcgtgcaggataaggtcctatggattgtaaactgcttttgtatgagagcaataaggattacgtgtaatccgatgagagtatcatacgaata

SEQ ID NO: 1595 - DNA, 490 bp, Unknown
  Ascusbbf_499794, encodes 16S rRNA
agagtttgatcctggctcaggataaacgctggcggcgcacataagacatgcaagtcgaacggaagtcgttatactgatttagataagaacggagaacttgttcaaagggacttgaagaagatttataacaatggctttagtggcggactggtgagtaatacgtaagcaacctgcctattagaggggaacaacagttagaaatgactgctaataccgcatatgccatatggatcacatgattcaagtgggaaaggagtaatccgctaatagatgggcttacggctgattagctagttggtgtggtaacggcataccaaggcgacgatcagtagccggactgagaggttcaacggccacattgggactgagatacggcccagactcctacgggaggcagcagtcgggaattttgcgcaatggaggaaactctgacgcagtgacgccgcgtgcaggaagaaggttttcggattgtaaactgctttagacaggg

SEQ ID NO: 1596 - DNA, 490 bp, Unknown
  Ascusbbf_1590761, encodes 16S rRNA
agagtttgatcatggctcaggatgaacgctggcggcgtgcctaacacatgcaagtcgagcgagaagctcatgatcgattgactgagtggaaagcggcggacgggtgagtaacgcgtaggcaacctgccccttgcagagggatagcctcgggaaaccgggattaaaacctcataatgcgtaagtgagacatctcagatacgccaaagatttatcggcaagggatgggcctgcgtctgattagttagttggtggggtaacggcctaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaaggatgaaggcccttgggtcgtaaacttctgttctaagggaagataatgacggtaccttaggagcaagtcccggctaactacgtgccag

SEQ ID NO: 1597 - DNA, 468 bp, Unknown
  Ascusbbf_43813, encodes 16S rRNA
agagtttgatcatggctcagaacgaacgctggcggcaggcctaatacatgcaagtcgaacgcaccttcgggtgagtggcagacgggtgagtaacgcgtgggaaccttcccgatagtacggaataactccgggaaaccggtgctaataccgtatacgcccttcgggggaaagatttatcgctatcggatgggcccgcgttggattagctagttggtggggtaaaagcctaccaaggcgacgatccatagctggtctgagaggatgatcagccacactgggactgagacacggcccagactcctacgggaggcagcagtagggaatcttggacaatgggcgaaagcctgatccagccatgccgcgtgagtgaagaaggccttagggttgtaaaactcttttagcggggaagataatgacggtacccgcagaataagccccggctaacttcgtgccagcagccgcggtaat

SEQ ID NO: 1598 - DNA, 490 bp, Unknown
  Ascusbbf_47552, encodes 16S rRNA
agagtttgatcatggctcaggatgaacgctagcgacaggcctaacacatgcaagtcgaggggtaacaggggagcttgctcccgctgacgaccggcgcacgggtgagtaacacgtatgcaacctacccgtaagagggggataacccggagaaatccggactaacaccgcataatatcacgatgaggcatcttgacgtgattaaatatttatagcttacggatgggcatgcgcatgattagctagttggtggggtaacggcctaccaaggcgacgatcattaggggtcctgagagggaaatcccccacattggtactgagacacggaccaaactcctacgggaggcagcagtgaggaatattggtcaatgggcgagagcctgaaccagccatgtcgcgtgaaggatgaatgtcctatggattgtaaacttcttttataggggaataaagtgagtctcgtgaggctttttgcatgtaccctatgaataagcat

SEQ ID NO: 1599 - DNA, 485 bp, Unknown
  Ascusbbf_128789, encodes 16S rRNA
agagtttgatcatggctcagaacgaacgctggcggcaggcttaacacatgcaagtcgaacggaacatagggagcttgcttcttatgtcagtggcgcacgggtgagtaacgcgtaggaacctgtcttttagcctgggatagcctctggaaacggagggtaaaaccggatgagccctgagggggaaatgagtaatcagctggaagaggggcctgcgttagattaggcagttggtggggtaacggcctaccaaaccgacgatctatagctggtctgagaggatgatcagccacattgggactgagacacggcccaaactcctacgggaggcagcagtggggaatattggacaatgggggagaccctgatccagccatgccgcgtgagtgatgacggccttcgggttgtaaagctcttttacacgggaagatgatgacggtaccgtgagaataagcaccggcaaacttcgtgccagcagccgcggtaat

SEQ ID NO: 1600 - DNA, 490 bp, Unknown
  Ascusbbf_1580781, encodes 16S rRNA
agagtttgatcctggctcagattgaacgctggcggcaggcttaacacatgcaagtcgaacggtagcaggaagaagcttgcttctttgctgacgagtggcggacgggtgagtaatgcttgggaatctggcttatggagggggataactactggaaacggtagctaataccgcgtaatctctacggagtaaagggtgggaccgtaaggccacctgccataagatgagcccaagtgggattaggtagttggtggggtaatggctcaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgatgaggaaggcggttagtttaatagactaatcgattgacgttagtcacagaag

SEQ ID NO: 1601 - DNA, 470 bp, Unknown
  Ascusbbf_109121, encodes 16S rRNA
agagtttgatcctggctcagagtgaacgctggcggcatgcttaacacatgcaagtcgtgcgccccgcaaggggagcggcggacgggtgagtaacacgtaggaatgtgtccggaggtgggggataaccctgggaaactagggctaataccgcatatgggctgaggctcaaagcagcgatgcgccttcggagtagcctgcgcctgattagctagttggtggggtaaaggcctaccaaggcgacgatcagtagctggtctgagaggacgatcagccacactgggactgagacacggcccagactcctacgggaggcagcagtggggaatattggacaatgggcgcaagcctgatccagcaatgccgcgtgtgtgaagaaggtcttcggatcgtaaagcactttcggcggggacgatgatgacggtacccgcagaagaagccccggctaacttcgtgccagcagccgcggtaat

SEQ ID NO: 1602 - DNA, 490 bp, Unknown
  Ascusbbf_125831, encodes 16S rRNA
agagtttgatcatggctcaggacgaacgctggcggcgtgcctaacacatgcaagtcgaacgaagcttgatgaatgatcccttcggggtgatttctgatatgacttagtggcggacgggtgagtaacgcgtgagcaacctgcctttcagagggggatagcgtttggaaacgaacgataataccgcataacatcagagtgctgcatggcattttgatcaaaggagcaatccgctgaaagatgggctcgcgtctgattagatagttggtgaggtaacggctcaccaagtcgacgatcagtagccggactgagaggttgaacggccacattgggactgagacacggcccagactcctacgggaggcagcagtggggaatattgcacaatgggggaaaccctgatgcagcaacgccgcgtgagggaagacggttttcggattgtaaacctttgtctttggtgaagaagaagtgacggtagccaaggaggaagcca

SEQ ID NO: 1603 - DNA, 490 bp, Unknown
  Ascusbbf_141749, encodes 16S rRNA
agagtttgatcatggctcaggatgaacgctggcggcaggcttaatacatgcaagtcgaacggtaacgaccggtagcaataccggggcgacgagtggcgcacgggtgcgtaacgcgtatgcaacctgccttcaaccggggcataacgttgagaaatcggcgctaatatcccatgtgtatgagagacggcatcgtcttacatataaagatttattggttgaggatgggcatgcgtaacattagcttgttggcggggtaacggcccaccaaggcgacgatgtttaggggttctgagaggattcacccccacactggaactgagacacggtccagactcctacgggaggcagcagtagggaatattgggcaatggaggcaactctgacccagccatgccgcgtgaaggaagacggccctatgggttgtaaacttcttttgccgcagagtaacccgggggacgcgtcccccgctgagagtatgcggcgaataagt

SEQ ID NO: 1604 - DNA, 490 bp, Unknown
  Ascusbbf_334896, encodes 16S rRNA
agagtttgatcctggctcagattgaacgctggcggcatgctttacacatgcaagtcgaacggcagcacggggagcttgctccctggtggcgagtggcgaacgggtgagtaatatatcggaacgtgtccaataatgggggataactagtcgaaagattagctaataccgcatacgccctgagggggaaagtgggggatcttcggacctcacgttaatggagcggccgatatctgattagctagttggtggggtaaaggcctaccaaggcgacgatcagtagctggtctgagaggatgatcagccacactgggactgagacacggcccagactcctacgggaggcagcagtggggaattttggacaatgggcgaaagcctgatccagccatgccgcgtgagtgaagaaggccttcgggttgtaaagctctttcgcaaggaaagaaaacttatctactaatactagatgaggatgacggtaccttgataagaa

SEQ ID NO: 1605 - DNA, 490 bp, Unknown
  Ascusbbf_91548, encodes 16S rRNA
agagtttgatcctggctcaggatgaacgctagcgataggcttaacacatgcaagtcgaggggcatcagggacttcggtctgctggcgaccggcgcacgggtgcgtaacgcgtatgcaacttaccctacaatggaggataacccgtcgaaagacggactaatactgcgtatgctcacgctgaggcatctcaaagtgaggaaagaaaatcgatgtaggataggcatgcgtcccattagctagttggtgaggtaacggctcaccaaggcgacgatgggtaggggaactgagaggtttatcccccacactggtactgagacacggaccagactcctacgggaggcagcagtgaggaatattggtcaatgggcgagagcctgaaccagccaagtcgcgtgaaggaagactgtcttatggattgtaaacttcttttgtatgggaataacatgacctacgtgtaggttactgcatgtaccatacgaataagcatcgg

SEQ ID NO: 1606 - DNA, 490 bp, Unknown
  Ascusbbf_134904, encodes 16S rRNA
agagtttgatcatggctcaggatgaacgctggcggcgtgcctaacacatgcaagtcgaacggagtgttttcttcggaggacacttagtggcggacgggtgagtaacgcgtgggtaatctgccttacacagggggacaacagttggaaacgactgctaataccgcataagccggtagcgccgcatggcgcatccggaaaagattcatcggtgtaagatgagcccgcgtctgattagttagttggcggggtaacggcccaccaagacgacgatcagtagccgacctgagagggtgatcggccacattgggactgagacacggcccaaactcctacgggaggcagcagtggggaatattgcgcaatggggggaaccctgacgcagcaacgccgcgtgagtgaagaagtatttcggtatgtaaagctctatcagcagggaagaaaacgacggtacctgcagaagaagtcccggctaactacgtgccagcagccg

SEQ ID NO: 1607 - DNA, 490 bp, Unknown
  Ascusbbf_96014, encodes 16S rRNA
agagtttgatcatggctcaggatgaacgctggcggcgtgcttaatacatgcaagtcgaacgaagagcccttaaccgaagatgatgacgtgcttgcactgaatctgattcaccttagggttactgagtggcggacgggtgagtaacgcgtgggtaacctgccttagacagggggataacatcaagaaattggtgctaataccgcatatgctcacagtatcgcatgatacagtgaggaaaactccggtggtctaagatggacccgcgtctgattagctagttggaggggtaacggcccaccaaggcgacgatcagtagccgacttgagagagtgatcggccacattgggactgagacacggcccaaactcctacgggaggcagcagtagggaatattgcacaatgggggaaaccctgatgcagcgacgccgcgtgaaggatgaagtatttcggtatgtaaacttctatcagcaaggaagaaaatgacggtac

SEQ ID NO: 1608 - DNA, 490 bp, Unknown
  Ascusbbf_106031, encodes 16S rRNA
agagtttgatcatggctcaggatgaacgctagctacaggcttaacacatgcaagtcgaggggcagcatgatcaaagcttgctttgattgatggcgaccggcgcacgggtgcgtaacgcgtatccaacctgccgtgtactcggggatagccctctgaaaggaggattaatacccgatgtggttgcttgaggacatcctcttgcaattaaagatttatcggtacaccgatggggatgcgtacgattaggtagtcggcggggtaacggcccaccgagccaacgatcgttaggggttctgagaggaaggtcccccacataggaactgagacacggtcctaactcctacgggaggcagcagtgaggaatattggtcaatgggcgagagcctgaaccagccaagtagcgtgaaggatgactgccctatgggttgtaaacttcttttataggggaataaagtgtggcacgtgtgccattttgtatgtaccctatgaa

SEQ ID NO: 1609 - DNA, 490 bp, Unknown
  Ascusbbf_917792, encodes 16S rRNA
agagtttgatcatggctcagattgaacgctggcggcaggcttaacacatgcaagtcgaacgagatgagtggcttcggtcatgagtctagtggcggacgggtgagtaacgcgtggacaacttgccttatagtgggggatagccgaaagaaatttcgattaataccgcataatacgatttggtcgcatgattgaatcgggaaagacttcggtcgctaaaagaaaggtctgcgtctgattagctagttggtgtggtaacggcataccaaggcaacgatcagtagctggtttgagagaatgaacagccacattgggactgagatacggcccagactcctacgggaggcagcagtggggaatattgcgcaatggaggaaactctgacgcagcgacgccgtgtaaaggatgaaggccttcgggttgtaacttatatcgattgtgaaaagcaaggatggtagcaaagtaagaagctccggctaactacgtgccagca

SEQ ID NO: 1610 - DNA, 490 bp, Unknown
  Ascusbbf_111004, encodes 16S rRNA
agagtttgatcatggctcaggatgaacgctggcggcgtgcttaacacatgcaagtcgaacgaagcatctcgcccgatgaagtggagtgcttgcacaaagcggattcaattgagatgactgagtggcggacgggtgagtaacgcgtgggtaacctacccttatcagggggataacagttggaaacagctgctaataccgcataagcgcacagtatcgcatgatacagtgtgaaaagctccgacggataaggatggacccgcgtctgattagctagttggtgaggtaacggctcaccaaggcgacgatcagtagccgacctgagagggtgatcggccacattgggactgagacacggcccaaactcctacgggaggcagcagtggggaatattgcacaatgggcgaaagcctgatgcagcgacgccgcgtgagtgatgaagtatttcggtatgtaaagctctatcagcagggaagaataatgacggtacctg

SEQ ID NO: 1611 - DNA, 490 bp, Unknown
  Ascusbbf_503613, encodes 16S rRNA
agagtttgatcctggctcaggatgaacgctggcggcgcacataagacatgcaagtcgaacgaacttaatcgaaagtttacttttgaagcggttagtggcggactggtgagtaacacgtaagcaacctgcctatcagaggggaataacagtgagaaatcattgctaataccgcatatgctcacagtaccacatggtacagtgaggaaaggagcaatccgctgatagatgggcttgcgtctgattagatagttggtggggtaacggcctaccaagtcgacgatcagtagccggactgagaggttgaacggccacattgggactgagatacggcccagactcctacgggaggcagcagtcgggaatattgcgcaatggaggaaactctgacgcagtgacgccgcgtgcaggaagaaggttttcggattgtaaactgctttagttaaggaagatacaagacagtacttaaagaataagcaccggctaactatgt

SEQ ID NO: 1612 - DNA, 490 bp, Unknown
  Ascusbbf_1358092, encodes 16S rRNA
agagtttgatcatggctcaggatgaacgctggcggcgtgcctaacacatgcaagtcgaacggggttaaggaaaattttcggatagaacttaacttagtggcggacgggtgagtaacgcgtggataacctgcctcgcacagggggatagcagctggaaacggctgataataccgcataagactacagcaccgcctggtgcagcagtaaaagatttatcggtgcgagatggatccgcgtctgattagccagttggcggggtaacggcccaccaaagcgacgatcagtagccggcctgagagggtgaacggccacattgggactgagacacggcccaaactcctacgggaggcagcagtggggaatattgcacaatgggcgcaagcctgatgcagcaacgccgcgtgagtgaagaagtatttcggtatgtaaagctctatcagcagggaagaaaggccctttaagggagatgacggtagctgactaagaagcc

SEQ ID NO: 1613 - DNA, 490 bp, Unknown
  Ascusbbf_307552, encodes 16S rRNA
agagtttgatcctggctcaggatgaacgctagctacaggcttaacacatgcaagtcgaggggcagcatggtggtagcttgctaccaccgatggcgaccggcgcacgggtgagtaacacgtatccaacctgcccatgacccggggatagccctctgaaaggaggattaatacccgatacggtgcgagtgggacatcccgctcttaccaaagattcatcggtcacggatggggatgcgtctgattagcttgtcggcggggtaacggcccaccgaggctacgatcagtaggggttctgagaggaaggtcccccacataggaactgagacacggtcctaactcctacgggaggcagcagtgaggaatattggtcaatggtcgaaggactgaaccagccaagtagcgtgaaggatgactgccctacgggttgtaaacttcttttatgcgggaataaagtgtggcacgcgtgccattttgcatgtaccgcatgaat

SEQ ID NO: 1614 - DNA, 490 bp, Unknown
  Ascusbbf_182992, encodes 16S rRNA
agagtttgatcatggctcaggacgaacgctggcggcgtgcctaacacatgcaagtcgaacgagaaatacagaaggaagttcttcgggacggacggaagtatggacagtggcggacgggcgagtaacgcgtgagtaacctgcccataagagcgggatagccgatggaaacgtcgagtaataccgcatgacatatatctatcgcatgataaatatatcaaagaattatcgcttatggatggactcgcgtcagattagatagttggagaggtaacggctcaccaagtcgacgatctgtagccgaactgagaggttgatcggccgcattgggactgagacacggcccagactcctacgggaggcagcagtggggaatattgcgcaatggggggaaccctgacgcagcaacgccgcgtgcaggaagaaggtcttcggattgtaaactgttgtcgcaggggaagaagaaagtgacggtaccctgtgagaaagtcac

SEQ ID NO: 1615 - DNA, 490 bp, Unknown
  Ascusbbf_459233, encodes 16S rRNA
agagtttgatcctggctcaggacgaacgctggcggcgtgcttaacacatgcaagtcgagcggagtcatgatgaaagcttgctggattcatgacttagcggcggacgggtgagtaacgcgtgagcaatctgtcccatacagggggataataccgcgaaagtggttctaataccgcatgagaccacggcgaggcatctcgttgaggtcaaaggagcaatccggtatggggtgagctcgcgtccgattagatagtaggtgaggtaacggcccacctagtcgacgatcggtagccgacctaagagggtgatcggccacattgggactgagacacggcccagactcctacgggaggcagcagtggggaatattgggcaatgggggaaaccctgacccagcaacgccgcgtggaggaagaaggtcttcggatcgtaaactcctgtcctacaggaagaggagaagactgtactgtaggaggaagccccggctaacta

SEQ ID NO: 1616 - DNA, 470 bp, Unknown
  Ascusbbf_640935, encodes 16S rRNA
agagtttgatcatggctcagaacgaacgctggcggcaggcttaacacatgcaagtcgaacgcatccttcggggtgagtggcagacgggtgagtaacacgtgggaacgtacctttcagttcggaataacccagggaaacttgggctaagaccggatacgcccttttggggaaagatttatcgctgagagatcggcccgcgtctgattagctagttggtgaggtaaaggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcgtccgggacgataatgacggtaccggaagaagaagccccggctaacttcgtgccagcagccgcggtaat

SEQ ID NO: 1617 - DNA, 490 bp, Unknown
  Ascusbbf_356125, encodes 16S rRNA
agagtttgatcatggctcaggacgaacgctggcggcgtgcctaacacatgcaagtcgaacggatttacagagaagcttgcttttttgtaaattagtggcggacgggtgagtaacgcgtgagtaacctgccttaaagagggggataacaccaagaaattggtgctaataccgcataaaatacgagcaccgcatgatgcttgtatcaaaggagcaatccgctttaagatggactcgcgtccgattagctagttggtgagataaaagcccaccaaggcgacgatcggtagccgggttgagagactgaacggccacattgggactgagacacggcccagactcctacgggaggcagcagtgggggatattgcacaatgggcgaaagcctgatgcagcaacgccgcgtgagggaagaaggttttcggattgtaaacctctgtccaaagggaagaaaaaaatgacggtacctttggaggaagctccggctaactac

SEQ ID NO: 1618 - DNA, 490 bp, Unknown
  Ascusbbf_328174, encodes 16S rRNA
agagtttgatcctggctcaggacgaacgctggcggcgtggattaggcatgcaagtcgagcgatatcttaccttcgggtaagtgaaagcggcgaacgggtgagtaacacgtgaacaacctgccctcacattccggataatagaccgaaaggtcttgtaatacgggcgaggattcctcttaggcatcttagaggaagggaaggcgcaagccgtgcgaggaggggttcgcggattatcaggtagttggtggggtaacggcctaccaagcctacgacgattagctggtctgagaggatggtcagccacactgggactgagacactgcccagactcctacgggaggctgcagtcgagaatcttgcacaatgcgcgaaagcgtgatgcagcgacgccgcgtgaaggatgaaggcccttgggtcgtaaacttcttttatcggggaagaattcatgacggtacccgatgaataagccacggctaactacgtgccagca

SEQ ID NO: 1619 - DNA, 490 bp, Unknown
  Ascusbbf_1603295, encodes 16S rRNA
agagtttgatcctggctcaggatgaacgctagctacaggcttaacacatgcaagtcgaggggcagcataaggtttgcttgcaaaccttgatggcgaccggcgcacgggtgcgtaacgcgtatccaaccttccccgcagtagggtccagcccgttgaaagacggattaatcccctatgttgtccattgacggcatccgatttggacgaaaggttttctccgctgcgggatggggatgcgtaggattagctggtcggcggggtaacggcccaccgaggctacgatccttaggggttctgagaggaaggtcccccacactggaactgagacacggtccagactcctacgggaggcagcagtgaggaatattggtcaatggaggcaactctgaaccagccaagtagcgtacaggacgacggccctacgggttgtaaactgcttttgcacagggataaacccggccacgcgtggccgtttgcaggtactgtgcga

SEQ ID NO: 1620 - DNA, 490 bp, Unknown
  Ascusbbf_202880, encodes 16S rRNA
agagtttgatcctggctcaggacgaacgctggcggcgtgcttaacacatgcaagtcgagcgagagagatgtcttcggacatcaatctagcggcggacgggtgagtaacacgtgggcaacctgccttagtgagggggatagccttccgaaaggaagattaataccgcataaagtagtatttacacatgtagatattaagaaaggagtaatccgcactaagatgggcccgcggcgcattagctagttggagaggtaacggctcaccaaggcaacgatgcgtagccgacctgagagggtgaacggccacattggaactgagagacggtccagactcctacgggaggcagcagtggggaatattgcacaatggaggaaactctgatgcagcaacgccgcgtgagtgaagaaggtcttcggattgtaaagctctgttaatcgggacgaaaaatgacggtaccgatagaggaagccacggctaactacgtgccagc

SEQ ID NO: 1621 - DNA, 490 bp, Unknown
  Ascusbbf_295965, encodes 16S rRNA
agagtttgatcctggctcaggatgaacgctagcggcaggcttaacacatgcaagtcgaggggcagcggggtgtagcaatacactgccggcgaccggcgcacgggtgcgtaacgcgtatgcaacctgcccgtaacagggggataactcggggaaacccgaactaataccccgtattgacgtggggccgcatggttctgcgacgaaagcttcggtggttacggatgggcatgcgtggcattaggtagttggcggggcaacggcccaccaagccgacgatgtctaggggagctgagaggcttatcccccacactggtactgagacacggaccagactcctacgggaggcagcagtgaggaatattggtcaatggacggaagtctgaaccagccatgccgcgtgaaggaagaatgccctatgggttgtaaacttcttttgccgcagagtaataaggggcgtgcgcgccccgatgagagtatgcggcgaataagc

SEQ ID NO: 1622 - DNA, 490 bp, Unknown
  Ascusbbf_193901, encodes 16S rRNA
agagtttgatcatggctcagaacgaacgctggcagtatgctttaaccatgcaagtcgaacgagaaagtgtagcaatacataagtaaagtggcaaacgggtgagtaacacacaggaatctacccagtagagaggaataagcactagaaatggtgtctaatacctcataagccaatgtagtaaaatatattgggaaaggattggtagcaatattaattcactattggatgagcctatggcggattagctagttggtagggtaatggcctaccaaggcaatgatccgtagctggtctgagaggatgatcagccacattgaaactgcgatacggttcaaactcctacgggaggcagcaggtgggaatattggacaatggacgaaagtctgatccagcaatactgcgtgaatgatgaaggcctttgggttgtaaagttcttttaatagggaagataatgactgtacctatagaataagtaccggcaaacttcgtg

SEQ ID NO: 1623 - DNA, 490 bp, Unknown
  Ascusbbf_739192, encodes 16S rRNA
agagtttgatcctggctcaggatgaacgctggcggcgtgcctaacacatgcaagtcgaacgaggctcttctctcagacgtttcgaccgaagagagaggatcaccgagtggcggatgggtgagtaacgcgtggagtacctgcccctgtcagggggataacagccggaaacagctgacaataccgcatagagtacttgatcgcatgttcgagtacggaaagatttatcggacagggatggctccgcgttggattagctcgttggtggggtaacggcctaccaaggcgacgatccatagccggcctgagagggcgaccggccacattgggactgagacacggcccagactcctacgggaggcagcagtggggaatattgcacaatgggcgcaagcctgatgcagcgacgccgcgtggaggaagaagtatttcggtatgtaaactcctatcagcagggaagaaaatgacggtacctgactaagaagccccggct

SEQ ID NO: 1624 - DNA, 490 bp, Unknown
  Ascusbbf_737999, encodes 16S rRNA
agagtttgatcatggctcaggacgaacgctggcggcgtgcctaacacatgcaagtcgaacggagtgttttgctgaaaggaaggaagcttgcttccggatattcttaaaacacttagtggcggactggtgagtaacgcgtgagcaacctgccttacagagggggacaacagttggaaacgactgctaataccgcataaagtctgaccttggcatcgaggacagaccaaaggagcaatccgctgtaagatgggctcgcgtccgattagatagttggtgaggtaacggctcaccaagtcgacgatcggtagccggactgagaggttgaacggccacattgggactgagatacggcccagactcctacgggaggcagcagtgggggatattgcacaatggaggaaactctgatgcagcaacgccgcgtgagggaagaaggttttcggattgtaaacctctgttttaagtgacgaaacaaatgacggtagcttaa

SEQ ID NO: 1625 - DNA, 490 bp, Unknown
  Ascusbbf_1689279, encodes 16S rRNA
agagtttgatcctggctcaggatgaacgctggcggcgtgcctaacacatgcaagtcgaacggggtattgacgctgaagagagaagtagcttgctacggatcgaatcatgttgatacttagtggcggacgggtgagtaacgtgtggataacctggtccatccagggggatagcagctggaaacggctgataataccgcataagcgcacggaagggcatccttctgtgtgaaaagatttttcgggatggaatggatccgcatctgattagccagttggcgggatagaagcccaccaaagcgacgatcagtagccggcctgagagggcggacggccacattgggactgagaaacggcccagactcctacgggaggcagcagtgggggatattgcacaatggggggaaccctgatgcagcgacgccgcgtgggtgaagaagtatttcggtatgtaaagccctatcagcagggaagataatgacggtacctgagt

SEQ ID NO: 1626 - DNA, 490 bp, Unknown
  Ascusbbf_735819, encodes 16S rRNA
agagtttgatcctggctcaggacgaacgctggcggcgtgcctaacacatgcaagtcgaacggagtgattcgaaagcttgcttttgaatcacttagtggcggacgggtgagtaacgcgtgagtaacctgcctttcagagggggataacatcctgaaaaggatgctaataccgcataacatatcgaggccgcatggtcttggtatcaaaggagcaatccgctgagagatggactcgcgtccgattagccagttggcggggtaacggcccaccaaagcgacgatcggtagccggactgagaggttgaacggccacattgggactgagacacggcccagactcctacgggaggcagcagtgggggatattgcacaatggaggaaactctgatgcagcaacgccgcgtgagggaagaaggtcttcggattgtaaacctttgtccttggtgacgaaacaaatgacggtagccaaggaggaagctccggctaactac

SEQ ID NO: 1627 - DNA, 490 bp, Unknown
  Ascusbbf_155684, encodes 16S rRNA
agagtttgatcatggctcaggatgaacgctggcggcgtgcttaacacatgcaagtcgaacgaagcatttcggaatgcggctatgccaaatgaagatctgacttagtggcggacgggtgagtaacgcgtgggtaacctgccttgtactgggggataacagttagaaatgactgctaataccgcataagcccacggtttcgcatggaactgtgagaaaagatttattgatacaagatggacccgcgtctgattagctagttggcgaggtaacggcccaccaaggcgacgatcagtagccgacctgagagggtgatcggccacattgggactgagacacggcccaaactcctacgggaggcagcagtggggaatattgcacaatgggggaaaccctgatgcagcgacgccgcgtgagtgaagaagtatttcggtatgtaaagctctttaagcagggaagataatgacggtacctgcagaataagcaccggcta

SEQ ID NO: 1628 - DNA, 490 bp, Unknown
  Ascusbbf_1735273, encodes 16S rRNA
agagtttgatcatggctcaggattaacgctggcggcgtgcctaacacatgcaagtcgagcgagaaatggtgaagagattcttcggatgaacagatccatggacagcggcggacgggtgagtaacgcgtgggcaacctgcccctttccggaggatagccaagggaaactttgaataatactccataaagcagagacaccgcatgatgattctgccaaagatttatcggagagggatgggcccgcgtctgattagccagttggtgaggcagcggctcaccaaagcgacgatcggtagccggcctgagagggtgaacggccacattggaactgagacacggtccagactcctacgggaggcagcagtggggaatattgcacaatgggcggaagcctgatgcagcaacgccgcgtgaaggatgaaggttttcggatcgtaaacttctgtccctggggaagaagaaagtgacggtacccggggaggaagccccgg

SEQ ID NO: 1629 - DNA, 490 bp, Unknown
  Ascusbbf_741617, encodes 16S rRNA
agagtttgatcatggctcaggacgaacgctggcggcgtgcttaacacatgcaagtggtgcgacgaaccagggcttgccctggggcaaagccgcgaacgggtgagtaacacgtgggtaatctgccccgatgaccgggacaacccgaggaaactcgggctaataccggatgtggtgcactggcataagccggtgtactaaaggaagcttcggcctccgcattgggaggtgcccgcggcccattagcttgttggtggggtaatggcctaccaaggcaacgatgggtagctggtctgagaggacgatcagccacactgggactgagacacggcccagactcctacgggaggcagcagtggggaatcttgcgcaatgcgcgaaagcgtgacgcagcaacgccgcgtgggggaagacggccttcgggttgtaaacccctttcaggagggacgaaggttcgccggtgaatagccgtgcggattgacggtacctccac

SEQ ID NO: 1630 - DNA, 490 bp, Unknown
  Ascusbbf_287794, encodes 16S rRNA
agagtttgatcatggctcagattgaacgctggcggcgtgcttaacacatgcaagtcgagcggtaacaggtgtagcaatacatgctgacgagcggcgaacgggtgagtaatgcttaggaatcttcctcgtagtggggaataacttggggaaactcaagctaataccgcatacgaactacggttgaaagcgggggatcgcaagacctcgcgctatgagatgagcctaagtcggattagctagttggtggggtaatggcctaccaaggcgacgatccgtagctggtctgagaggacgaccagccacactgggactgagacacggcccagactcctacgggaggcagcagtggggaatattggacaatgggggaaaccctgatccagcgacgccgcgtgtgtgaagaaggcctgcgggttgtaaagcacttttagtggggatgaaaagcgcaaggttaatacctttgcgtcttgacctaacctacagaaaaagc

SEQ ID NO: 1631 - DNA, 490 bp, Unknown
  Ascusbbf_151916, encodes 16S rRNA
agagtttgatcatggctcaggacgaacgctggcggcgtgcctaatacatgcaagtcgagcgagtcccttcgggggctagcggcggacgggtgagtaacacgtaggcaacctgcccgtaagctcgggataacatggggaaactcatgctaataccggatagggtcttctctcgcatgagaggagacggaaaggtggcgcaagctaccacttacggatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgtcagagacgaacaagtaccgttcgaacagggcggtaccttgacggtacctgacgagaaagcc

SEQ ID NO: 1632 - DNA, 490 bp, Unknown
  Ascusbbf_1807490, encodes 16S rRNA
agagtttgatcctggctcaggatgaacgctggcggcgtgcctaatacatgcaagtcgagcgagaagctttcgagaagattcttcggatgattcatgaaagtggaaagcggcggacgggtgagtaacgcgtaggcaacctgccccttgcacagggatagccattggaaacgatgattaatacctgataaagccggaccatagccttatggatcggccaaagatttatcggcgagggatgggcctgcgtctgattagctagttggtggggtaacggcctaccaaggcgacgatcagtagccgacctgagagggtgatcggccacattggaactgagacacggtccaaactcctacgggaggcagcagtagggaatcttgcacaatgggcgcaagcctgatgcagcaacgccgcgtgagcgatgaaggcccttgggtcgtaaagctctgtcctatgggaagaagaaagtgacggtaccattggaggaagcccc

SEQ ID NO: 1633 - DNA, 490 bp, Unknown
  Ascusbbf_366270, encodes 16S rRNA
agagtttgatcatggctcaggatgaacgctggcggcgtgcttaacacatgcaagtcgaacggaacacctttccggatccttcgggtgacgggctggtgtttagtggcggacgggtgagtaacgcgtgggtaacctgccctgtacagggggataacagccagaaatggctgctaataccgcatgagcgcacgagagggacatccctcggtgtgaaaaactccggtggtacaggatgggcccgcgtctgattagcttgttggcggggtaacggcccaccaaggcgacgatcagtagccggtctgagaggatgaacggccacattggaactgagacacggtccaaactcctacgggaggcagcagtggggaatattgcacaatggggggaaccctgatgcagcaacgccgcgtgagtgaagaagtatttcggtatgtaaagctctatcagcagggaagataatgacggtacctgaccaagaagctccggctaa

SEQ ID NO: 1634 - DNA, 490 bp, Unknown
  Ascusbbf_369206, encodes 16S rRNA
agagtttgatcctggctcagaatgaacgttggcggcgtggattaggcatgcaagtcggacgagaagtttccttcgggaaacggaaagtggcaaacggggtagtaaggcgtaggtgacgtaccctcaggttcgggatagccacgggaaaccgtgattaataccgaatgatctctttttgtatggtgcattaagagcaaaggtgtgattccgccagaggagcggcttacgtgatattaggtagttggtgaggtaatggctcaccaagccttagatgtctagggggtgtgagagcatggcccccaccactgggactgagacactgcccagacacctacgggtggctgcagtcgagaatcttcggcaatggacgcaagtctgaccgagcgacgccgcgtgcgggatgaaggcccttgggttgtaaaccgctgtcagaggggatgaaatgcagaagggttatcccttttgtttgacagagcctcagaggaagcac

SEQ ID NO: 1635 - DNA, 490 bp, Unknown
  Ascusbbf_217627, encodes 16S rRNA
agagtttgatcctggctcaggacgaacgctggcggcgtgcctaacacatgcaagtcgagcggggatacgaggcggaagttttcggatggaagccctgtattcgagcggcggacgggtgagtaacgcgtgagcaacctttccttcacagggggataacacagcgaaagttgtcgtaataccgcataagaccacagcgccgcatggcgcgggggtcaaaggagaaatccggtgaagggtgggctcgcgtccgattagccggttggcggggtaaaggcccaccaaagcaacgatcggtagccgacctgagagggtgatcggccacattggaactgagacacggtccaaactcctacgggaggcagcagtgggaatattgggcaatgggcgaaagcctgacccagcaacgccgcgtgagggaagaaggtcttcgggtcgtaaacctctgtcctcagtgaagagaaggagacggtagctgaggaggaagccccgg

SEQ ID NO: 1636 - DNA, 490 bp, Unknown
  Ascusbbf_1794843, encodes 16S rRNA
agagtttgatcctggctcagaacgaacgctggtagcgtggattaggcatgcaagtcgaacgggatcgcccggttagcaataattgggcgtgagagtggcggattggggaggaacacgtgagcaacctgtccttgagtggtggaaaacctcgggaaactgaggctaatacagcatgtggcgcccggagacatctccggagcgtcaaagggggccgcaaggctctcgctcatcgaggggctcgcgcaccatcagcttgttggcggggtaacggcccaccaaggcctacggttagctggtctgggaggatgaccagccccactgggactgagatactgcccagactcctacgggaggctgcagtcgaggatcatttgcaatgggcgaaagcctgacaatgcgacgctgcgtggaggatgaaggccttcgggttgtaaactcctgtcatgagggaacaggcgagggtacccaacacgtaccttagttgagtgta

SEQ ID NO: 1637 - DNA, 353 bp, Unknown
  Ascusbbf_1539399, encodes 16S rRNA
agagtttgatcctggctcagaacgaacgctggcggcgcgttttaagcatgcaagtcgagcggcagcagcaatgcgagagcggcggacgggtgagtaacacgtgggtaatctgccctccggtcgggaatagcctgtggaaacacaggataataccggatgcgatggccaccacacaagtggaggacaggaaaggagccaaggctccgccggaggatgagcccgcgtcccattagcttgatggtgaggtaaaggcccaccatggcgatgatgggtagccggcctgagagggtgaacggccacattggaactgagacacggtccagactcctacgggagccagcagccgcggtaat

SEQ ID NO: 1638 - DNA, 490 bp, Unknown
  Ascusbbf_1624038, encodes 16S rRNA
agagtttgatcctggctcaggatgaacgctggcggcgtgcctaatacatgcaagtcgtgcgggggaagatccttcgggatcggacccagcggcgaacgggtgagtaacacgtgggcaatctgcccgcaagacggggataactccgggaaaccggtgctaatacccgataatcccggctcccgcatgggagcggggtgaaaggcggcttcggctgtcacttgcggatgggcccgcggcgcattagctggttggtgaggtaacggctcaccaaggcgacgatgcgtagccgacctgagagggtgatcggccacactgggactgagacacggcccagactcctacgggaggcagcagtagggaattttccgcaatgggcgcaagcctgacggagcaacgccgcgtgagtgaggacggccttcgggttgtaaaactctgttcttgaggaagaacccttccgaggcgaacagcctcggaagttgacggtactcaa

SEQ ID NO: 1639 - DNA, 490 bp, Unknown
  Ascusbbf_1732737, encodes 16S rRNA
agagtttgatcatggctcaggataaacgctggcggcgtgcttaacacatgcaagtcgaacggagtggtcctcccgaagcgtgacgaagcttgcttctgaacaattcatttggatcacttagtggcggacgggtgagtaacgcgtgggtaacctgccctatactgggggatagcagttggaaacgactgataataccgcataagcatacactttcgcatgaaagagtgtgaaaaactccggtggtataggatggacccgcgtctgattagctagttggtgaggtaacggcccaccaaggcgacgatcagtagccggcctgagagggtgtacggccacattgggactgagacacggcccaaactcctacgggaggcagcagtggggaatattggacaatgggggaaaccctgatccagcgacgccgcgtgagcgaagaagtatttcggtatgtaaagctctatcagcagggaagaaaatgacggtacctgac

SEQ ID NO: 1640 - DNA, 490 bp, Unknown
  Ascusbbf_1589259, encodes 16S rRNA
agagtttgatcctggctcaggatgaacgctggcggcacgcttaacacatgcaagtcgaacgaggttatgaacttcggttaataacctagtggcggacgggtgcgtaacgcgtggtaatctgcccttgacagggggataacgtatagaaatgtacgctaataccgcataagcccacggaaccgcatggttctgagggaaaagggtcactggtcaaggatgagcccgcgtctgattaggtagttggcagggtaaaggcctaccaagcccgcgatcagtagccggtctgagaggatggacggccacattgggactgagacacggcccaaactcctacgggaggcagcagtggggaatattgcacaatgggggaaaccctgatgcagcgatgccgcgtgaaggatgaagtgtttcggcacgtaaacttctatcagcaaggaagaatgaagacagtacttgaataagcagccccggctaactacgtgccagcagc

SEQ ID NO: 1641 - DNA, 490 bp, Unknown
  Ascusbbf_1763013, encodes 16S rRNA
agagtttgatcatggctcaggatgaacgctggcggcgtgcttaacacatgcaagtcgaacgaagaggtgctaaaggaggggcttcggctctgaattcggcacatatcttagtggcggacgggtgagtaacgcgtgggcaacctgccctttacaggggaataatcattggaaacgatgactaataccgcatgtccccgagaaatggcatcatttttcggaaaaaggagaaatccggtaaaggatgggcccgcgtctgattagctggttggtggggtaacggcctaccaaggcgacgatcagtagccgacctgagagggtgatcggccacattgggactgagacacggcccaaactcctacgggaggcagcagtggggaatattgcacaatggggggaaccctgatgcagcaacgccgcgtgaaggaagaaggttttcggatcgtaaacttctatcaatagggacgaagaaagtgacggtacctaaataaga

SEQ ID NO: 1642 - DNA, 490 bp, Unknown
  Ascusbbf_810834, encodes 16S rRNA
agagtttgatcctggctcaggatgaacgctggcggcgtgcctaacacatgcaagtcgaacgaggttacttatcttggagattcgtcaaagagatttttaaccgagtggcggatgggtgagtaacgcgtggagaacctgcccttgtcagggggataacaactggaaacggttgacaataccgcatacgctctttaagtcgcatgacccaaagaggaaagatttatcggacaaggatggctccgcgtcggattagccagttggcggggtaacggcccaccaaagcgacgatccgtagccggcctgagagggcgaccggccacattgggactgagacacggcccagactcctacgggaggcagcagtgggggatattgcacaatggggggaaccctgatgcagcgacgccgcgtggaggaagaagtatttcggtatgtaaactcctatcagcagggaagaaaatgacggtacctgactaagaagccccggcta

SEQ ID NO: 1643 - DNA, 490 bp, Unknown
  Ascusbbf_1736001, encodes 16S rRNA
agagtttgatcctggctcagattgaacgctggcggcaggcttaacacatgcaagtcgaacgatgattactagcttgctagtaagattagtggcgaacgggtgagtaaagcttaggaatctgccgtgtagtgggggacaactaaccgaaaggttagctaataccgcatacgccctacgggggaaagcatgggatcttaggaccatgcgctatacgatgagcctaagtcggattagctagttggtggggtaaaggcctaccaaggcgacgatctgtagcgggtcttagaggatgatccgccacactgggactgagacacggcccagactcctacgggaggcagcagtggggaatattggacaatggggggaaccctgatccagccatgccgcgtgtgtgaagaaggtcgtaagattgtaaagcactttaagcgaggaggaaagggcgttggttaatagctagcgtctgtgacgttactcgcagaataagcac

SEQ ID NO: 1644 - DNA, 490 bp, Unknown
  Ascusbbf_1477679, encodes 16S rRNA
agagtttgatcatggctcaggacgaacgctggcggcgtgcctaatacatgcaagtcgagcgaatgacgagaagcttgcttctctgatttagcggcggacgggtgagtaacacgtgggcaacctgccctacagatcgggataactcagggaaacctgggctaataccggataatccttcgaatcacatgttttgaagttgaaaggcgcttcggcgtcactgtaggatgggcccgcggtgcattagctagttggtggggtaacggcctaccaaggcaacgatgcatagccgacctgagagggggatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaacaagtacgttaggaaatgaacgtaccttgacggtaccttat

SEQ ID NO: 1645 - DNA, 490 bp, Unknown
  Ascusbbf_259343, encodes 16S rRNA
agagtttgatcctggctcaggatgaacgctggcggcgtgcataacacattcaagtcgaacggtgaagggacttcggtcccggatcagtggcggacgggtgagtaacgcgtgagcaacctgccctgcagtgcgggataacagagggaaacttctgctaataccgcatatagcatcggaaccgcatgattccggtatgaaagatttattgctgcaggatgggctcgcgtctgattagatagttggcggggtaacggcccaccaagtctacgatcagtagccggactgagaggttgaacggccacattggaactgagatacggtccagactcctacgggaggcagcagtggggaatattgggcaatgggcgaaagcctgacccagcgacgccgcgtgaaggaagaaggtcttcggattgtaaacttctgttaaccagggacgaaacaaatgacggtacctggagagaaagccacggctaactacgtgccagca

SEQ ID NO: 1646 - DNA, 490 bp, Unknown
  Ascusbbf_981679, encodes 16S rRNA
agagtttgatcatggctcaggatgaatgctggcggcgtgcctaatacatgcaagtcgagcggtaacagggcttcaccgtgttcttgacgcacttggccattgagcaagtagttgaattcgagagcacagtgaagctgctgacgagcggcggacggctgagtaacgcgtgggaacggaccccaaactgagggataactactcgaaagagtagctaataccgcatgtgatcttcggattaaagcttttgcggtttgggactggcctgcgtacgattagatagttggtagggtaatggcctaccaagtcgacgatcgttagatggtttgagaagatgatcatccagactgggactgagacacggcccagactcctacgggaggcagcagtagggaatctttcacaatgggcgaaagcctgatggagcaacgccgcgtgcaggatgacggccttcgggttgtaaactgcttttataaccgagaaatatgatggt

SEQ ID NO: 1647 - DNA, 490 bp, Unknown
  Ascusbbf_731606, encodes 16S rRNA
agagtttgatcatggctcaggatgaacgctagctacaggcttaacacatgcaagtcgaggggcatcaggggactagcttgctagtcctgctggcgaccggcgcacgggtgagtaacacgtatccaacctgcccccagcttggggatagccctctgaaaggaggattaatacccgatatgcttgttctccggcatcggaggacaatcaaagattcatcggctgtggatggggatgcgtctgattagcttgttggcggggtaacggcccaccaaggcgacgatcagtaggggttctgagaggaaggtcccccacataggaactgagacacggtcctaactcctacgggaggcagcagtgaggaatattggtcaatgggcgagagcctgaaccagccaagtagcgtgaaggatgactgccctacgggttgtaaacttcttttatgggaggataaagtgggtcacgtgtggccctttgcaggtatcccatgaat

SEQ ID NO: 1648 - DNA, 487 bp, Unknown
  Ascusbbf_1060647, encodes 16S rRNA
agagtttgatcctggctcagaacgaacgctggcggcaggcttaacacatgcaagttgaacgggattcaatttgtgcttgcacgagttgatgagagtagcgcactggtgagtaacacgtgggaacgtacattttggtggggaacaacagagggaaacttctgctaataccgcataagccctgagggggaaagatttatcgccgagatatcggcccgcggaagattaggtagttggtggggtaaaggcctaccaagcctacgatctatagctggtctgagaggacgatcagccacattggaactgagacacggtccagactcctacgggaggcagcagtgaggaatattgggcaatggagggaactctgacccagccatgccgcgtgagtgagaaggttttcgaattgtaaagctctttcgggtgtgaagatgatgacggtaacaccagaagaagccccggcaaacttcgtgccagcagccgcggtaat

SEQ ID NO: 1649 - DNA, 490 bp, Unknown
  Ascusbbf_733925, encodes 16S rRNA
agagtttgatcctggctcaggatgaacgctggcggcgtgcttaacacatgcaagtcgaacggacttgttcaattggaaacggaagatgcttgcatacgaagtttccgcccgaacaagttagtggcggacgggtgagtaacgcgtggagaacctgcctttatctgggggataacagttagaaatgactgctaataccgcataagcgcacatggtcgcatggccgagtgtgaaaaactccggtggatagagatggctccgcgtcagattagccagttggcggggtaacggcccaccaaagcgacgatctgtagccggcctgagagggcgatcggccacattgggactgagacacggcccaaactcctacgggaggcagcagtggggaatattgcacaatgggggaaaccctgatgcagcgacgccgcgtgagtgatgacgtatttcggtatgtaaagctctatcagcagggaagataatgacggtacctgac

SEQ ID NO: 1650 - DNA, 490 bp, Unknown
  Ascusbbf_1524564, encodes 16S rRNA
agagtttgatcatggctcaggacgaacgctggcggcgcgcctaacacatgcaagtcgaacggagctgatattgacagcgacttcggtcaaaggagatttcagcttagtggcgaacgggtgagtaacgcgtgagtaacctgcctcagagagggggacaacagttggaaacgactgctaataccgcataagcccacactgcctcatggcagagtgagaaaaggggattaccgctttgagatggactcgcgtctgattagccagttggcggggtaacggcccaccaaagcgacgatcagtagccggactgagaggctgatcggccacattgggactgagacacggcccagattcctacgggaggcagcagtggggaatattgcacaatggggggaaccctgatgcagcgacgccgcgtggaggaagaaggtattcgtattgtaaactcctgtcgtgtgggacgaagaatgacggtaccacacaagaaagcacc

SEQ ID NO: 1651 - DNA, 490 bp, Unknown
  Ascusbbf_1438428, encodes 16S rRNA
agagtttgatcatggctcaggatgaacgctggcggcgtgcttaacacatgcaagtcgaacgaagctcttacgacagatctcttcggagtgaagatgtttgagactgagtggcggacgggtgagtaacgcgtgggtaacctgcctcatagagggggacaacagttggaaacgactgctaataccgcatagtaagaaagaaccgcatgattttttcttgaaagcttttgcgctatgagatggacccgcgtctgattagctagttggtaaggtaacggcttaccaaggcaacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcaggaaagataatgacggtacctgactaagaagccccgg

SEQ ID NO: 1652 - DNA, 490 bp, Unknown
  Ascusbbf_1777365, encodes 16S rRNA
agagtttgatcatggctcaggatgaacgctggcggcgtgcctaacacatgcaagtcgaacggttaaaccgccctcgggcggaaataaagtggcgaacgggtgagtaacacgtgaccaacctgccccctccaccgggacagccccgcgaaagcgcggttaataccggatactccgggcgcggcgcatgccgggcccgggaaagccctggcgggaggggatggggtcgcggcccatcaggtagtaggtcgggcagcggccgacctagccgacgacgggtagccgggttgagagaccgaccggccacattgggactgagatacggcccagactcctacgggaggcagcagtggggaatattgcgcaatgggggcaaccctgacgcagcaacgccgcgtgcgggaagaaggcgtccgcgtcgtaaaccgctttcagcagggaagacatcgacggtacctgcagaagaagccccggctaactacgtgccagcagc

SEQ ID NO: 1653 - DNA, 490 bp, Unknown
  Ascusbbf_1724539, encodes 16S rRNA
agagtttgatcctggctcaggatgaacgctggcggcgtgcctaacacatgcaagtcgagcggagatattgggaagatctttcgagtgaatccccttatcttagcggcggatgggtgagtaacacgtgggtaacctgccctgcacagggggataacagctggaaacggctgttaataccgcatatgcacacgctgccgcatggcagggggtggaaagatttatcggtgcaggatgggcccgcgtcggattaactagttggcagggtaacggcctaccaaggtgatgatccgtagccgacctgagagggtgaccggccacattgggactgagacacggcccaaactcctacgggaggcagcagtgggggatattgcacaatgggcgcaagcctgatgcagcgacgccgcgtgaaggaagaagtatttcggtatgtaaacttctatcagcggggaagaagatgacggtacccgactaagaagccccggctaac

SEQ ID NO: 1654 - DNA, 490 bp, Unknown
  Ascusbbf_1779887, encodes 16S rRNA
agagtttgatcctggctcaggatgaacgctggcggcgtgcttaacacatgcaagtcgaacggagtttaaaatgaagcttgcgatttttaaacttagtggcggacgggtgagtaacgcgtgggtaacctgccttataccgggggataacacttagaaataggtgctaataccgcataagcgcacagcttcgcatgaagcagtgtgaaaaactccggtggtataagatggacccgcgtctgattagctggttggtgaggtaacggcccaccaaggcgacgatcagtagccggcctgagagggtgaacggccacattggtactgagacacggcccaaactcctacgggaggcagcagtggggaatattggacaatgggggaaaccctgatccagcgacgccgcgtgagtgaagaagtatttcggtatgtaaagctctatcagacgggaagatgatgacggtaccgtcagaagaagcaccggctaacttcgtgc

SEQ ID NO: 1655 - DNA, 490 bp, Unknown
  Ascusbbf_1823703, encodes 16S rRNA
agagtttgatcatggctcaggacgaacgctggcggcgtgcctaacacatgcaagtcgagcggagacatggggaatggagacttcggtcaaaaggaaccatgttttagcggcggacgggtgagtaacgcgtgagcaatctgtccttcacaggggaataagataccgaaaggtgttctaataccgcataagaccacatattcgcatgaataaggggtcaaaggagcaatccggtgaagggtgagctcgcgtccgattagatagttggtgaggtaacggcccaccaagtcaacgatcggtagccgacctgagagggtgatcggccacattgggactgagacacggcccagactcctacgggaggcagcagtgggaatattgggcaatggggggaaccctgacccagcaacgccgcgtggaggaagaaggtcttcggatcgtaaactcctgtcctaagagacgagcaggagacggtatcttaggaggaagcccc

SEQ ID NO: 1656 - DNA, 490 bp, Unknown
  Ascusbbf_1443290, encodes 16S rRNA
agagtttgatcatggctcaggacgaacgctggcggtgtgcttaatacatgcaagtcgagcggactatgggggcttgctcccatagttagcggcggacgggtgagtaacgcgtgagcaacctgcctgtatctgggggataacacatagaaatgtgtgctaataccgcatatgaccacagtgaggcatctcacagaggtaaaagatttatcggatacagatgggctcgcgttcaattagatagttggtagtgtaacggactaccaagtcgacgattgatagccgacctgagagggtgatcggccacattggaactgagatacggtccagactcctacgggaggcagcagtagggaatattgggcaatggaggcaactctgacccagcaacaccgcgtgaatgatgaaggtcttcggattgtaaagttctgtgatgggggacgaagaaagtgacggtaccccaagagcaagccacggctaactacgtgccagc

SEQ ID NO: 1657 - DNA, 490 bp, Unknown
  Ascusbbf_102933, encodes 16S rRNA
agagtttgatcatggctcaggatgaacgctggcggcgtgcttaatacatgcaagtcgaacgaagcgacccacccgaagattgaagtagcttgctacggattgattcaaccgggttgacttagtggcggacgggtgagtaacgcgtgggtaacctgccttagacagggggataacagttagaaatgactgctaataccgcatatgcgcacagtatcgcatgatacagtgtggaaaacttttgtggtctaagatggacccgcgtctgattagctagttggaggggtaacggcccaccaaggcgacgatcagtagccgacttgagagagtgatcggccacattgggactgagacacggcccaaactcctacgggaggcagcagtagggaatattgcacaatgggggaaaccctgatgcagcgacgccgcgtgaaggatgaagtatttcggtatgtaaacttctatcagcaaggaagaaaatgacggtacttga

SEQ ID NO: 1658 - DNA, 490 bp, Unknown
  Ascusbbf_60761, encodes 16S rRNA
agagtttgatcatggctcaggatgaacgctggcggcgtgcctaacacatgcaagtcgaacgaagcgcctcgcccgacgaagtggagtgcttgcacaaagcagaatcaattgaggcgacttagtggcggacgggtgagtaacgcgtgggtaacctgccgtatgcagggggataacagttagaaatgactgctaataccgcataagcgcacagtatcgcatgatacagtgtgaaaagccttaacggcatacgatggacccgcgtctgattagccagttggcagggtaacggcctaccaaagcgacgatcagtagccggcctgagagggtgaacggccacattgggactgagacacggcccaaactcctacgggaggcagcagtgggggatattgcacaatgggggaaaccctgatgcagcgacgccgcgtgagtgaagaagtatttcggtatgtaaagctctatcagcagggaagaaaatgacggtacctga

SEQ ID NO: 1659 - DNA, 490 bp, Unknown
  Ascusbbf_76049, encodes 16S rRNA
agagtttgatcctggctcaggatgaacgctagctacaggcttaacacatgcaagtcgaggggcagcatgagatcagcttgctgattttgatggcgaccggcgcacgggtgagtaacacgtatccaacctgcccgctactcagggatagccttctgaaaggaagattaatacttgatatatcattatatcacatgttatgatgatgaaagatttatcggtagcggatggggatgcgttccattagcttgttggcggggtaacggcccaccaaggcatcgatggataggggttctgagaggaaggtcccccacattggaactgagacacggtccaaactcctacgggaggcagcagtgaggaatattggtcaatgggcgtaagcctgaaccagccaagtagcgtgaaggatgactgccctatgggttgtaaacttcttttaatcgggaataaagtggtctacgtgtagacttttgtatgtaccgattgaata

SEQ ID NO: 1660 - DNA, 490 bp, Unknown
  Ascusbbf_92106, encodes 16S rRNA
agagtttgatcatggctcaggataaacgctggcggcgtgcataacacattcaagtcgaacggacgatacgagaaacttcggttttttgtaaagttagtggcggacgggtgagtaacgcgtgagcaatctgcctttgatagagggataacacatggaaacgtgtgctaataccgcataacgttaaagaaccgcatgattctttaaccaaagctccggcgatcaaagatgagctcgcgtccgattagctagttggcagggtaaaggcctaccaaggcgacgatcggtagccggactgagaggttgaacggccacattggaactgagaacggtccagactcctacgggaggcagcagtggggaatattgggcaatggaggcaactctgacccagcgacgccgcgtgaaggaagaaggtcttcggattgtaaactttagttatcagggacgaaggaagtgacggtacctgaagagaaagccacggctaactacg

SEQ ID NO: 1661 - DNA, 485 bp, Unknown
  Ascusbbf_6104, encodes 16S rRNA
agagtttgatcctggctcagaacgaacgctggcggcaggcttaacacatgcaagttgaacggtattgtgaggtgcttgcactgagcaagagagtagcgcactggtgagtaacacgtgggaacatgccctaaagtacgggatagcgtctggaaacggacgataatacggtatacgccctgagggggaaagatttatcgctttaggattggcccgcggcagattaggtagtaggtggggtaaaggcctacctagccgacgatctatagctggtctgagaggacgatcagccacattgggactgagacacggcccagactcctacgggaggcagcagtgaggaatattgggcaatggggggaaccctgacccagccatgccgcgtgagtgagaaggtcttcggattgtaaagctctttcggatgtgacgatgatgacggtaacatctaaagaagccccggcaaacttcgtgccagcagccgcggtaat

SEQ ID NO: 1662 - DNA, 490 bp, Unknown
  Ascusbbf_109934, encodes 16S rRNA
agagtttgatcatggctcaggatgaacgctggcggcgtgcctaacacatgcaagtcgagcgagaaacttatgattgacgcttcggtagatttcataagcggaaagcggcggacgggtgagtaacgcgtaggcaacctgccctttgcacagggatagcctcgggaaaccgggattaaaacctgataacaccgaagattcacatgtataatcggtcaaagatttatcggcaaaggatgggcctgcgtctgattagttagttggtgaggtaacggctcaccaaggcaatgatcagtagccgacctgagagggtgatcggccacattggaactgagacacggtccaaactcctacgggaggcagcagtggggaatattgcacaatgggggaaaccctgatgcagcaacgccgcgtgagcgaagaaggcggaatcgtcgtaaagctctgtccttggggaagaaaaaaatgacggtacccttggaggaagccccgg

SEQ ID NO: 1663 - DNA, 488 bp, Unknown
  Ascusbbf_644637, encodes 16S rRNA
agagtttgatcctggctcagattgaacgctggcggcaggcttaacacatgcaagttgaacgggattattgagtagcttgctatttgatatgagagtggcgcacgggtgagtaatacgtgggaacgtacctattagttcggaacaactgttggaaacgacagctaataccggataagccctgagggggaaagatttatcgctagtagaacggcccgcggcagattaggcagttggtggggtaaaggcctaccaaacctacgatctgtagctggtctgagaggacgatcagccacattggaactgagacacggtccagactcctacgggaggcagcagtgaggaatattgggcaatgggggaaaccctgacccagccatgccgcgtgagtgaagaaggttttcggattgtaaagctctttcgggagagaagatgatgacggtatctccagaggaagccccggcaaacttcgtgccagcagccgcggtaat

SEQ ID NO: 1664 - DNA, 490 bp, Unknown
  Ascusbbf_358604, encodes 16S rRNA
agagtttgatcatggctcagattgaacgctggcggcaggcctaacacatgcaagtcgagcggcagcacagagaaacttgtttctcgggtggcgagcggcggacgggtgagtaatgcctgggaaattgccctgatgtgggggataaccattggaaacgatggctaataccgcatgatagcttcggctcaaagagggggaccttcgggcctctcgcgtcaggatatgcccaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtgtgaagaaggccttcgggttgtaaagcactttcagtcgtgaggaaggtggtagtgttaatagcactatcatttgacgttagcgacagaag

SEQ ID NO: 1665 - DNA, 490 bp, Unknown
  Ascusbbf_635932, encodes 16S rRNA
agagtttgatcctggctcagattgaacgctggcggcaggcctaatacatgcaagtcgaacggtaacagggagagagcttgctctctctgctgacgagtggcggacgggtgagtaaggcctgggaaactgcctggcagagggggacaacagctggaaacggctgctgataccgcatataccctgagggggaaaggagcgatccgctgccagatgcgcccagatgggattaggcagttgggaggtaacggctcaccaaaccgatgatctctagctggtttgagaggacaatcagccacattggaattgagaaacggaccaaactcctacgggaggcagcagtggggaatattgcacaatgggggaaaccctgatgcagccatgccgcgtgtgtgaagaaggccttcgggttgtaaagcacttttgcattcgaggaagacggcgtataaataaatgcgctatttgacgttagagtgtgaataagcaccggcaa

SEQ ID NO: 1666 - DNA, 470 bp, Unknown
  Ascusbbf_142664, encodes 16S rRNA
agagtttgatcatggctcagagcgaacgctggcggcaggcctaacacatgcaagtcgagcgcccgggcaaccgggagcggcagacgggagagtaacacgtgggaacatgcccttcagttcggaataacccggggaaactcggactaataccggatacgcccgtaaggggaaagatttatcgctgaaggattggcccgcgtctgattagctagttggtggggtaatggcccaccaaggcgacgatcagtagctggtctgagaggatgatcagcctcactgggactgagacacggcccagactcctacgggaggcagcagtggggaatattggacaatgggcgaaagcctgatccagccatgccgcgtgagtgatgaaggccttagggttgtaaagctctttcgtcagggaagataatgacggtacctgaagaagaagccccggctaacttcgtgccagcagccgcggtaat

SEQ ID NO: 1667 - DNA, 490 bp, Unknown
  Ascusbbf_267924, encodes 16S rRNA
agagtttgatcatggctcaggacgaacgctggcggcgcgcctaacacatgcaagtcgagcgggaattttgcgagagtaatcgagtgaaaatccagcggcggacgggtgagtaacgcgtgagtgacctgccttacacagggggataacgtaccgaaaggtacactaataccgcatgagaccccggcagcgcatgctgcagaggtcaaaggagcaatccggtgtaagatggactcgcgtccgattagatagttggtgaggtaacggcccaccaagtcagcgatcggtagccgacctgagagggtgatcggccacattggaactgagagacggtccaaactcctacgggaggcagcagtggggaatattgggcaatgggggaaaccctgacccagcgacgccgcgtgagggaagaaggttttcggattgtaaacctctgttcttggtgaagagaagaagacggtagccaaggaggaagccccggctaactacg

SEQ ID NO: 1668 - DNA, 490 bp, Unknown
  Ascusbbf_1367663, encodes 16S rRNA
agagtttgatcatggtcaggatgaacgctagcggcaggcctaatacatgcaagtcggacgggatccatcggagagcttgctcgaagatggtgagagtggcgcacgggtgcgtaacgcgtgagcaacctacctctatcagggggatagcctctcgaaagagagattaacaccgcataacatatctgaccggcatcggttagctattaaatatttataggatagagatgggctcgcgtgacattagctagttggtagggtaacggcttaccaaggcgacgatgtctaggggctctgagaggagaatcccccacactggtactgagacacggaccagactcctacgggaggcagcagtaaggaatattggtcaatgggcggaagcctgaaccagccatgccgcgtgcaggaagactgccctatgggttgtaaactgcttttgtccaggaataaacctctttacgagtagagagctgaatgtactggaagaata

SEQ ID NO: 1669 - DNA, 490 bp, Unknown
  Ascusbbf_1360999, encodes 16S rRNA
agagtttgatcctggctcaggacgaacgctggcggcgtgcctaatacatgcaagtcgtacgcaattgatccaccgagtgcttgcactcaccggatcgttgagcggcgcacgggtgagtaacacgtgggtaacctgcccaccagaggggggtaacagtcggaaacgattgctaataccgcataggttgaacgaccgcatggtcgctcaaggaaagacggctttggctgtcactggtggatggacccgcggcgtattagttagttggtgaggtaacggctcaccaagacaatgatacgtagccgacctgagagggtgatcggccacattgggactgagacacggcccaaactcctacgggaggcagcagtagggaatcttccgcaatggacgaaagtctgacggagcaacgccgcgtgagtgaagaaggttttcggatcgtaaaactctgttgttagagaagaacatgtctgagagtaactgttcaggcaat

SEQ ID NO: 1670 - DNA, 490 bp, Unknown
  Ascusbbf_1189718, encodes 16S rRNA
agagtttgatcctggctcaggatgaacgctggcggcgtgcctaacacatgcaagtcgagcgagaagctcatcacagatgcttcggttgaagtgatgagtggaaagcggcggacgggtgagtaacgcgtaggcaacctgccctttgcagagggatagcctcgggaaaccgggattaaaacctcatgacacctcttaaagacatctttgagaggtcaaagatttatcggcaaaggatgggcctgcgtctgattagctagttggtggggtaacggcctaccaaggcgacgataagtagccgacctgagagggtgatcggccacattggaactgagacacggtccaaactcctacgggaggcagcagtggggaatattgcacaatgggggaaaccctgatgcagcaacgccgcgtgaaggaagaaggcctttgggtcgtaaacttctgttctaagggaagataatgacggtaccttaggagcaagtcccggcta

SEQ ID NO: 1671 - DNA, 490 bp, Unknown
  Ascusbbf_1900993, encodes 16S rRNA
agagtttgatcctggctcaggatgaacgctagctacaggcttaacacatgcaagtcgaggggcagcatggaagtagcttgctacttccgatggcgaccggcgaatgggtgagtaacgcgtatccaacctgccgtgtgctcatggatagcccttagaaatgaggattaatacatgatggtctcctttgatcgcctgagattgggagtaaagattgatcggcacacgatggggatgcgttccattagatagttcgcggggtaacggcccaccaagtcgatgatggataggggttctgagaggaaggtcccccacactggtactgagacacggaccagactcctacgggaggcagcagtgaggaatattggtcaatgggcgagagcctgaaccagccaagtagcgtgaaggaagacggccctacgggttgtaaacttcttttgtcggggaataacaagcgccacgtgtggcgccctgcacgtacccggtgaat

SEQ ID NO: 1672 - DNA, 490 bp, Unknown
  Ascusbbf_64234, encodes 16S rRNA
agagtttgatcatggctcagaacgaacgctggtggcgtgtcttatacatgcaagtcgagcggtgcagcaatgcatagcggcgaacgggtgagtaacacgtaagcaatctgccccctgcttgggaatagccgtgccaacgcgcggataataccgaatatcgtggcctcccgcatgggaggttgacaaaagatttatcggcaggggatgagcttgcgtccgattagctagttggcggggcaacggcccaccaaggcgacgatcggtagccggcctgagagggcgatcggccacattgggactgagatacggcccagactcctacgggaggcagcagtagggaatattgcacaatgggggaaaccctgatgcagcaacgccacgtgtgggaagaagcatttcggtgtgtaaaccactgtcgtgagggaataaggctatttttcggaacagttgaatgtacctcgaaaggaagcaccggcaaacttcgtgccag

SEQ ID NO: 1673 - DNA, 490 bp, Unknown
  Ascusbbf_15117, encodes 16S rRNA
agagtttgatcatggctcaggacgaacgctggcggcgtgcctaacacatgcaagtcgaacggagtattgcgctgaaacgagagtagcttgctacaggaatttcttgtaatacttagtggcggacgggtgagtaacgcgtgaggaacctgccttacagagggggacaacagttggaaacgactgctaataccgcataacatattgagaggacatcctcttaatatcaaaggagcaatccgctgtaagatggcctcgcgtctgattagatagttggtgaggtaacggcccaccaagtcgacgatcagtagccggactgagaggttgaacggccacattgggactgagacacggcccagactcctacgggaggcagcagtgggggatattgcacaatggaggaaactctgatgcagcaacgccgcgtgagggaagaaggttttcggattgtaaacctctgtttttagcgaagaaagaaatgacggtagctaaa

SEQ ID NO: 1674 - DNA, 490 bp, Unknown
  Ascusbbf_949232, encodes 16S rRNA
agagtttgatcatggctcagattgaacgctggcggcaggcctaatacatgcaagtcgaacgaacttaattcattcttttagattgaaagcggttagtggcggactggtgagtacaacataagcaacctgcctataagaggggaacaacagttagaaatgactgctaataccgcatatgccataataatcacatgattatagtgggaaaggagtaatccgcttatagatgggcttatgcctgattagctagttggtggggcaacggcctaccaaggcgacgatcagtagccgaactgagaggttaaacggccacattgggactgagatacggcccagactcctacgggaggcagcagtcgggaatattgcgcaatggaggaaactctgacgcagtgacgccgcgtgcaggatgaaggttttcggattataaactgctttagacagggaagatacaagacagtacctgtagaataagctccggctaactacg

SEQ ID NO: 1675 - DNA, 490 bp, Unknown
  Ascusbbf_30424, encodes 16S rRNA
agagtttgatcctggctcaggatgaacgctagcggcaggcttaacacatgcaagtcgaggggcagcgtgatgtagcaatacattgacggcgaccggcgaaagggtgagtaacgcgtgagcaacatgcccggtagaggaggatagtcgatggaaacgtcgcgtaatactccgtaacaacagggaccgcatgatccttgtttaatagatttatcgctaccggattggctcgcgtcccattaggcagttggcggggtaacggcccaccaaaccgacgatgggtaggggttctgagaggaaggtcccccacattggaactgagacacggtccagactcctacgggaggcagcagtgaggaatattggtcaatggccgagaggctgaaccagccatgccgcgtgcgggaggacggccctatgggttgtaaaccgcttttgttggggagcaataagggtcacgtgtggcccgatgagagtacccagcgaataagca

SEQ ID NO: 1676 - DNA, 490 bp, Unknown
  Ascusbbf_103254, encodes 16S rRNA
agagtttgatcctggctcaggatgaacgctagcggcaggcttaacacatgcaagtcgaggggcagcgtggagtagcaatactctgacggcgaccggcgaaagggtgagtaacgcgtgagcaacatgcccgatagtggaggatagtcgatggaaacgtcgcgtaatactccgtaacatacgggaccgcatgattctgtattaatagatttattgctatcggattggctcgcgtaccattagctagttggcggggtaacggcccaccaaggcgacgatggttaggggttctgagaggaaggtcccccacattggaactgagacacggtccagactcctacgggaggcagcagtgaggaatattggacaatggccggaaggctgatccagccatgccgcgtgcgggaagacggccctatgggttgtaaaccgcttttgttggggagcaataagcagtacgtgtactgcgatgagagtacccagcgaataagca

SEQ ID NO: 1677 - DNA, 490 bp, Unknown
  Ascusbbf_180291, encodes 16S rRNA
agagtttgatcctggctcaggacgaacgctggcggcgtgcttaacacatgcaagtcgagcggaaaggcctcaaccttgtgttggggtactcgagcggcgaacgggtgagtaacacgtgagtaatctgccctccactctgggataagccttggaaacggggtctaataccggatatgacctgctcctgcctgggagtgggtggaaagcgtttagcggtgggggatgtgctcgcggcctatcagcttgttggtggggtaatggcctaccaaggctttgacgggtagccggcctgagagggtgaccggtcacactgggactgagacacggcccagactcctacgggaggcagcagtggggaatattggacaatgggcggaagcctgatccagcaacgccgcgtgggggatgaaggccttcgggttgtaaacctctttcagtaccgacgaagcccctgctttggtggggtgtgacggtaggtacagaagaagca

SEQ ID NO: 1678 - DNA, 490 bp, Unknown
  Ascusbbf_1016, encodes 16S rRNA
agagtttgatcatggctcaggatgaacgctagcggcaggcttaacacatgcaagtcgaggggcagcgtggagtagcaatactctgacggcgaccggcgaaagggtgagtaacgcgtgagcaacatgcccgggactgggggatagtcgatggaaacgtcgtgtaataccccgtaacacattgcaccgcatgatgcgatgttgagagatttatcgattccggattggctcgcgtcccattagctagttggcggggtaacggcccaccaaggcgacgatgggtaggggttctgagaggaaggtcccccacattggaactgagacacggtccagactcctacgggaggcagcagtgaggaatattggacaatggccgagaggctgatccagccatgccgcgtgcgggaggacggccctatgggttgtaaaccgcttttgtcagggggcaataagtgtcacgtgtggcacgatgagagtacctggcgaataagca

SEQ ID NO: 1679 - DNA, 490 bp, Unknown
  Ascusbbf_8620, encodes 16S rRNA
agagtttgatcatggctcaggatgaacgccggcggtgtgcctaatacatgcaagtcgtacgcactggcccaactgattgatggtgcttgcacctgattgacgatggattaccagtgagtggcggacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagag

SEQ ID NO: 1680 - DNA, 490 bp, Unknown
  Ascusbbf_3982, encodes 16S rRNA
agagtttgatcatggctcaggatgaacgctagctacaggcttaacacatgcaagtcgaggggcagcatgacgatagcttgctattgtcgatggcgaccggcgcacgggtgagtaacgcgtatccaacctgcccattactcaggtatagcccagtgaaaactggattaatccctgatgtggtctcgtgcagacatctaagcgagactaaagtttcaacggtaatggatggggatgcgtctgattagcttgttggcggggtaacggcccaccaaggcgacgatcagtaggggttctgagaggaaggtcccccacattggaactgagacacggtccaaactcctacgggaggcagcagtgaggaatattggtcaatggacggaagtctgaaccagccaagtagcgtgcaggatgacggccctatgggttgtaaactgcttttgtgcgggaataaagaaggggacgtgtcctctgttgcatgtaccgcacgaat

SEQ ID NO: 1681 - DNA, 490 bp, Unknown
  Ascusbbf_27171, encodes 16S rRNA
agagtttgatcatggctcaggatgaacgctggcggcgtgcctaacacatgcaagtcgaacggggtacagacgctgaagattggagtgcttgcacaaagagattcttgtttgtacttagtggcggacgggtgagtaacgcgtggaaaacctgcctcatacagggggataacaggaagaaattcctgctaataccgcataagcgcacggtaccgcatggtagagtgtgaaaagatttatcggtatgagatggttccgcgtctgattagccagttggcggggtaacggcccaccaaagcgacgatcagtagccggcctgagagggcggacggccacattgggactgagacacggcccagactcctacgggaggcagcagtgggggatattgcacaatggagggaactctgatgcagcgacgccgcgtgggtgaagaagttattcgtaatgtaaagccctatcagcagggaagataatgacggtacctgactaa

SEQ ID NO: 1682 - DNA, 490 bp, Unknown
  Ascusbbf_110747, encodes 16S rRNA
agagtttgatcatggctcagattgaacgctagcgggatgctttacacatgcaagtcgaacggcagcgcgaaagaagcttgcttcttttggcggcgagtggcgaacgggtgagtaatgtatcggaacgtgcccagtagcgggggataactactcgaaagagtggctaataccgcatacgccctacgggggaaagggggggatcgcaagacctctcactattggagcggccgatatcggattagctagttggtggggtaaaggcctaccaaggcgtcgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcagggaagaaaagtcgcaggctaatatcctgcgacgctgacggtacctgcaga

SEQ ID NO: 1683 - DNA, 490 bp, Unknown
  Ascusbbf_818496, encodes 16S rRNA
agagtttgatcctggctcaggatgaacgctagctacaggcttaacacatgcaagtcgaggggtaacgacagcgaaagcttgcttttgctgggcgacgaccggcgcacgggtgagtaacgcgtatccaacctgcccataactaagggataatccgtagaaatgcggtctaataccttatgtgttccgacgaggacatctgaattggaataaagatttatcggttatggatggggatgcgtctgattagattgttggcggggcaacggcccaccaagtctacgatcagtaggggttctgagaggaaggtccctcatattggaactgagacacggtccaaactcctacgggaggtagcagtgaggaatattggttaatgggtgagagcctgaattagttaagtagtgtgtaggatgatggccctatgggttgtaaattgtttttgtatggggataaagtgctccacgtgtggagttttgtaggtaccatacga

SEQ ID NO: 1684 - DNA, 490 bp, Unknown
  Ascusbbf_113009, encodes 16S rRNA
agagtttgatcatggctcaggatgaacgctggcggcgtgcttaacacatgcaagtcgaacgaagcattgtgattgatttcttcggattgatttcactttgacttagtggcggacgggtgagtaacgcgtgggtaacctgccgtatgcagggggacaacagttagaaatgactgctaataccgcataacccgctagtgccgcatggcacagacggaaaagattttatcggcatacgatggacccgcgtctgattagcttgttggtgaggtaacggcccaccaaggcgacgatcagtagccgaactgagaggttgaccggccacattgggactgagacacggcccagactcctacgggaggcagcagtggggaatattgcacaatgggggaaaccctgatgcagcaacgccgcgtgagtgatgacgtatttcggtatgtaaagctctatcagcagggaagaaaatgacggtacctgactaagaagccccggc

SEQ ID NO: 1685 - DNA, 484 bp, Unknown
  Ascusbbf_9615, encodes 16S rRNA
agagtttgatcatggctcagaacgaacgctggcggcacgcttaacacatgcaagtcgaacggtgtaatggggcttgctccattacgtagtggcggacgggtgagtaacacgtggagacctgactagaggaggtggatagcttcgggaaactggaggtaatacagcataagctcgagagaggaaaggggaaacccgcctttagagggatctgcggctgattaggtagttggtggggtaaaggcctaccaagccgacgatcagtagctggtctgagaggatgatcagccacactggaactgagatacggtccagactcctacgggaggcagcagtggggaatattggacaatggggggaaccctgatccagcgatgccgcgtgagtgaagaaggccttagggttgtaaagctcttttgacggggacgatgatgacggtacccgtagaataagcaccggctaactctgtgccagcagccgcggtaat

SEQ ID NO: 1686 - DNA, 490 bp, Unknown
  Ascusbbf_10289, encodes 16S rRNA
agagtttgatcatggctcagaacgaacgctggcggcgcgttttaagcatgcaagtcgagcggcagtagcaatacgagagcggcggacgggtgagtaacacgtgggtaatctgcctaccagtcggggatagcctgtggaaacacaggataataccggatgcgatgccctgcacacaagtgcggggcaggaaaggggccaaggccccgctggaagatgagcccgcgtcccattagctagatggcggggtaaaggcccaccatggcgatgatgggtagccggcctgagagggtgaacggccacattggaactgagacacggtccagactcctacgggaggcagcagctaagaatcttccacaatggacgaaagtctgatggagcgacgccgcgtgggcgatgaaggccgtgaggttgtaaagcccttttcttgaggaggaataagcggatcagggaatgggtctgcgatgacgtgaatcaaggaataagcccc

SEQ ID NO: 1687 - DNA, 490 bp, Unknown
  Ascusbbf_10861, encodes 16S rRNA
agagtttgatcatggctcaggataaacgctggcggcgtgcctaatacatgcaagtcgatcggcagacagtgagcttgcttaatgtctgcagaggcgaacgggtgagtaatacataagcaacctgcccacgaagactgggataatccctggaaacggggactaataccggataggtaacgagatcgcatgatcttgttattaaaggttcaaaacactggtggatgggcttatggcgcattagctggttggtgaggtaacggcccaccaaggcgatgatgcgtagccggcctgagagggtgaacggccacattgggactgagacacggcccagactcctacgggaggcagcagtagggaattttcggcaatgggcgaaagcctgaccgagcaacgccgcgtgagtgaagacggccttcgggttgtaaagctctgttgtaagggaagaataccagggagagaatctctggctgacggtaccttaccagaaagc

SEQ ID NO: 1688 - DNA, 490 bp, Unknown
  Ascusbbf_534099, encodes 16S rRNA
agagtttgatcctggctcaggacgaacgctggcggcgcgcttaacacatgcaagtcgaacggtgaatgtagtaaagcttgctttaagacattcatagtggcggacgggtgagtaacgcgtgaggacttgtcctgtacagggggacaactgatggaaacgtcagctaataccccataagccgagaggtaaaaggagcgatccggtacaggagggactcgcgttctatcagttagttggtggggtaacggcccaccaaggcgaagacggatagccggactgagaggttggccggccacattggaactgagatacggtccagactcctgcgggaggcagcagtggggaatattgggcaatggggggaaccctgacccagcgacgccgcgtgagtgaagaaatccctcgggatgtaaagctctgttgtgcgggaagaaggaagtgacggtaccgcacgaggaagccacggcaaactacgtgccagcagccgcgg

SEQ ID NO: 1689 - DNA, 490 bp, Unknown
  Ascusbbf_18699, encodes 16S rRNA
agagtttgatcatggctcaggatgaacgctggcggcgtgcttaacacatgcaagtcgaacgagaaccttacgacggagacttcggttgaagatgtaagaattctagtggcggacgggtgagtaacgcgtgggtaacctgcccatgagaggaggataacagggagaaattcttgctaatactctatatgcttacggtatcgcatgatactgtgaggaaatgaatttcgctcatggatggacccgcgtttgattagccagttggtggggtaacggcctaccaaagcaacgatcaatagccggcctgagagggtgatcggccacattgggactgagacacggcccaaactcctacgggaggcagcagtggggaatattgcacaatgggggaaaccctgatgcagcaacgccgcgtgagtgaagaagtatttcggtatgtaaagctctatcgatgggaaataagatgaaggtacccaaataagaagccccggct

SEQ ID NO: 1690 - DNA, 490 bp, Unknown
  Ascusbbf_47370, encodes 16S rRNA
agagtttgatcatggctcagattgaacgctggcggcatgctttacacatgcaagtcggacggcagcacagagaagcttgcttcttgggtggcgagtggcgaacgggtgagtaatatattggaacgtaccgagtaatgggggataactaatcgaaagattagctaataccgcatacgtcctgagggagaaagcgggggatcttcggacctcgcgttattcgagcggccaatatctgattagctagttggtggggtaaaggcccaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggaacgggctaatatcccgttctgatgacggtacctgaagaat

SEQ ID NO: 1691 - DNA, 490 bp, Unknown
  Ascusbbf_66745, encodes 16S rRNA
agagtttgatcatggctcaggacgaacgctggcggcgtgcttaacacatgcaagtcgaacgctgaagctctgcccttgtggtggggtggatgagtggcgaacgggtgagtaacacgtgggtaatctgccccatactctgggataacccctggaaacgggggctaataccggataggacattctgccgcatggtggggtgtggaaagttccggcggtatgggatgggcccgcggcctatcagcttgttggtggggtaatggcctaccaaggcgacgacgggtagccggcctgagagggtgaccggccacactgggactgagacacggcccagactcctacgggaggcagcagtggggaatcttgcgcaatgggcgaaagcctgacgcagcaacgccgcgtgggggatgaaggccttcgggttgtaaacctctttcaccatcgacgaagccctttggggtgacggtaggtggggaagaagcaccggctaact

SEQ ID NO: 1692 - DNA, 490 bp, Unknown
  Ascusbbf_633621, encodes 16S rRNA
agagtttgatcctggctcaggacgaacgctggcagcgtgcttcatacatgcaagtcgaacgagaagctctcgcttgctagagtggaaagtggcggacgggtgagtaatatgtaggaaatctgccctagagagggggacaacagagcgaaacttctgctaataccccatatgagcttagttgcaataccaatcttgaaaactccggtgctctaggatgagcctgcatctgattagcttgttggtggtgtaatggactaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgaatgatgaagcccttcggggtgtaaaattctgtcagtggggacgaattttgacggtacccacagaggaagcaccggctaactccgtgccagcagccg

SEQ ID NO: 1693 - DNA, 490 bp, Unknown
  Ascusbbf_1672, encodes 16S rRNA
agagtttgatcatggctcaggacgaacgctggcggcgtgcctaacacatgcaagtcgaacgagtgtactagcaatagtacattagtggcggacgggtgagtaatacatgagtaacctgccttatacagggggataacacctagaaatgggtgctaataccgcataataacctattgtggcatcacaataggaggaaaggagaaatccggtaaaagatggactcatgttcgattagctagttggtggggtaaaggcctaccaaggcaacgatcgatagccgaactgagaggttgatcggccacattggaactgagaaacggtccagactcctacgggaggcagcagtggggaatattgcgcaatgggggaaaccctgacgcagcaacgccgtgtgaaggaagaaggctctagggttgtaaacttctttgattagggacgaaagaaatgacggtacctaaagaacaagccacggctaactacgtgccagcag

SEQ ID NO: 1694 - DNA, 490 bp, Unknown
  Ascusbbf_8776, encodes 16S rRNA
agagtttgatcatggctcaggatgaacgctagcggcaggcttaacacatgcaagtcgaggggcagcgcggggtagcaatactctggcggcgaccggcgaaagggtgagtaacgcgtgagcaacatgcccgggactgggggatagtcgatggaaacgtcgcgtaataccccgtaatacacggaaccgcatgattctgtgttgagagatttattgattccggattggctcgcgtgccattagctagttggcggggtaacggcccaccaaggcgacgatggctaggggttctgagaggaaggtcccccacattggaactgagacacggtccagactcctacgggaggcagcagtgaggaatattggacaatggccgagaggctgatccagccatgccgcgtgcgggaagacggccctatgggttgtaaaccgcttttgcgagggagcaataaggtctacgtgtagaccgatgagagtaccttacgaataagca

SEQ ID NO: 1695 - DNA, 490 bp, Unknown
  Ascusbbf_36838, encodes 16S rRNA
agagtttgatcatggctcaggatgaacgctggcggcgtgcctaacacatgcaagtcgagcggacttaagaaaagaatcttcggatgaaatttttaagttagcggcggatgggtgaggaacgcgtggagaacctgcccttcacagggggataacagctggaaacggctgttaataccgcatatgctcacggagccgcatggccccgggaggaaagctccggcggtgaaggatggctccgcgtcggattaacttgttggcggggtaacggcccaccaaggtgatgatccgtagccggcctgagagggcgaccggccacattgggactgagacacggcccaaactcctacgggaggcagcagtgggggatattgcacaatgggcgcaagcctgatgcagcgacgccgcgtgatggaggaagtacttcggtatgtaaacatctatcagcagggaagaagatgacggtacctgcagaagaagccccggctaacta

SEQ ID NO: 1696 - DNA, 490 bp, Unknown
  Ascusbbf_320393, encodes 16S rRNA
agagtttgatcatggctcaggacgaacgctggcggcgtgcctaatacatgcaagtcgagcgagcttgcctagatgattttagtgcttgcactaaatgaaactagatacaagcgagcggcggacgggtgagtaacacgtgggtaacctgcccaagagactgggataacacctggaaacagatgctaataccggataacaacactagacgcatgtctagagtttgaaagatggttctgctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgaaagtctgatggagcaacgccgcgtgagtgaagaagggtttcggctcgtaaagctctgttggtagtgaagaaagatagaggtagtaac

SEQ ID NO: 1697 - DNA, 490 bp, Unknown
  Ascusbbf_15310, encodes 16S rRNA
agagtttgatcctggctcaggacgaacgctggcggcgtgcttaacacatgcaagtcgaacgagaatagattggaagcttgcttttgatttattcgagtggcggacgggtgagtaacgcgtgaataatctgtcctatacagggggataacgcatcgaaagatgtgctaataccgcgtaggaccacgggatcgcatgattccgaggtgaaaggagcaatccagtatagggtgagttcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgaaagcctgacccagcaacgccgcgtgaaggaagaaggttttcggattgtaaacttctgtcctatgtgaagagatagagacggtagcataggaggaagccccggctaacta

SEQ ID NO: 1698 - DNA, 489 bp, Unknown
  Ascusbbf_23610, encodes 16S rRNA
agagtttgatcctggctcagaatgaacgctggcggcatggattaggcatgcaagtcgaacggggtccttcgggacctagtggcgaaagggtgagtaacacgtgagcaatctgcccccaaggccggaataagcactggaaacggtgtctaaaaccggatgaggcccggagtcgcatgactcctcagccaaatattgataccctggggatgagctcgcggcccattagctagttggcggggtaacggcccaccaaggctgcgacgggtaggtggtctgagaggatggtcacccacactgggactgagacactgcccagactcctacgggaggctgcagtcgagaatcttccgcaatgggcgcaagcctgacggagcgatgccgcgtgagggacgaaggccttcgggtcgtaaacctctgtcaccggggacgaaacctgacggtacccggaaaggaagccacggctaaccacgtgccagcagccgcggtaat

SEQ ID NO: 1699 - DNA, 490 bp, Unknown
  Ascusbbf_49197, encodes 16S rRNA
agagtttgatcatggctcaggatgaacgctggcggcgtgcctaacacatgcaagtcgaacggttaaaccggcttcggccggaaataaagtggcgaacgggtgagtaacacgtgaccaacctgccccgcgcaccgggacagccccccgaaagggggattgataccggatactccgccgggcccgcatgggcccggcgggaaagctccggcggcgcgggatggggtcgcggcccatcaggtagtgggtcgggtagaggccggcccagccgacgacgggtagccgggttgagagaccgaccggccacattgggactgagatacggcccagactcctacgggaggcagcagtggggaatattgcgcaatgggggcaaccctgacgcagcaacgccgcgtgcgggaggaaggcactcgtgtcgtaaaccgctttcagcagggaagacatcgacggtacctgcagaagaagccccggctaactacgtgccagcagc

SEQ ID NO: 1700 - DNA, 490 bp, Unknown
  Ascusbbf_33854, encodes 16S rRNA
agagtttgatcatggctcagaatgaacgttggcggcatggattaggcatgcaagtcgagcgagaaccctaagatggagacttcggtcaaagtcttagggggacagcggcgaaagggtgagtaacgcgtagttacctgccccagggtccagaatagcctcgggaaactgagagtaatgctggataatatctccggatcaaaggtgagattccgccctgggaggggactgcgtcctactagcttgttggtaaggtaatggcttaccaaggctacgatgggtagcgggcgtgagagcgtggcccgtcacactgggactgagacactgcccagacacctacgggtggctgcagtcgagaatcttcggcaatgcgcgaaagcgtgaccgagcaatgccgcgtgcgggatgaaggccctcgggttgtaaaccgcgaaagtaaggcggaaggctctgtgaagagcagagtttgaccaatttacagtaaggacgggct

SEQ ID NO: 1701 - DNA, 490 bp, Unknown
  Ascusbbf_138617, encodes 16S rRNA
agagtttgatcctggctcaggacgaacgctggcggcgtgcttaacacatgcaagtcgagcggaaaggcccttcggggtactcgagcggcgaacgggtgagtaacacgtgagcaacctgccccaagctttgggataaccctcggaaacgggggctaataccgaatattactgctggtcgcatggctggtggtggaaagtttttcggcttgggatgggctcgcggcctatcagcttgttggtggggtgatggcctaccaaggcgacgacgggtagccggcctgagagggcgaccggccacactgggactgagacacggcccagactcctacgggaggcagcagtgggaatattgcacaatgggcggaagcctgatgcagcgacgccgcgtgagggatgacggccttcgggttgtaaacctctttcagcagggacgaagcgagagtgacggtacctgcagaagaagcaccggccaactacgtgccagcagccg

SEQ ID NO: 1702 - DNA, 490 bp, Unknown
  Ascusbbf_1436053, encodes 16S rRNA
agagtttgatcctggctcaggatgaacgctagcggcaggcttaacacatgcaagtcgaggggcagcgcggggtagcaatactctggcggcgaccggcggacgggtgcgtaacgcgtgagcaacttgcccgtcactgggggataggccctggaaacggtgtgtaatactccataacatatggattcacatggattcatattgaaagattcgttggtgacggatgggctcgcgtaacattagcaagtcggcggggtaacggcccaccgaggccacgatgtttaggggttctgagaggaaggtccccaacaccggaactgggaaacggtccagcctcctacggagggaagaagtgaggaatattggtcaatgggcggaagcctgaaccagccatgccgcgtgcaggaatagggccctatgggtcgtaaactgcttttccttgagggcaataagggtcacgagtggcccgatgagagtatcaggggaataagca

SEQ ID NO: 1703 - DNA, 490 bp, Unknown
  Ascusbbf_11922, encodes 16S rRNA
agagtttgatcctggctcaggatgaacgctggcggcgtgcctaatacatgcaagtcgaacgcaaatcttcgggtttgagtggcgaacgggtgagtaacacgtaggtaatctaccgtagagacggggataacgattggaaacgatcgctaataccggatagcatatcggatcgcatgatctgatatttaaagatacaattgtatcactctatgatgagcctgcgtcgcattagctagttggtgagataatagcccaccaaggcgatgatgcgtagccggactgagaggttgaacggccacattgggactgagacacggcccagactcctacgggaggcagcagtagggaattttcggcaatgggggaaaccctgaccgagcaacgccgcgtgaatgaagaagtatttcggtatgtaaaattcttttgtatgggaagaacgaatcagggagtggaaagccctggaagtgactgtaccatacgaataagcccc

SEQ ID NO: 1704 - DNA, 490 bp, Unknown
  Ascusbbf_32758, encodes 16S rRNA
agagtttgatcctggctcagagtgaacgctagcggaatgctttatacatgcaagtcgaacggagttttgttatgaagtagcaatatggaatagtaaaacttagtggcgaactggcgagtaatagttaggaacttaccgagtagtgggggacaacagttagaaatgactgctaataccgcatacgcccgagaggggaaagatttatcgctatttgagaggcctaaccacgattagcttgttggtgagataaaagcccaccaaggcagtgatcgttatctgatctgagaggatgatcggacgcatcgggactgagacacggcccggactcctacgggaggcagcagtagggaatattggacaatggacgcaagtctgatccagcaattccgcgtgagtgatgaaggtgttatgcattgtaaaactcttttgcctgcgaagataatgacggtagcaggagaataagcaccgactaactatgtgccagcagccg

SEQ ID NO: 1705 - DNA, 490 bp, Unknown
  Ascusbbf_9913, encodes 16S rRNA
agagtttgatcatggctcaggacgaacgctggcggcgtgcctaacacatgcaagtcgaacggagttaccaagaatttcggtttgaagtaacttagtggcggacgggtgagtaacgcgtgagtaacctgcctagaagagggggataacgttctgaaaagaacgctaataccgcataacgtataagtttcgcatggaatttataccaaaggagtaatccgcttttagatggactcgcgtccgattagcttgttggcggggtaacagcccaccaaggcgacgatcggtagccggactgagaggttgaacggccacattgggactgagacacggcccagactcctacgggaggcagcagtgggggatattgcgcaatgggggaaaccctgacgcagcaacgccgcgtgaaggacgaaggtcttcggattgtaaacttcttttgttaaggacgaagaaagtgacggtacttaacgaataagctccggctaactac

SEQ ID NO: 1706 - DNA, 490 bp, Unknown
  Ascusbbf_117003, encodes 16S rRNA
agagtttgatcatggctcaggatgaacgctagcggcaggcctaacacatgcaagtcgaggggtagatatcttcggatattgagaccggcgcacgggtgcgtaacgcgtatgcaatctaccttatactaagggatagcccagagaaatttggattaataccttatagttattttgaatggcatcgtttaaaatataaagatttattggtataagatgagcatgcgtcccattagttagttggtaaggtaacggcttaccaagacgatgatgggtaggggtcctgagagggagatcccccacactggtactgagacacggaccagactcctacgggaggcagcagtgaggaatattggtcaatggacggaagtctgaaccagccatgccgcgtgcaggatgacggtcctatggattgtaaactgcttttgtacgggaagaaaacacattacgtgtaatgtactgacggtaccgtaagaataaggatcggcta

SEQ ID NO: 1707 - DNA, 490 bp, Unknown
  Ascusbbf_365530, encodes 16S rRNA
agagtttgatcatggctcaggatgaacgctagctacaggcttaacacatgcaagtcgaggggcatcaggatgtagcaatacattgctggcgaccggcgcacgggtgagtaacacgtatccaacctgccttttactcggggataggctttcgaaagaaagattaatacccgatggcataatatttccgcatgggattattattaaagaatttcggtaaaagatggggatgcgttccattaggcagttggcggggtaacggcccaccaaaccttcgatggataggggttctgagaggaaggtcccccacattggaactgagacacggtccaaactcctacgggaggcagcagtgaggaatattggtcaatgggcgagagcctgaaccagccaagtagcgtgaaggatgactgccctatgggttgtaaacttcttttataggggaataaagtgagccacgtgtggctttttgtatgtaccctatgaataagga

SEQ ID NO: 1708 - DNA, 490 bp, Unknown
  Ascusbbf_1226, encodes 16S rRNA
agagtttgatcatggctcaggatgaacgctagctacaggcttaacacatgcaagtcgaggggcagcatggaggttgcttgcaacttccgatggcgaccggcgcacgggtgagtaacgcgtatccaaccttccccctagtagggcacagcccggcgaaagtcggattaataccctatgttgtttgaagcggacatctaattcaaaccaaagattcatcgctagtggatggggatgcgtctgattagcttgatggcggggtaacggcccaccatggcgacgatcagtaggggttctgagaggaaggtcccccacattggaactgagacacggtccaaactcctacgggaggcagcagtgaggaatattggtcaatggaggcaactctgaaccagccaagtagcgtgcaggatgacggccctatgggttgtaaactgcttttacgaggggataaccgatgccacgcgtggtgttttgcatgtacctcgtgaat

SEQ ID NO: 1709 - DNA, 490 bp, Unknown
  Ascusbbf_4594, encodes 16S rRNA
agagtttgatcatggctcaggatgaacgctggcggcgtgcctaatacatgcaagtcgaacgagcaaaatccagcttgctggatggagctagtggcgaacgggtgagtaatacgtaagcaacctgcctacaaggactgggataacacctggaaacgggcgctaataccggataggtaacgggagggcatccttctgttattaaaggtttgaaacacaagtagatgggcttacggtgcattagctagttggtgaggtaacggcccaccaaggcgatgatgcatagccggcctgagagggtgaacggccacattgggactgagacacggcccagactcctacgggaggcagcagtagggaattttcggcaatgggcgcaagcctgaccgagcaacgccgcgtgagtgatgaaggttttcggatcgtaaagctctgttgtaagggaagaatggcgcggatagactccgcgattgacggtaccttaccagaaagc

SEQ ID NO: 1710 - DNA, 490 bp, Unknown
  Ascusbbf_7641, encodes 16S rRNA
agagtttgatcatggctcaggatgaacgctggcggcgtgcttaacacatgcaagtcgaacggagcttatttggaaagcttgcttttcgtttaagcttagtggcggacgggtgagtaacgcgtgagcaacctgccctagagtggggaataacaccgagaaatcggtgctaataccgcataatgtcggaggaccgcatgatccaccgaccaaaggatttattcgctttaggatgggctcgcgtccgattaggcagttggcggggtaacggcccaccaaaccgacgatcggtagccgaactgagaggttgatcggccacattgggactgagacacggcccagactcctacgggaggcagcagtggggaatattgggcaatgggcgaaagcctgacccagcaacgccgcgtgaaggatgaaggtcttcggattgtaaacttctttgattggggaagaataaatgacctacccaaagaacaagtcacggctaact

SEQ ID NO: 1711 - DNA, 489 bp, Unknown
  Ascusbbf_641844, encodes 16S rRNA
agagtttgatcatggctcagaacgaacgctggcggcatggattaggcatgcaagtcgaacgggagcagcaatgctccagtggcgcaagggtgaggaacacgtgaacaacccttcgagttggggatagcttctggaaacgggagataataccgaataacatcaccggatcgcatgattaggtgatcaaagcagtaatgcgcttgaagaggggttcgcgtcccattagctagttggtgaggtaacggcccaccaaggcgatgatgggtagctggtctgagaggacgaccagccacattgggactgagatactgcccagactcctacgggaggctgcagtcgagaattttgggcaatggacgaaaatctgacccagcaatgccgcgtgcgggatgaaggtcttcggattgtaaaccgctgtcaagagggacgaaacatgacggtacctctgaaggaagccacggctaactacgtgccagcagccgcggtaat

SEQ ID NO: 1712 - DNA, 490 bp, Unknown
  Ascusbbf_111038, encodes 16S rRNA
agagtttgatcctggctcaggatgaacgctggcggcgtgcctaatacatgcaagtcgaacgagctgcttcggcagcgagtggcgaacgggtgagtaacatatgaataatctacctctttaactgggataccagtctgaaaagactgctaataccggataggtaatactgaggcatcttggtattattaaagatgcgtttgcatcgaattgagatgagttcatatcgcattagctagttggtgaggtaacggctcaccaaggcgatgatgcgtagccggtctgagaggatgaacggccacattgggactgagacacggcccagactcctacgggaggcagcagtagggaattttcggcaatgggcgcaagcctgaccgagcaacgccgcgtgaacgatgaaggtcttgggattgtaaagttctgttacgagggaagaacatttggtataggaaatgatatcaaactgacggtacctcgccagaaagccacg

SEQ ID NO: 1713 - DNA, 490 bp, Unknown
  Ascusbbf_1347676, encodes 16S rRNA
agatttgatcatggctcagaacgaacgctggcggcatggattaggcatgcaagtcgaacgggagcagcaatgctccagtggcgcaagggtgaggaacacgtgaacaacctgccttcgagttggggatagcctctggaaacgggagataataccgaataacatcattttctcacatggggatttgatcaaagcagcaatgcgcttgaagaggggttcgcgtcccattagctagttggtgaggtaacggcccaccaaggcgatgatgggtagctggtctgagaggacgatcagccacattgggactgagatactgcccagactcctacgggaggctgcagtcgagaattttgggcaatggacgaaagtctgacccagcaatgccgcgtgcgggatgaaggtcttcggattgtaaaccgctgtcaagagggacgaagattgacggtacctctggaggaagccacggctaactacgtgccagcagccgcggtaa

SEQ ID NO: 1714 - DNA, 490 bp, Unknown
  Ascusbbf_26972, encodes 16S rRNA
agagtttgatcatggctcaggatgaacgctggcggcgtgcctaacacatgcaagtcgaacgggaactccaagatgagacttcggtggatttttggaaattctagtggcggacgggtgagtaacgcgtgggtaacctgcccttaagaggtgaataacaacgagaaatcggtgctaatacaccatatgcttacgagatcgcatgattttgtgaggaaagatttatcgcttaaggatggacccgcgtttgattagccagttggtagggtaacggcctaccaaagcaacgatcaatagccggcctgagagggtgaacggccacattggaactgagacacggtccaaactcctacgggaggcagcagtggggagtattgcacaatgggcgcaagcctgatgcagcaacgccgcgtgagtgaagaagtatttcggtatgtaaagctctatcgatggggaataaaatgaaggtacccaagtaagaagccccggctaa

SEQ ID NO: 1715 - DNA, 490 bp, Unknown
  Ascusbbf_1815139, encodes 16S rRNA
agagtttgatcctggctcaggacgaacgctggcggcatgcctaacacacgcaagtcgaacggagtttaaggagcttgctctttaaacttagtggcggacgggtgagtaacgcgtgagcaacttgcctctcggtggggaataatgtactgaaaaggacactaataccgcataacgtatcgggaccgcatgattctgataccaaagatttatcgccgagagatgggctcgcgtccgattagccagttggtggggtagcggcctaccaaagcgacgatcggtagccggactgagaggttgaacggccacattgggactgagacacggcccagactcctacgggaggcagcagtgggggatactgcgcaatgggggaaaccctgacgcagcaatgccgcgtggaggatgaaggtcttcggattgtaaactccttttgtcagggacgaaaatgacggtacctgacgaataagctccggctaactacgtgccagca

SEQ ID NO: 1716 - DNA, 490 bp, Unknown
  Ascusbbf_848160, encodes 16S rRNA
agagtttgatcatggctcaggacgaacgctggcggcgtgcctaacacatgcaagtcgaacggagctatcgagaatttcggtttgagataacttagtggcggacgggtgagtaacgcgtgagtaacctgcctgaaagagggggataacgttctgaaaagaacgctaataccgcatgacatattgaggtcgcatgactttgatatcaaaggagcaatccgctttcagatggactcgcgtccgattatctagttggcggggtaacggcccaccaaggcgacgatcggtagccggactgagaggttgaacggccacattgggactgagacacggcccagactcctacgggaggcagcagtgggggatattgcgcaatgggggaaaccctgacgcagcaacgccgcgtgaaggacgaaggtcttcggattgtaaacttcttttgttaaggacgaagaaagtgacggtacttaacgaataagctccggctaactac

SEQ ID NO: 1717 - DNA, 490 bp, Unknown
  Ascusbbf_100564, encodes 16S rRNA
agagtttgatcctggctcagaatgaacgctggcggcatggattaggcatgcaagtcgaacgagaaagcggtttcggccgcgagtaaagtggcgaaagggtgagtagcacgtggggaacctgccccggggaccggaacaagcctgtgaaaacgggtctgagaccggatgccgccccggcccgcatgggccggaggcgaaagattaatcgccccgggatggccccgcgccccattagcttgttggcggggtgacggcccaccaaggctgcgacgggtaggtggtctgagaggatggtcacccacactgggactgagacactgcccagactcctacgggaggctgcagtcgagaatcttccgcaatgggcgcaagcctgacggagcgatgccgcgtgggggaaggaggccctcgggtcgtaaacccctgtcggacgggacgaaatcaatgacggtaccgtccaaggaagccacggctaaccacgtgccagcag

SEQ ID NO: 1718 - DNA, 490 bp, Unknown
  Ascusbbf_30577, encodes 16S rRNA
agagtttgatcatggctcaggatgaacgctagcggcaggcctaacacatgcaagtcgaggggtagtggttgcttgcaaccatgagaccggcgcacgggtgcgtaacgcgtatgcaacctaccttgtacagggggatagcccagagaaatttggattaataccccatggtaccgatacccggcattggggatcggttaaagctccggcggtacaagatgggcatgcgtcctattagctagtaggtatggtaacggcatacctaggcaacgataggtaggggccctgagagggggatcccccacactggtactgagacacggaccagactcctacgggaggcagcagtgaggaatattggacaatgggcgggagcctgatccagccatgccgcgtgcaggaagactgccctatgggttgtaaactgcttttgtacgggaagaaacaccccctcgtgagggggcttgacggtaccgtaagaataaggatcggc

SEQ ID NO: 1719 - DNA, 490 bp, Unknown
  Ascusbbf_56514, encodes 16S rRNA
agagtttgatcatggctcagaacgaacgctggcggcgcgtcttaagcatgcaagtcgaacggcaagatagtagcttgctactatcctagagtggcggactggtgagtaacgcgtgggtgatgtaccctttggatggggatagccggtagaaataccgggtaataccgaataagcttgcttctttaaagtgaagtaaggaaagcagtgtatgctgcaccgaaggaacggcccgcgtactattagctagttggtgaggtaacggctcaccaaggcgacgatagttatccggcctaagagggtgaacggacacattgggactgagatacggcccagactcctacgggaggcagcagctaagaatattccgcaatggaggaaactctgacggagcgacgccgcgtggatgatgaaggccggaaggttgtaaagtccttttaagtgagaagaataaacagtataggtaatgatactgagatgacggtaacacttg

SEQ ID NO: 1720 - DNA, 490 bp, Unknown
  Ascusbbf_86544, encodes 16S rRNA
agagtttgatcatggctcaggatgaacgctggcggcgtgcctaacacatgcaagtcgaacggagtgtagacgctgtgcgaagaagtgcttgcacggattcaaacttgtttacacttagtggcggacgggtgagtaacgcgtggaaaacctgcctcatacagggggataacaggaagaaattcctgctaataccgcatgagcgcacactgtcgcatggcagagtgtgaaaagatttatcggtatgagatggttccgcgtctgattagccagttggcggggtaacggcccaccaaagcgacgatcagtagccggcctgagagggcggacggccacattgggactgagacacggcccagactcctacgggaggcagcagtgggggatattgcacaatggaggcaactctgatgcagcgacgccgcgtgggtgaagaagttattcgtaatgtaaagccctatcagcagggaagataatgacggtacctgactaa

SEQ ID NO: 1721 - DNA, 490 bp, Unknown
  Ascusbbf_70243, encodes 16S rRNA
agagtttgatcctggctcaggatgaacgctggcggcgtgcttaacacatgcaagtcgaacggaacagaagttttcggatttctgtttagtggcggacgggtgagtaacgcgtgggtaacctgcctcaaactgggggataacggttggaaacgaccgctaataccgcataagcccacagtgccgcatggcacagagggaaaagatttatcggtttgagatggacccgcgtctgattagccagttggtggggtaacggcctaccaaagcaacgatcagtagccgacctgagagggtgatcggccacattgggactgagacacggcccaaactcctacgggaggcagcagtggggaatattgcgcaatgggggaaaccctgacgcagcaacgccgcgtgagtgaggaagtatttcggtatgtaaagctctatcagcggggacgaagatgacggtacccgcagaagaagtcccggctaactacgtgccagcagc

SEQ ID NO: 1722 - DNA, 490 bp, Unknown
  Ascusbbf_179679, encodes 16S rRNA
agagtttgatcatggctcaggatgaacgctggcggcgtgcttaacacatgcaagtcgaacgaagcatttactgccgattttttcggaaagaagcggtttatgactgagtggcggacgggtgagtaacgcgtgggcaacctgcccttaaccgggggacaacagttggaaacggctgctaataccgcataagcgcacagtgtcgcatggcacagtgtgaaaaactccggtggttaaggatgggcccgcgttggattaggtagttggggcggtaacggcgcaccaagccgacgatccatagccgacctgagagggtgaccggccacattgggactgagacacggcccagactcctacgggaggcagcagtggggaatattgcacaatgggggaaaccctgatgcagcgacgccgcgtgagtgaagaagtatttcggtatgtaaagctctatcagcagggaagaagatgacggtacctgcacaagaagccccgg

SEQ ID NO: 1723 - DNA, 490 bp, Unknown
  Ascusbbf_70528, encodes 16S rRNA
agagtttgatcatggctcaggatgaacgctggcggcgtgcctaacacatgcaagtcgagcgggaaacgctcaagcagagattcgtcgaagcgagagcgtggatagcggcggacgggtgagtaacgcgtaggtaacctgccttaggctgagggatagcccggggaaacctggattaataccacataacgcgggggagtcacatggccccctcgccaaagatttatcggcctgagatggacctgcgtctgattagatagttggtgaggtaacggcccaccaagtcaacgatcagtagccgacctgagagggtgatcggccacattggaactgagacacggtccaaactcctacgggaggcagcagtggggaatattgcacaatgggggaaaccctgatgcagcaacgccgcgtgagcgaagaaggtcttcggattgtaaagctctgtccttggggacgaaagatgacggtacccaaggaggaagccccggct

SEQ ID NO: 1724 - DNA, 490 bp, Unknown
  Ascusbbf_596048, encodes 16S rRNA
agagtttgatcctggctcagaatgaacgttggcggcgtggattaggcatgcaagtcgagcggcaaggtttttttcggaagaccctagagcggcggaagggataggaacatatggatacatgcctcctaggcctggatagcgtctggaaacgggcgataatacaggatgaggtcttcggaccaaaggtgcgattcccctaagagattggtccatatcctattagctagttggtaaggtaacggcttaccaaggcgatgatgggtacggggcgtgagagcgcgaccccgatcactgggactgagacactgcccagacgcctacgggcggctgcagtcgagaatcttcggcaatggacgcaagtctgaccgagcgacgccgcgtgtatgacgaaggtcttcggattgtaaaatactgtcgatagggcggaagtttagaggggtactcccttctatttgacctatcttttgaggaaggacgggctaagttcgtg

SEQ ID NO: 1725 - DNA, 490 bp, Unknown
  Ascusbbf_552981, encodes 16S rRNA
agagtttgatcatggctcaggacgaacgctggcggcgtgcctaacacatgcaagtcgagcggggataccgggaacagcggcttcggccaacgggaacggtattccagcggcggacgggtgagtaacgcgtgaacaatctgtcccggacagggggataacacttggaaacaggtgctaataccgcataagaccacagggtcccatgaccgaggggtcaaaggagcaatccggttcggggtgagttcgcgtctgattagctggttggtgaggtaacggcccaccaaggcgacgatcagtagccgacctgagagggtgatcggccacattggaactgagacacggtccaaactcctacgggaggcagcagtgggaatattgggcaatgggcgcaagcctgacccagcaacgccgcgtgagggaagaaggttttcggattgtaaacctctgtccttggtgacgaaggaagtgacggtagccaaggaggaagccc

SEQ ID NO: 1726 - DNA, 490 bp, Unknown
  Ascusbbf_1401674, encodes 16S rRNA
agagtttgatcctggctcaggacaaacgctggcggcgtgcctaacacatgcaagtcgaacggggtgtgttccttcgggagcacacttagtggcggacgggtgagtaacgcgtgagcaacctgcccttcagtgggggacaacagctggaaacggctgctaataccgcatgacgtattcccggggcatcccggggataccaaagatttattgctgaaggatgggctcgcgtctgattagatagttggcggggcaacggcccaccaagtcgacgatcagtagccggactgagaggttgaacggccacattgggactgagatacggcccagactcctacgggaggcagcagtggggaatattgggcaatgggcgaaagcctgacccagcaacgccgcgtgaaggaagaaggccttcgggttgtaaacttcttttaagagggacgaagggttgacggtacctcttgaataagccacggctaactacgtgccagca

SEQ ID NO: 1727 - DNA, 490 bp, Unknown
  Ascusbbf_63743, encodes 16S rRNA
agagtttgatcatggctcaggacgaacgctggcggcatgcctaacacatgcaagtcgaacggacgagggtagcaatacccgagttagtggcgaacgggtgagtaacacgtgagcaacctgccctacacactgggatagcagttggaaacgactgataataccggatgagaccacagtcccgcatgggacaggggtcaaagtgaattagcggtgtaggatgggctcgcgtccaattagctagttggtgaggtaacggcccaccaaggcgacgattggtagccgacttgagagagtgatcggccacactggaactgagacacggtccagactcctacgggaggcagcagtggggaatattgggcaatggaggaaactcttacccagcaatgccgcgtgagggatggaggtcctatggattgtaaacctctttgattagggaaaaagaaagtgatggtacctaaagaacaagccccggctaactatgtgccag

SEQ ID NO: 1728 - DNA, 490 bp, Unknown
  Ascusbbf_426582, encodes 16S rRNA
agagtttgatcctggctcaggatgaacgctggcggcgtgcttaacacatgcaagtcgaacggagtacatcaaccgagaccttcgggtctcacctgttgtacttagtggcggacgggtgagtaacgcgtgagcaaccaaccttttgcagagggataacaattagaaatgattgctaataccacataagaccacagcatcgcatggtgcagtgggaaaagttccggcggcaagagacgggctcgcgttcgattagctggatggcggggtaacggcccaccatggcgacgatcgatagccggactgagaggtcgaccggccacattgggactgagacacggcccagactcctacgggaggcagcagtggggaatattgcacaatgggggaaaccctgatgcagcgacgccgcgtgagtgatgacgtatttcggtatgtaaagctcttttagcagggaagaagatgacggtacctgcagaaacagccccggcta

SEQ ID NO: 1729 - DNA, 490 bp, Unknown
  Ascusbbf_36204, encodes 16S rRNA
agagtttgatcctggctcaggacgaacgctggcggcgtgcttaacacatgcaagtcgagcggagacatataacggaaggcttcggccggaagatatatgttttagcggcggacgggtgagtaacgcgtgagcaacctgtccttcacagggggataagataccgaaaggtgttctaataccgcataagaccacagagccgcatggcagaggggtcaaaggagcaatccggtgaagggtgggctcgcgtccgattagatagttggtgaggtaacggcccaccaagtcgacgatcggtagccgacctgagagggtgatcggccacattgggactgagacacggcccagactcctacgggaggcagcagtggggaatattgggcaatgggggaaaccctgacccagcaacgccgcgtggaggaagaaggtcttcggatcgtaaactcctgtcctaagagacgagcaggagacggtatcttaggaggaagccccg

SEQ ID NO: 1730 - DNA, 490 bp, Unknown
  Ascusbbf_103367, encodes 16S rRNA
agagtttgatcatggctcaggatgaacgctggcggcgtgcttaacacatgcaagtcgaacggggtacccatgattgaggcttcggctgattgattggactacctagtggcggacgggtgcgtaacacgtgagtaacctgcccttcagagggggacaacagttggaaacgactgctaataccgcataacgtacagctatcgcatggtagttgtaccaaagattttatcgctgaaggatggactcgcggccgattagctagttggtgaggtaatggctcaccaaggcgacgatcggtagccggactgagaggttgaccggccacattgggactgagacacggcccagactcctacgggaggcagcagtggggaatattgcacaatgggcgcaagcctgatgcagcaacgccgcgttaaggatgaaggttttcggatcgtaaacttatgtcttcagggacgaaatttgacggtacctgaggaggaagccacgg

SEQ ID NO: 1731 - DNA, 490 bp, Unknown
  Ascusbbf_124368, encodes 16S rRNA
agagtttgatcctggctcaggatgaacgctggcggcgtgcttaacacatgcaagtcgaacggagtttataggacagattccttcgggatgaagacttataaacttagtggcggacgggtgagtaacgcgtgggtaacctgccttacacagggggatagcagttggaaacgactggtaataccgcataccttgcattagttgcatgacttatgcaagaaagatttatcggtgtaagatggacccgcgtctgattagctagttggtacggtaacggcgtaccaaggcgacgatcagtagccggcctgagagggtgaacggccacattgggactgagatacggcccagactcctacgggaggcagcagtggggaatattgcacaatggaggcaactctgatgcagcgacgccgcgtgagcgaagaagtatttcggtatgtaaagctctatcagtagggaagataatgacggtacctacagaagaagccccggc

SEQ ID NO: 1732 - DNA, 490 bp, Unknown
  Ascusbbf_111895, encodes 16S rRNA
agagtttgatcatggctcaggatgaacgctggcggcgtgcctaacacatgcaagtcgaacgaggtattttgattggagattcgtcaaagatctttataccgagtggcggatgggtgagtaacgcgtggagaacctgcccttatctgggggataacaactggaaacggttgacaataccgcatacgcttccgtggtcgcatgaccgtggaaggaaagatttatcggataaggatggctccgcgtcggattagccagttggcggggtaacggcccaccaaagcgacgatccgtagccggcctgagagggcgaccggccacattgggactgagacacggcccagactcctacgggaggcagcagtgggggatattgcacaatgggggaaaccctgatgcagcgacgccgcgtggaggaagaagtatttcggtatgtaaactcctatcagcagggaagaaaacgacggtacctgactaagaagccccggctaac

SEQ ID NO: 1733 - DNA, 490 bp, Unknown
  Ascusbbf_72947, encodes 16S rRNA
agagtttgatcctggctcaggatgaacgctagcggcaggcttaacacatgcaagtcgaggggcatcacgagtagcaatacttggtggcgaccggcgcaagggtgcgtaacgcgtgagcaacatgcccgtatcagggggataatccagggaaacttggtctaataccccatagcaattgaaggaggcatcttctttgatttaaagctttggtggatacggattggctcgcgtgacattagctagatggtaaggtaacggcttaccatggctacgatgtctaggggttctgagaggaaggtcccccacactggaactgagacacggtccagactcctacgggaggcagcagtgaggaatattggacaatggatggaaatctgatccagccatgccgcgtgcaggaagacggccctatgggttgtaaactgcttttatatgggagcaataagacctacgagtaggttgatgagagtaccatatgaataagcac

SEQ ID NO: 1734 - DNA, 490 bp, Unknown
  Ascusbbf_80, encodes 16S rRNA
agagtttgatcatggctcaggatgaacgctggcggcatgcctaacacatgcaagtcgaacggagttgttggtagcttgctatcgacaacttagtggcggacgggtgagtaacgcgtgagtaacctgcctctaagagggggataacgttctgaaaagaacgctaataccgcatataattacgaaatcgcatgattttgtaatgaaaggagcaatccgcttagagatggactcgcgtctgattagcttgatggcggggtaacggcccaccatggcgacgatcagtagccggactgagaggttgaacggccacattgggactgagacacggcccagactcctacgggaggcagcagtgggggatattgcgcaatgggggaaaccctgacgcagcaatgccgcgtgaaggatgaaggttttcggattgtaaacttcttttgttaaggacgataatgacggtacttaacgaataagctccggctaactatgtgcc

SEQ ID NO: 1735 - DNA, 490 bp, Unknown
  Ascusbbf_1581, encodes 16S rRNA
agagtttgatcatggctcaggatgaacgctagctacaggcttaacacatgcaagtcgagcggaacagcttcggctgtttagcggcagacgggtgagtaacacgtatccaacctttcccttactcgggtatagcctcgggaaactgagagtaatccccgatgttgtgtacgaatagcattttttgcacactaaagatttatcggtaaggggtggggatgcgttccattaggtagtaggcggggcaacggcccacctagccgatgatggataggggttctgagaggaaggtcccccacattggaactgcgacacggtccaaactcctacgggaggcagcagtgaggaatattggtcaatggtcggaagactgaaccagccaagtagcgtgcaggatgacggccctatgggttgtaaactgcttttgtgcgggaataacgtacgccacgtgtggtgtagtgcatgtaccgtacgaataaggatcggctaactc

SEQ ID NO: 1736 - DNA, 490 bp, Unknown
  Ascusbbf_1828119, encodes 16S rRNA
agagtttgatcctggctcaggatgaacgctggcggcgtgcttaacacatgcaagtcgaacgaagcacctctaatcgaagattgagaaagcttgcttttgattgattcaccttgaggtgactgagtggcggacgggtgagtaacgcgtgggtaacctaccctatacagggggataacagttggaaacgactgctaataccgcataagcgcacagggccgcatggtctagtgtgaaaaactccggtggtataggatggacccgcgtctgattagctagttggtgaggtaacggctcaccaaggcgacgatcagtagccgacctgagagggtgaccggccacattgggactgagacacggcccaaactcctacgggaggcagcagtggggaatattgcgcaatgggcgaaagcctgatgcagcgacgccgcgtgaacgaagaagtatttcggtatgtaaagttctatcagcagggaagaaaaatgacggtacc

SEQ ID NO: 1737 - DNA, 490 bp, Unknown
  Ascusbbf_32376, encodes 16S rRNA
agagtttgatcatggctcaggatgaacgctggcggcgtgcctaacacatgcaagtcgagcgagaaacctttgattgacacttcggttgatttcaaaggcggaaagcggcggacgggtgagtaacgcgtaggcaacctgccccttgcagagggatagcctcgggaaaccgggattaaaacctcataacaccgaacctacacatgttcgatcggtcaaagatttatcggcaagggatgggcctgcgtctgattagctggttggtggggtaacggcctaccaaggcaatgatcagtagccgacctgagagggtgatcggccacattggaactgagacacggtccaaactcctacgggaggcagcagtggggaatattgcacaatgggcgaaagcctgatgcagcaacgccgcgtgagcgatgaaggcggattcgtcgtaaagctctgtccttggggaagaagaactgacggtacccttggaggaagccccggc

SEQ ID NO: 1738 - DNA, 490 bp, Unknown
  Ascusbbf_97694, encodes 16S rRNA
agagtttgatcctggctcaggatgaacgctagcgacaggcctaacacatgcaagtcgaggggtagcatgaaagtagcaatacttttgatgacgaccggcgcacgggtgagtaacgcgtatgcaacctacctactacaggggaatagcccgaagaaattcggattaatgccgcataatacaggggcaccgcatggtgatatttgttaaagattaattggtagtagatgggcatgcgttccattagccagttggtgaggtaacggctcaccaaagcaacgatggataggggaactgagaggtttatcccccacactggtactgagacacggaccagactcctacgggaggcagcagtgaggaatattggtcaatgggcgagagcctgaaccagccaagtcgcgtgaaggatgactgccctatgggttgtaaacttcttttgtactggggtaaaaaagaggacgtgtcctttcttgcaagtacagtacgaata

SEQ ID NO: 1739 - DNA, 490 bp, Unknown
  Ascusbbf_1263, encodes 16S rRNA
agagtttgatcatggctcagaacgaacgctggtggcgtgtcttatacatgcaagtcgagcggtgcagcaatgcatagcggcgaacgggtgagtaacgcgtaagcaatctgccccctgctcgggaatagccgtgccaacgcgcgggtaataccggatatagtggccctggacatccggggttgacaaaagatttatcggcaggggatgagcttgcgtccgattagctagttggcggggcaacggcccaccaaggcgacgatcggtagccggcctgagagggtgatcggccacattgggactgagatacggcccagactcctacgggaggcagcagtagggaatattgcacaatgggggaaaccctgatgcagcaacgccacgtgtgggaagaagcatttcggtgtgtaaaccactgtcgtgagggaataaggctgattttcggatcagttgaatgtacctcgagaggaagcaccggcaaacttcgtgccag

SEQ ID NO: 1740 - DNA, 490 bp, Unknown
  Ascusbbf_509, encodes 16S rRNA
agagtttgatcatggctcaggacgaacgctggcggcgtgcttcatacatgcaagtcgaacgagaatctgacttcggtcagaggaaagtggcggacgggtgagtaatatgtagagaatctgcccttaagtgggggacaacagttggaaacgactgctaataccgcatatgagcgtagctgagatgctattcttgaaaacttcggtgcttagggatgagtctgcatctgattagctagttggcggtgtaatggaccaccaaggcgacgatcagtagctggtttgagaggatgatcagccacaatgggactgagacacggcccatactcctacgggaggcagcagtagggaattttgcgcaatggggggaaccctgacgcagcaacgccgcgtgattgaataagcccttcggggtgtaaagatctgtcagtggggacgaaacttgacggtacccacagaggaagcatcggctaactccgtgccagcagccgcg

SEQ ID NO: 1741 - DNA, 490 bp, Unknown
  Ascusbbf_8151, encodes 16S rRNA
agagtttgatcctggctcaggacaaacgctggcggcgtgcctaacacatgcaagtcgaacgaagcactgtggaaagagacttcggtcaattgaaactttgacttagtggcggacgggtgagtaatgcatgagcaacctgccctggagagggggacaacagctggaaacggctgctaataccgcatgatgtcaccggaaggcatcttctggtgaccaaagatttatcgctctgggatgggctcatgtctgattagatagttggcggggcaacggcccaccaagtctgcgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttatcagggacgaagaacgtgacggtacctgatgaataagccacg

SEQ ID NO: 1742 - DNA, 490 bp, Unknown
  Ascusbbf_25712, encodes 16S rRNA
agagtttgatcatggctcaggacgaacgctggcggcgtgcttaacacatgcaagtcgagcggaaaggccccttcgggggtactcgagcggcgaacgggtgagtaacacgtgagcaacctgcccctgacttcgggataagcctgggaaaccgggtctaataccggatatgacgcgtcaccgcatggtgtgcgtgtggaaagattttttggttggggttgggctcgcggcctatcagcttgttggtggggtgatggcctaccaaggcgacgacgggtaaccggcctgagagggcgaccggtcacactgggactgagacacggcccagactcctacgggaggcagcagtgggaatattgcgcaatgggcggaagcctgacgcagcgacgccgcgtgggggatgacggccttcgggttgtaaacctctttcagcaccgacgaagcggaagtgacggtaggtgcagaagaagcgccggctaactacgtgccagca

SEQ ID NO: 1743 - DNA, 490 bp, Unknown
  Ascusbbf_101725, encodes 16S rRNA
agagtttgatcatggctcaggacgaacgctggcggcgtgcctaatacatgcaagtcgagcgagccgaactaattgattaccttcgggtatgaagttagggaagcgagcggcggatgggtgagtaacacgtgggtaacctaccctatagtctgggataccacttggaaacaggtgctaataccggataaaaggagagatcacatgatttctttttgaaaggcggcgtaagctgtcgctaaaggatggacccgcggtgcattagctagttggtaaggtaacggcttaccaaggcaacgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaagatagtgagagtaactgctcat

SEQ ID NO: 1744 - DNA, 490 bp, Unknown
  Ascusbbf_1332114, encodes 16S rRNA
agagtttgatcctggctcagaacgaacgctggcggcgcgtcttaagcatgcaagtcggacggcaagatgccttcgggcatcctagagtggcgaacgggtgagtaacacgtaagtgatctgccctgcagttggggatagcctgtggaaacacagggtaataccggatgagatgacaatgattgaactatgtcaagaaagtggctacggccacgctgcgggatgagcttgcggctcattagctagttgggggtgtaacggaccaccaaggcgacgatgagtagccggcctgagagggtgaacggccacattgggactgagacacggcccagacacctacgggaggcagcagctaagaatattccgcaatggggggaaccctgacggagcgacgccgcgtgaacgatgaaggcagagatgttgtaaagttcttttattgctgaagaataaggggggcagggaatggcctcctgatgacgttaggcgatgaata

SEQ ID NO: 1745 - DNA, 490 bp, Unknown
  Ascusbbf_107547, encodes 16S rRNA
agagtttgatcctggctcaggacgaacgctggcggcgtgcttcatacatgcaagtcgaacggggtccattcagtggcaacactgaggaagatctagtggcgaacgggtgagtaacacgtgaggaacctatcccggtctctggaataacaagtggaaacatttgctaataccggatgccgtcgctatctctcatggggtggtgacgaaagatttatcggattgggcgggcctcgcggcctatcagcttgttggtggggtaatggcctaccaaggcatcgacgggtagctggtctgagaggatgatcagccacactgggactgagacacggcccagactcctacgggaggcagcagtagggaatcttgcgcaatgggcgaaagcctgacgcagcaacgccgcgtgcgggaagaaggctctcgggttgtaaaccgctttcagtaggaacgaatttgacggtacctgcagaagaaggtgcggccaactacgtgc

SEQ ID NO: 1746 - DNA, 490 bp, Unknown
  Ascusbbf_304588, encodes 16S rRNA
agagtttgatcatggctcagaacgaacgctggcggcgtgcctaacacatgcaagtcgagcgcgaaaggggcaacctgagtagagcggcggacgggtgcgtaacacgtgggtaatctgccctggagattcagataaccactcgaaagggtggctaatacgaaataagcccacggcctcttcggaggctgagggaaaaggtggcctctacatgtaagctaccactccaggatgagcccgcggcccatcagctagttggcggggtaatggcccaccaaggcaacgacgggtagctggtctgagaggacgatcagccacactgggactgagacacggcccagactcctacgggaggcagcagtggggaattttgcgcaatggacgaaagtctgacgcagcaacgccgcgtgtgtgatgaaggttttcggatcgtaaagcactttcgtccgggaagaaaaagcaggtgctaatcagcctgtattgacggtaccgg

SEQ ID NO: 1747 - DNA, 490 bp, Unknown
  Ascusbbf_1490159, encodes 16S rRNA
agagtttgatcctggctcaggatgaacgctggcggcgtgcctaatacatgcaagtcgaacgggtgcagcaatgcattagtggcgaacgggtgagtaacacgttggtgacctgccccaaagatgggaatatcacctggaaacgggtggcaaaaccgaataagcttggctcagtcagaaaaggccaagtaaaagcgaaagctactttgggaggggcctgcggcccatcagttagttggtgagggtaacggcccaccaagacgaagacgggtaggggacctgagagggtggtcccccacaatggagctgaaacacggtccatacacctgcgggtggcagcagtagggaacattgcttaatgggcgaaagcctgaagcagcaacgccgcgtggacgaaggaggccttcgggttgtaaagtccttttacgagggaagaggaaggacggtacctcgtgaataagtctcggctaactacgtgccagcagccgcggta

SEQ ID NO: 1748 - DNA, 490 bp, Unknown
  Ascusbbf_617640, encodes 16S rRNA
agagtttgatcctggctcagaacgaacgctggcggcgtggattaggcatgcaagtcgtacgcgaaagtttccttcggggaataagtagagtggcgaactggtgagtacaaggtgactaacctgcccttgagtgggggataacttcgggaaaccggagctaataccgcatggcttcttacttccttggaggtaagaataaagcagtgatgcgctcaaggatggggtcaccccccattagcttgttggtagggtaatggcctaccaaggctgcgatgggtagctggactgagaggttgaccagccacactgggactgagatacggcccagactcctacggggggcagcagtctagaggcttcgacaatgcccgaaagggtgatcgagcgacgccgcgtgtgggatgaaggttttcggattgtaaaccacttttgtttgggaagaaggcttgtatcgtgaatatgagattgacggtaccaaacgaataagccc

SEQ ID NO: 1749 - DNA, 470 bp, Unknown
  Ascusbbf_96664, encodes 16S rRNA
agagtttgatcctggctcagaacgaacgctggcggcaggcctaacacatgcaagtcgaacgcccccttcggggggagtggcgcacgggtgagtaacgcgtgggaacctaccccgaggtccgggacaaccgctggaaacggcggctaataccggatgtgtcctgagggagaaagatttatcgccttgggaggggcccgcgtccgattaggtagttggtgtggtaacggcgcaccaagccatcgatcggtagctggtctgagaggatgatcagccacactgggactgagacacggcccagactcctacgggaggcagcagtggggaatattggacaatgggcgcaagcctgatccagccatgccgcgtgagtgaagaaggccttagggttgtaaagctctttcacgggcgacgatgatgacggtagcccgagaagaagccccggctaactccgtgccagcagccgcggtaat

SEQ ID NO: 1750 - DNA, 354 bp, Unknown
  Ascusbbf_1901765, encodes 16S rRNA
agagtttgatcctggctcaggatcaacgctggcggcgtgcctaatgcatgcaagtcgaacggggtggccttcgggtcacttacgtggcggacgggtgaggaacacgtgggcaacctgcctgatggagggggataaccgctggaaacagtgggtaataccgcataatcctggatctcgagtgggagatatagggaaagtcgcaagacgccgacagaggggcctgcgtccgattagctagacggtggggtaacggcctaccgtggcagtgatcggtagctggtttgagaggatgatcagccacacggggactgagacacggccccgactcctacgggagccagcagccgcggtaat

SEQ ID NO: 1751 - DNA, 490 bp, Unknown
  Ascusbbf_438175, encodes 16S rRNA
agagtttgatcatggctcaggacgaacgctggcggcgtgcttaacacatgcaagttgaacgagaattttttaattaatttcttcggaaagagattaaagaaggaaagtagcgaacgggtgagtaacacgtgagaaacctgcctttcacaaagggatagcctcgggaaaccgggattaataccttatgacacttagatatcgcatgataattaagttaaagaatttcggtgaaagatggtctcgcgtctgattagctagttggtaaggtaacggcttaccaaggcgacgatcagtagccggattgagaggttgaacggccacactggaactgagacacggtccagactcctacgggaggcagcagtggggaattttgcacaatggggggaaccctgatgcagcgacgccgcgtgaacgatgaaggtcttcggattgtaaagttctgtccttagtgaagataatgactgtaactaagaagcaagccctggct

SEQ ID NO: 1752 - DNA, 470 bp, Unknown
  Ascusbbf_98712, encodes 16S rRNA
agagtttgatcctggctcagaacgaacgctggcggcaggcttaacacatgcaagtcgaacggtctcttcggaggcagtggcagacgggtgagtaacgcgtgggaacatacctttcggtacggaacaacagttggaaacgactgctaataccgtatacgccctgagggggaaagatttatcgccgagagattggcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgccggtgaagataatgacggtaaccggtaaagaagccccggctaacttcgtgccagcagccgcggtaat

SEQ ID NO: 1753 - DNA, 490 bp, Unknown
  Ascusbbf_462120, encodes 16S rRNA
agagtttgatcctggctcaggatgaacgctagcgataggcttaacacatgcaagtcgaggggcatcattattttagcttgctaagatagatggcgaccggcgcacgggtgcgtaacgcgtatgcaacctacctgtaattaggggataacccggtgaaagtcggactaataccctatatgctcttagagtcacatgatttatagaggaaagatttattgattacagatgggcatgcgtcccattagctggttggtaaggtaacggcttaccaaggcgacgatgggtagggggactgagaggttgaccccccacactggtactgagacacggaccagactcctacgggaggcagcagtgaggaatattggtcaatgggcgagagcctgaaccagccaagtcgcgtgaaggaagacggttctatggattgtaaacttcttttgtagaggagtaatggcggttacgcgtaaccgagatgcaagtactctacgaa

SEQ ID NO: 1754 - DNA, 470 bp, Unknown
  Ascusbbf_144723, encodes 16S rRNA
agagtttgatcatggctcagaacgaacgctggcggcaggcctaacacatgcaagtcgaacgctctagcaatagagagtggcgcacgggtgagtaacacgtgggaatctacctgatagtctgggataacagcgggaaactgctgctaataccggatacgcccttagggggaaagatttatcgctatcagatgagcccgcgttagattagctagttggtgaggtaatggctcaccaaggctccgatctatagccggtctgagaggacgatcggccacactgggactgagacacggcccagactcctacgggaggcagcagtggggaatattgggcaatgggcgcaagcctgacccagccatgccgcgtgtgtgatgaaggccttagggttgtaaagcacttttagtagtgaagatgatgactgtagctacagaaaaagccccggctaacttcgtgccagcagccgcggtaat

SEQ ID NO: 1755 - DNA, 490 bp, Unknown
  Ascusbbf_377012, encodes 16S rRNA
agagtttgatcctggctcaggatgaacgctggcggcgtgcttaacacatgcaagtcgaacgtgattgcacatctagcaatagaggtgcatgaaagtggcgaacgggtgagtaacacgtggataacctatcctgaagtgggggataacgacgggaaactgtcgctaataccgcatgagcttgatggcctgggaatgtcgtcaaggaaagctttagtgctttaggaggggtctgcgtccgattagctagatggtggggtaacggcctaccatggcgatgatcggtagctggtctgagaggatggtcagccacacgggaactgagatacggtcccgactcctacggggggcagcagtgaggaatattgcacaatgggggaaaccctgatgcagcaacgccgcgtggaggaagaaggccttcgggttgtaaactccttttccaggggacgagagaggacggtaccctgggaataagtcacggctaactacgtgc

SEQ ID NO: 1756 - DNA, 490 bp, Unknown
  Ascusbbf_294227, encodes 16S rRNA
agagtttgatcatggctcaggatgaacgctagcggcaggcctaacacatgcaagtcgaggggtaacagaggagcttgcttctgctgacgaccggcgcacgggtgagtaacgcgtatgcaacctaccttttacagggagatagcccggagaaatccggattaatatcccatacgattgttaagacacaagtctctacaaagaaagcttcggcggtattagatgggcatgcgtcctattagttagttggtaaggtaacggcttaccaagactccgataggtagggggcctgagagggtgaccccccacactggtactgagacacggaccagactcctacgggaggcagcagtgaggaatattggtcaatggaggcaactctgaaccagccatgccgcgtgcaggaagaatgccctatgggttgtaaactgcttttatttaggaagaatccccagtacgtgtactgggttgacggtactaaacgaataaggac

SEQ ID NO: 1757 - DNA, 490 bp, Unknown
  Ascusbbf_1776505, encodes 16S rRNA
agagtttgatcatggctcaggacgaacgctggcggcgtgcctaatacatgcaagtcgaacgagtgacccctcggtggcaacaccttgggcgatctagtggcgaacgggtgagtaacacgtgaggaacctgccccgaagactgggataaccagaggaaactctggctaataccggatgccctcaccggatcgcatgatctggtgaggaaatggattccgcttcgggagggtctcgcggcctatcagcttgttggtggggtaacggcctaccaaggcgtcgacgggtagctggtctgagaggacgatcagccacactgggactgagacacggcccagactcctacgggaggcagcagtagggaatcttgcgcaatgggcgaaagcctgacgcagcaacgccgcgtgcgggatgaaggccttcgggttgtaaaccgctttcagcagggacgaaaatgacggtacctgcagaagaagccccggccaactacgtg

SEQ ID NO: 1758 - DNA, 490 bp, Unknown
  Ascusbbf_690605, encodes 16S rRNA
agagtttgatcctggctcaggatgaacgctagcggcaggcctaatacatgcaagtcgaacggaacaattttttcggagattgtttagtggcgcacgggtgagtaacgcgtacacgacctacctataagagggggatagccttgggaaactgagagtaataccgcatatgatttcgagattgcatgattttgaaattaaagctgaggcgcttatagatgggtgtgcgttctattagctagttggtagtgtaacggactaccaaggcgacgatagatagggggcgtgagagcgtggccccccaaacgggtactgagacacggacccgactcctacgggaggcagcagtaaggaatattggacaatggacgcaagtctgatccagccatgccgcgtgcaggatgaaggccctctgggttgtaaactgcttttatcagggaagaaaacccgatacgtgtatcggattgccggtacctgaggaataagcaccggc

SEQ ID NO: 1759 - DNA, 490 bp, Unknown
  Ascusbbf_286093, encodes 16S rRNA
agagtttgatcctggctcagattgaacgctagcggaatgctttacacatgcaagtcgaacggcagcgcggacttcggtctggcggcgagtggcgaacgggtgagtaatgcatcggaatgtacccagtagcgggggataactacgcgaaagcgtggctaataccgcatacgccctacgggggaaagggggggatcttcggacctctcactattggagcagccgatgtcagattagctagttggtggggtaaaggcctaccaaggcaacgatctgtagctggtttgagaggacgaccagccacactgggactgagacacggcccagactcctacgggaggcagcagtggggaattttggacaatgggggaaaccctgatccagccattccgcgtgtgtgatgaaggccttcgggttgtaaagcacttttggcaggaaagaaatgactcgggccaataccccgggttgatgacggtacctgcagaataagcac

SEQ ID NO: 1760 - DNA, 490 bp, Unknown
  Ascusbbf_711651, encodes 16S rRNA
agagtttgatcctggctcaggatcaacgctggcggcgtgcctaatgcatgcaagtcgaacggggtctccttcgggggactaacgtggcggacgggtgaggaacacgtggccaatctgcccaccggcagggggtagcccgcggaaacgcggggtaattccgtatacgctggctcgtcttgtgggatgagtcaggaaaggaccttcgggttcaccggtggaggaggctgcgaccgattagctagctggtggggtaacggcctaccagggcgatgatcggtagctggtctgagaggatgatcagccacacggggactgagacacggccccgactcctacgggaggcagcagcaaggaattttccgcaatgggcgaaagcctgacggagcaacgccgcgtgcgggatgacgcgtttcggcgtgtaaaccgctgttcgtggggacgaagcactgacggtacccacggaggaaggcccggctaactacgtgccagc

SEQ ID NO: 1761 - DNA, 490 bp, Unknown
  Ascusbbf_1606975, encodes 16S rRNA
agagtttgatcctggctcaggatgaacgctagcggcaggcctaatacatgcaagtcgaacgggatccagggcgtagcttgctacaaactggtgagagtggcgcacgggtgcgtaacgcgtgagcaacctacccatatcagggggatagcccgaagaaattcggattaacaccgcatgacacagcgactcggcatcgagatgttgttaaatatttataggatatggatgggctcgcgtgacattagctagttggtaaggtaacggcttaccaaggctacgatgtctaggggctctgagaggagaatcccccacactggtactgagacacggaccagactcctacgggaggcggcagtaaggaatattggtcaatggagggaactctgaaccagccatgccgcgtgcaggatgactgccctatgggttgtaaactgcttttgtacgggaataaacactggtacgtgtaccagcttgaatgtaccgtaagaat

SEQ ID NO: 1762 - DNA, 366 bp, Unknown
  Ascusbbf_438397, encodes 16S rRNA
agagtttgatcctggctcaggacgaacgctggcggcgtgcctaatacatgcaagtcgaacgaactctggtattgattggtgcttgcatcatgatttacatttgagtgagtggcgaactggtgagtaacacacgggaaacctgcccagaagcgggggataacacctggaaacagatgctaataccgcataacaacttggaccgcatggtccaagtttgaaagatggcttcggctatcacttttggatggtcccgcggcgtattagctagatggtggggtaacggctcaccatggcaatgatacgtagccgacctgagagggtaatcggccacattgggactgagacacggccagcagccgcggtaat

SEQ ID NO: 1763 - DNA, 478 bp, Unknown
  Ascusbbf_584144, encodes 16S rRNA
agagtttgatcatggctcaggatgaacgctggcggcgtgcctaatacatgcaagtcgagcggtaaggcccttcggggtacacgagcggcggacgggtgagtaacacgtaagaacataccccaaactgagggataactgctcgaaagagtagctaataccgcatgtgctcttcggagtaaagcttcggcggtttgggaatggcttgcgtccgattagctagttggtaaggtaatggcttaccaaggcgacgatcggtagctggtctgagaggatgatcagccacactgggactgagacacggcccagactcctacgggaggcagcagtagggaattttccacaatgggggcaaccctgatggagcaacgccgcgtgcaggatgaatgccttcgggttgtaaactgcttttgtctgtgacgaatatgacggtagcagacgaataaggatcggctaactacgtgccagcagccgcggtaat

SEQ ID NO: 1764 - DNA, 490 bp, Unknown
  Ascusbbf_423792, encodes 16S rRNA
agagtttgatcctggctcagaacgaacgctggcggcaggcttaacacatgcaagtcgagcgccccgcaaggggagcggcagacgggtgagtaacgcgtgggaatctacccatctctacggaataactcagggaaacttgtgctaataccgtatacgcccttcgggggaaagatttatcggagatggatgagcccgcgttggattagctagttggtgaggtaaaggctcaccaaggcgacgatccatagctggtctgagaggatgatcagccacactgggactgagacacggcccagactcctacgggaggcagcagtggggaatattcgtcaatgggggaaaccctgaacgagcaatgccgcgtgaaggatgaaggtcctatggattgtaaacttctgttgttagggaagaacgactggtataggaaatgatatcagtgtgacggtacctttccagaaagctccggctaactacgtgccagcagccgcgg

SEQ ID NO: 1765 - DNA, 488 bp, Unknown
  Ascusbbf_1447032, encodes 16S rRNA
agagtttgatcatggctcagggctaacgctggcggcgcgcctaacacatgcaagtcgaacgaacccttcggggttagtggcagacgggtgagtaatgcgtggataatgtgcctttttgctggggataccgtttcgaaaggaacgttaataccgaatgtgctggacgcatcgcatggtgtgtttagtaaactgttagggtgaaaagagcagtccgcgttctatcagcttgttggtggggtaatggcctaccaaggctacgacggataactggtctgagaggatgatcagtcacactggaactgagacacggtccagactcctacgggaggcagcagtgaggaatcttgcacaatgggcgaaagcctgatgcagcgacgccgcgtgagggactaaggccttcgggttgtaaacctctgtcagtagggaagaagtatgacggtacctactgaggaagcatcggctaactacgtgccagcagccgcggtaat

SEQ ID NO: 1766 - DNA, 490 bp, Unknown
  Ascusbbf_1075052, encodes 16S rRNA
agagtttgatcatggctcaggatgaacgctggcagtgtgccttagacatgcaagtcggacggggcgctttcttttatcctttcggggtgattggttggttgcctagtggcgtacgggtgagtaacacgtgggtgacctgccctcaagtgggggataactctgggaaactggggctaatcccgcatgtgctggcacttttttggggtgttagtaaaggaactttgttctgcttggggatgggtccgcggcctatcagcttgttggtgtggtaatggcgcaccaaggctttgacaggtagccggcctgagagggtgttcggccacaggggcactgagatacgggccccactcctacgggaggcagcagttaggaattttcgacaatgggggaaaccctgatcgagcgacactgcgtgagggatgaaggtcttcggatcgtaaacttctaatagagggacgatggtgacggtacctcttgattagcaccggct

SEQ ID NO: 1767 - DNA, 490 bp, Unknown
  Ascusbbf_1015163, encodes 16S rRNA
agagtttgatcctggctcaggatgaacgctggcggcgtgcctaacacatgcaagtggagcgacgaacccggacttgtccgggggcaaagccgcgaacgggtgagtaacacgtgggtcacctgccccaatgaccgggacaactcgaggaaactcgagctaataccggatgtgctcttcggaggaaaggaagcttcggcctccgcattgggatgggcccacggcgcattagcttgttggtgaggtaaaagctcaccaaggcgacgatgcgtagctggtctgagaggacgatcagccacactggaactgaggtacggtccagactcctacgggaggcagcagtggggaatcttgcgcaatgcacgaaagtgtgacgcagcaacgccgcgtgggggaagaagatcttaggatcgtaaacccctttcagttgggacgagggttacacggtgaatagccggcgtaactgacggtaccttcagaagaagccccggct

SEQ ID NO: 1768 - DNA, 470 bp, Unknown
  Ascusbbf_1321840, encodes 16S rRNA
agagtttgatcatggctcagaacgaacgctggcggcatgcctaacacatgcaagtcgaacgagaccttcgggtctagtggcgcacgggtgcgtaacgcgtgggaacctgcctttaggttcggaatacctcaccgacaggtgtgctaataccgaataatgtcttcggaccaaagatttatcgcctttagatgggccctcgttggcttagctagttggtggggtaacggcctaccaaggcgacgatccatagctggtcttagaggatgatccgcaacactgggactgagacacggcccagactccgacgggaggcagcagtggggaagattggacaatgggcgaaagcctgatccagcaatgccgcgtgagggatgaaggccttagggttgtaaagctcttttaccagggatgataatgacagtacctggagaataagctccggctaactccgtgccagcagccgcggtaat

SEQ ID NO: 1769 - DNA, 490 bp, Unknown
  Ascusbbf_1542161, encodes 16S rRNA
agagtttgatcctggctcaggacgaacgctggcggcgtgcctaacacatgcaagtcgagcgaggtccaaccagtggcaacactggagaagacctagcggcgaacgggtgagtaacgcgtgaggaacttgccccggagttcgggataactcgaggaaactcgagctaataccgaatgccctcatctgatcgcatggtcggatgaggaaagattcatcgctccgggagagcctcgcggcctatcagctagttggtggggtaacggcctaccaaggcatcgacgggtagctggtctgagaggacgatcagccacactgggactgagacacggcccagactcctacgggaggcagcagtggggaatcttgcgcaatgggcgaaagcctgacgcagcaacgccgcgtgcgggatgacggccttcgggttgtaaaccgcattcagcagggacgaaattgacggtacctgcagaagaagccccggccaactacgtgc

SEQ ID NO: 1770 - DNA, 490 bp, Unknown
  Ascusbbf_1623667, encodes 16S rRNA
agagtttgatcctggctcaggataaacgctagcggcaggcctaacacatgcaagtcgaggggcagcgtaaggagtagcaatactttttgacggcgaccggcgcacgggtgcgtaacgcgtatgcaacctaccgttcacagggggatagtcagaggaaactttgaataataccgcataaaacaattgatcggcatcgattgattgttaaggtggcgacacggtgaacgatgggcatgcgttcgattagatagttggtgaggtaacggctcaccaagtcgacgatcgatagggggtctgagaggattatcccccacactggtactgagatacggaccagactcctacgggaggcagcagtgaggaatattgggcaatgggcggaagcctgacccagccatgccgcgtgcaggaagacggccctatgggttgtaaactgcttttaaacaggaagaataagatctacgtgtaggtcgatgacggtactgtaaga

SEQ ID NO: 1771 - DNA, 490 bp, Unknown
  Ascusbbf_1063076, encodes 16S rRNA
agagtttgatcatggctcaggatgaacgctagcgggaggcctaacacatgcaagccgagcggtagagattcttcggaatcttgagagcggcgcacgggtgcggaacacgtgtgcaacctgcctttatctgggagatagcctttcgaaaggaagattaataccccataatataagaaacggcatcgttttttattgaaagctccggcggatagagatgggcacgcgcaagattagatagttggtgaggtaacggctcaccaagtcaatgatctttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtatagggataaacctactcacgtgtgagtagctgaaggtactatacgaataagcaccggct

SEQ ID NO: 1772 - DNA, 490 bp, Unknown
  Ascusbbf_88663, encodes 16S rRNA
agagtttgatcatggctcaggatgaacgctagcggcaggcctaatacatgcaagtcgaacgcgattgcggtgcttgcaccgcatgaaagtggcgtacgggtgcgtaacgcgtgagcaacctaccgttgtctgggggatagcccggagaaatccggattaataccgcataatattagagagcagcattgctttctgatcaaacatttatgggacagcgatgggctcgcgtgacattagctagttggagtggtaacggcacaccaaggcgacgatgtctaggggatctgagaggatgaccccccacactgggactgagacacggcccagactcctacgggaggcagcagtaaggaatattggtcaatggaggcaactctgaaccagccatgccgcgtgcaggaagaatgccctctgggttgtaaactgcttttatcagggaataaacccttctacgtgtaggaggctgaatgtacctgaggaataaggatcg

SEQ ID NO: 1773 - DNA, 490 bp, Unknown
  Ascusbbf_350795, encodes 16S rRNA
agagtttgatcatggctcaggacgaacgctggcggcgcgcctaacacatgcaagtcgaacggaactagtgaccggagggtagatggttctatcttgcgatcactagttcagtggcggacgggtgagtaaaacatgagcaacctgcctaatagagggggatagcttttggaaacagaagataataccgcatacatcagagatttcgcatgaagtttttggaaaaggagcaatccgctattagatgggctcatgtccgattagcttgttggtggggtaatggcttaccaaggctacgatcggtagccgtactgagaggttcaacggccacattgggactgagacacggcccagactcctacgggaggcagcagtgaggaatattgcgcaatggaggaaactctgacgcagcgacgccgcgtgaaggaagacggtcttcggattgtaaacttctgtcttcagggaagaaaaaaatgacggtacctggggagga

SEQ ID NO: 1774 - DNA, 490 bp, Unknown
  Ascusbbf_318108, encodes 16S rRNA
agagtttgatcctggctcagaatgaacgttggcggcgtggattaggcatgcaagtcgagcggcaaggtttttttcgtaagattgaaaccctagagcggcggaagggataggacaatatagatacgtgcctcttagcccaggatagcgtctggaaacgggcgataatactggatgaggtcttaggatcaaaggtgagattccgctaagagatcggtctatagcctattagttagttggtagggtaacggcctaccaagacgatgatgggtacggggcgtgagagcgcgaccccgatcactgggactgagacactgcccagacgcctacgggcggctgcagtcgagaatcttcggcaatggacgcaagtctgaccgagcgacgccgcgtgtatgatgaaggccttcgggttgtaaagtactgtcgattgggcggaagttagagggggtaatctctctcttttgacctatcatttgaggaaggacgggctaag

SEQ ID NO: 1775 - DNA, 490 bp, Unknown
  Ascusbbf_14471, encodes 16S rRNA
agagtttgatcatggctcaggattaacgctggcggcgtgcctaatacatgcaagtcgaatggtggtagcaatacaaaccatggcgaacgggtgagtaacacgtaggtaacctatcttagcgacgaggataaccgttggaaacgacggataatactggataggacatcaaaaagggcatccttagatgtttaaaggagcaatccacggtaagaggggcctgcggcgcattagctagttggtggggtaaaggcctaccaaggccaagatgcgtagccggactgagaggttaaacggccacaatggaactgagaacggtccatactcctacgggaggcagcagtagggaattttcggcaatgggcgaaagcctgaccgagcaacgccgcgtgaacgaagaagttattcgtaatgtaaagttcttttattagggaagaaaaaacaaattgacggtacctaatgaataagctccggctaactacgtgccagcagc

SEQ ID NO: 1776 - DNA, 490 bp, Unknown
  Ascusbbf_9650, encodes 16S rRNA
agagtttgatcatggctcaggacgaacgctggcggcacgcttaacacatgcaagtcgaacgagcgaaaggtgcttgcacctctagctagtggcggacgggtgagtaacacgtgagcaatctgcctttcggtgggggataccaattggaaacgattgttaataccccataacataacgaagccgcatgactttgttatcaaagatttattgccgaaagatgagctcgcgtctgattaggtagttggtgaggtaacggctcaccaagccgacgatcagtagccggactgagaggttgaacggccacattgggactgagacacggcccagactcctacgggaggcagcagtggggaatattgcacaatgggcgaaagcctgatgcagcgatgccgcgtgagggaagaaggttttaggattgtaaacctctgtcttcggggacgataatgacggtacccgaggaggaagctccggctaactacgtgccagcagc

SEQ ID NO: 1777 - DNA, 490 bp, Unknown
  Ascusbbf_15655, encodes 16S rRNA
agagtttgatcatggctcaggacgaacgctggcggcgtgcctaacacatgcaagtcgagcggagccaaccgacggaagccttcgggcggaagatggtgaagcttagcggcggacgggtgagtaacgcgtgagtaacctgcctgtaagagggggataacacagagaaatttgtgctaataccgcatacggagcaattgtcgcatgacagaagcttaaaagatttatcgcttacagatggactcgcgttcgattagatagttggtaaggtaacggcttaccaagtcaacgatcgatagccgaactgagaggttgatcggccacattgggactgagacacggcccagactcctacgggaggcagcagtgggggatattgcgcaatggggggaaccctgacgcagcaacgccgcgtgaaggaagaaggccttcgggttgtaaacttttgtcgcaagggaagaagaaagtgacggtaccttgtgagaaagccacg

SEQ ID NO: 1778 - DNA, 490 bp, Unknown
  Ascusbbf_57043, encodes 16S rRNA
agagtttgatcatggctcaggatgaacgctagcggcaggcttaacacatgcaagtcgcggggcagcgcgggtagcaatacctggcggcgaccggcggaagggtgcgtaacgcgtgagcaacatgcccgtatcagggggataaccgatggaaacgtcgcctaataccccataacaacgagggccgcatggcccatgtttgaaagttacggcggatacggattggctcgcgtgacattagctagttggcggggtaacggcccaccaaggctacgatgtctaggggttctgagaggaaggtcccccacactggaactgagacacggtccagactcctacgggaggcagcagtgaggaatattggtcaatgggcgcaagcctgaaccagccatgccgcgtgcaggaatgaggccctatgggtcgtaaactgcttttgctgcggagcaataagtgctacgtgtaacacgatgagagtacgcagcgaataagcatc

SEQ ID NO: 1779 - DNA, 490 bp, Unknown
  Ascusbbf_50498, encodes 16S rRNA
agagtttgatcctggctcagattgaacgctggcggcaggcttaatacatgcaagtcgaacggtaacagtgaggaagcaattccttagctgacgagtggcggacgggtgagtaaagtttgggaatctgtcctgcagagggggatagcagctggaaacggctgataaaaccgcgtacgctctgaggaggaaagtgacgggatctagaaatagaccgtcagctgtagggtgagcccaaatgggattagctagtaggggtggtaaaggcacacctaggcgatgatctctagctggttttagcggatgaccagcaacattggaactgagacacggtccaaactcctacgggaggcagcagtagggaatattgcacaatggagggaactctgatgcagccatgccgcgtgtgtgaagaaggccttcgggttgtaaagcacttttattatagagaagagtaggtgtaataataagacacttatgagatgtaacataa

SEQ ID NO: 1780 - DNA, 488 bp, Unknown
  Ascusbbf_3063, encodes 16S rRNA
agagtttgatcctggctcagaacgaacgctggcggcaggcttaacacatgcaagttgaacgggatttgcttggtgcttgcactgagcgatgagagtagcgcactggtgagtaacacgtgggaacatgccttttggtgggggacaacagagggaaacttctgctaataccgcataagccctaagggggaaagatttattgccgaaagattggcccgcggaagattaggtagttggtggggtaaaggcctaccaagccgacgatctatagctggtctgagaggacgaacagccacattggaactgagacacggtccagactcctacgggaggcagcagtgaggaatattgggcaatggaggaaactctgacccagccatgccgcgtgagtgaagaaggttttcgaattgtaaagctctttcggatacgaggatgatgacggtagtatctaaagaagccccggcaaacttcgtgccagcagccgcggtaat

SEQ ID NO: 1781 - DNA, 490 bp, Unknown
  Ascusbbf_9270, encodes 16S rRNA
agagtttgatcctggctcaggatgaacgctagcggcaggcctaacacatgcaagtcgaggggtagagttagcttgctaacttgagaccggcgcacgggtgcgtaacgcgtatgcaatctaccttatactgagggatagcccggagaaatccggattaataccttatagtatattaaagtggcatcattttgatattaaagatttattggtataagatgagcatgcgtcccattagttagttggtgtggtaacggcacaccaagacgatgatgggtaggggtcctgagagggagatcccccacactggtactgagacacggaccagactcctacgggaggcagcagtgaggaatattggtcaatggaggcaactctgaaccagccatgccgcgtgcaggatgacggtcctatggattgtaaactgcttttgtacaggaagaaaacatactacgtgtagtaaattgacggtactgtaagaataaggatcggc

SEQ ID NO: 1782 - DNA, 490 bp, Unknown
  Ascusbbf_50464, encodes 16S rRNA
agagtttgatcctggctcaggatgaacgctagctacaggcttaacacatgcaagtcgcggggcatcatggggggtagcaatacttcctgatggcgaccggcggatgggtgagtaacgcgtatccaacctggccctatctcggggacagcccctcgaaagagggattaatacccgatgtttccatgtttccgcatgttttcatggacaaaggcatttgccggatagggatggggatgcgtctgattaggttgttggcggggtaacggcccaccaaaccttcgatcagtaggggttctgagaggaaggccccccacactgggactgagacacggcccagactcctacgggaggcagcagtgaggaatattggtcaatggccgtaaggctgaaccagccaagtagcgtgagggattacggccctacgggtcttaaacctcttttgttggggagcaaccggcgccactagtggcgtcctgcgagtacccttcga

SEQ ID NO: 1783 - DNA, 490 bp, Unknown
  Ascusbbf_803616, encodes 16S rRNA
agagtttgatcatggctcagaacgaacgctggtggcgtgtcttatacatgcaagtcgagcggtgcagcaatgcatagcggcgaacgggtgagtaacgcgtaagcaatctgccccatgctcgggaatagccgtgccaacgcgcggataataccggataccgtggccccctgcatagggggttgacaaaagatttatcggcatgggatgagcttgcgtccgattagctagttggcggggcaacggcccaccaaggcgacgatcggtagccggcctgagagggtgatcggccacgttgggactgagatacggcccagactcctacgggaggcagcagtagggaatattgcacaatgggggaaaccctgatgcagcaacgccacgtgtgggaagaagcatttcggtgtgtaaaccactgtcgtgagggaataaggcattttttcggagatgttgaatgtacctcgagaggaagcaccggcaaacttcgtgccag

SEQ ID NO: 1784 - DNA, 490 bp, Unknown
  Ascusbbf_26418, encodes 16S rRNA
agagtttgatcctggctcaggataaacgctggcggcgcgcataacacatgcaagtcgaacgagaaacttggcttcggtcagggatctagtggcggacgggtgagtaacacgtggacaacttgtcttgtagagggggatagccggaagaaattccgattaataccgcataatgtgatagtgttgcatgacattatcaagaaagatgcaaatcgctacaagagaggtctgcgtctgattagctagttggagtggtaatggcacaccaaggcaacgatcagtagccggtttgagagaatgaacggccacattgggactgagatacggcccagactcctacgggaggcagcagtggggaatattgcgcaatgggggaaaccctgacgcagcgacgccgtgtaagggaagaaggttttcggatcgtaaacctatatcgattgtgaaaagtaaggatggtagcaaagtaagaagccccggctaactacgtgccagc

SEQ ID NO: 1785 - DNA, 490 bp, Unknown
  Ascusbbf_123663, encodes 16S rRNA
agagtttgatcctggctcaggatgaacgctagcgataggccttacacatgcaagtcgaggggcagcacaaagaaagtagcaatacttttttggtggcgaccggcgcacgggtgagtaacgcgtatgcaacctacctactactttgggatagctcgttgaaagacgaattaataccttataaaacaggggctccgcatggagatatttgttaaagatttattggtagtagatgggcatgcgttccattagttagttggtgaggtaacggctcaccaagacaacgatggataggggaactgagaggtttgtcccccacactggaactgagacacggtccagactcctacgggaggcagcagtgaggaatattggtcaatggaggcaactctgaaccagccaagtcgcgtgaaggatgacggccctacgggttgtaaacttcttttttaagggaataaagtgagccacgtgtggctttttgcatgtaccttac

SEQ ID NO: 1786 - DNA, 490 bp, Unknown
  Ascusbbf_51738, encodes 16S rRNA
agagtttgatcctggctcagaacgaacgctggcggcgcgttttaagcatgcaagtcgagcggtaagccggagcaatccggcctagagcggcggacgggtgagtaacacgtggataatctggcctacagtttgggatagcctggtgaaagccaggataataccggatacgacagttttaacagaagttgagattgggaaaggggctaaggcctcgctgaaggatgagtccgcgtcccattagctggatggtagggtaaaggcctaccatggcgatgatgggtagccggcctaagagggtgaacggccacattgggactgagatacggcccagactcctacgggaggcagcagctaagaatcttccgcaatggtcgaaagactgacggagcgacgccgcgtgaatgatgaaggccgtgaggttgtaaagttcttttctggagggagaataagtgcatcagggaatgggtgcatgatgacgtgaatccaggaa

SEQ ID NO: 1787 - DNA, 490 bp, Unknown
  Ascusbbf_48087, encodes 16S rRNA
agagtttgatcatggctcaggatgaacgctggcggcgtgcataacacattcaagtcgaacggagttgcgatagaaagaggcttcggccaatggaaattgtaacttagtggcggacgggtgagtaacgcgtgagcaacctacctatgcgcgggggacaacagttggaaacgactgctaataccgcataaagtatattaaaggcatctttgatataccaaagagattcgcgtatagatgggctcgcgtccgattagatagttggtgaggtaacggcccaccaagtcgacgatcggtagccggactgagaggttgaacggccacattggaactgagagacggtccagactcctacgggaggcagcagtggggaatattgggcaatgggcgaaagcctgacccagcgacgccgcgtgagtgaagaaggtcttcggattgtaaagcttagttattggggaagaagaaagtgacggtacccaaagagaaagccacg

SEQ ID NO: 1788 - DNA, 490 bp, Unknown
  Ascusbbf_1053376, encodes 16S rRNA
agagtttgatcatggctcaggatggacgctagctacaggcttaacacatgcaagtcggacggcagtagcaatactgtagtggcgaacgggtgagtaacacgttggtgacctgccccaaagatgggaatatcacctggaaacgggtggcaaaaccgaataagctcgggtgagttagagaaactcgagtaaaagagcgatctaccttgggaggggcctgcggcccatcagttagttggtgagggtaacggcccaccaagacgaagacgggtaggggacctgagagggtggtcccccacaatggaactgaaacacggtccatacacctgcgggtggcagcagtagggaatattgcttaatgggcgaaagcctgaagcagcaacgccgcgtggacgaaggaggccttcgggtcgtaaagtccttttataggggaaaaggaaggatggtaccctatgaataagtctcggctaactacgtgccagcagccgcggta

SEQ ID NO: 1789 - DNA, 490 bp, Unknown
  Ascusbbf_34442, encodes 16S rRNA
agagtttgatcatggctcagattgaacgctggcggcatgctttacacatgcaagtcggacggcagcgagggggtgcttgcacttctgtcggcgagtggcgaacgggtgagtaatgcattggaacgtaccgagtagtgggggataactgtccgaaaggatagctaataccgcatacgacctgagggtgaaagcgggggactttttaagcctcgcgctatttgagcggccaatgtctgattagctagttggtggggtaaaggcctaccaaggcgacgatcagtagcgggtctgagaggatgatccgccacactgggactgagacacggcccagactcctacgggaggcagcagtggggaattttggacaatgggcgaaagcctgatccagccatgccgcgtgtctgaagaaggccttcgggttgtaaaggacttttgtacgggaagaaaaggcgattgctaatatcagttgctgatgacggtaccgtaagaa

SEQ ID NO: 1790 - DNA, 490 bp, Unknown
  Ascusbbf_362559, encodes 16S rRNA
agagtttgatcatggctcagaacgaacgctggcggcgcgtcttaagcatgcaagtcgagcggcaagataccttcgggtatcctagagcggcggactggtgagtaacacgtagatgacgcacccttctgacggggatagcctgtggaaacacagggtaataccggataagcccgtggggattggaagcttacggggaaaggaactattgttccgcgggaggagcggtctgcggcccatcagctggttggcggggtaaaggcccaccaaggcaatgacgggtatccggcctgagagggtgagcggacacattgggactgagatacggcccagactcctacgggaggcagcagctaagaatattccgcaatgcacgaaagtgtgacggagcgacgccgcgtggacgatgaaggccggaaggttgcagagtcctttggcgcctgaggaaagggcgggggaatggaaagcccctgaattgactgtagggcgagaa

SEQ ID NO: 1791 - DNA, 490 bp, Unknown
  Ascusbbf_28960, encodes 16S rRNA
agagtttgatcatggctcaggacgaacgctggcggcgtgcctaacacatgcaagtcgagcgagaatctttagtcagattccttcgggatgaagagtaaagaggaaagcggcggacgggtgagtaacgcgtgagtaacctgccttcaagagggggacaacagctggaaacggctgctaataccgcataacattacgaaatcgcatggttttgtaatcaaagatttatcgcttgaagatggactcgcgtctgattagatagttggtggggtaacggcctaccaagtcgacgatcagtagccgaactgagaggttgatcggccacattgggactgagacacggcccagactcctacgggaggcagcagtgggggatattgcgcaatgggggcaaccctgacgcagcaacgccgcgtgaaggaagaaggccttcgggttgtaaacttctttaagtgtggaagaagatgacggtacacacagaataagccacggc

SEQ ID NO: 1792 - DNA, 490 bp, Unknown
  Ascusbbf_60216, encodes 16S rRNA
agagtttgatcctggctcagagttaacgctggcatcgtgcataacacatgcaagtcgaacgggacttaatttgtagcttgctatagattaagtttagtggcagacgggtgagtaatgtataagaaacctacctctgagtggggaataacggtccgaaaggatcgctaataccccataacatatttggaaggcatctttcaaatatcaaagatttatcgcttggagatggtcttatattctatcagcttgttggcagtgtaacggactaccaaggctacgacggatagccggcctgaaagggcgaccggccacaagggcactgagacacgggccctactcctacgggaggcagcagtggggaattttggacaatgggcgcaagcctgatccagcaacgatgcgtggaggacgaaggttctcggattgtaaactccttttgtgagggaagaaaaaaatgacggtacctcacgaataagccacggctaactac

SEQ ID NO: 1793 - DNA, 490 bp, Unknown
  Ascusbbf_33384, encodes 16S rRNA
agagtttgatcatggctcaggacgaacgctggcggcgtgcctaacacatgcaagtcgaacgggacttaatattggaagttttcggatggaagagattaagtctagtggcggacgggtgagtaacgcgtgagtaacctgcctttcagagggggataacgtactgaaaaggacgctaataccgcataacgtatgagcatcgcatgatgcatataccaaaggagcaatccgctgaaagatggactcgcgtccgattagctagttggtgagataaaggcccaccaaggcgacgatcggtagccggactgagaggttgaacggccacattgggactgagacacggcccagactcctacgggaggcagcagtgggggatattgcgcaatgggggaaaccctgacgcagcaacgccgcgtgaaggaagacggttttcggattgtaaacttcttttgtcagggacgaagaatgacggtacctgacgaataagctccgg

SEQ ID NO: 1794 - DNA, 490 bp, Unknown
  Ascusbbf_1766236, encodes 16S rRNA
agagtttgatcctggctcaggatgaacgctggcggcgtgcttaacacattcaagtcgaacgagcgagaggaagcaattccttttgctagtggcggacgggtgagtaacgcgtgagcaacctacctttgtgagtgggataacaactggaaacgattgctaataccgcataacgtatagatattgcatgataactataccaaagaaattcgcacaaagatgggctcgcgtcccattagacagttggtgaggtaacggcccaccaaacctacgatgggtagccggactgagaggttgaacggccacattggaactgagaaacggtccagactcctacgggaggcagcagtggggaatattgggcaatggacgaaagtctgacccagcgacgccgcgtgaaggaagaaggtcttcggattgtaaactttagtcaacagggaagaagaaagtgacggtacctgtagaggaagccacggctaactacgtgccagca

SEQ ID NO: 1795 - DNA, 490 bp, Unknown
  Ascusbbf_1093817, encodes 16S rRNA
agagtttgatcctggctcaggatgaacgctggcggcgtgcctaatacatgcaagtcgaacgggtgtagcaatgcaccagtggcgaacgggtgagtaacacgttggtgacctgccccaaagatgggaatatcacctggaaacgggtggcaaaaccgaataagcttgagggagccagacatcctcaagtaaaagcgtaagctactttgggaggggcctgcggcccatcagttagttggtgagggtaacggcccaccaagacgaagacggataggggacctgagagggtggtcccccacaatggaactgaaacacggtccatacacctgcgggtggcagcagtagggaatattgcttaatgggcgaaagcctgaagcagcaacgccgcgtggacgatggaggccttcgggtcgtaaagtccttttatgggggaaaaggaaggatggcccccatgaataagtctcggctaactacgtgccagcagccgcggtaa

SEQ ID NO: 1796 - DNA, 490 bp, Unknown
  Ascusbbf_53917, encodes 16S rRNA
agagtttgatcctggctcagattgaacgctggcggcatgctttacacatgcaagtcgagcggcagcacgggtgcttgcacctggtggcgagcggcgaacgggtgagtaatgcatcggaacgtacccatgtggtgggggataaccactcgaaagagtggctaataccgcatacgccctgagggggaaagcgggggacttcttcgggagcctcgcgccattggagcggccgatgtcggattagctagtaggtggggtaaaggctcacctaggcgacgatccgtagctggtctgagaggatgatcagccacatcgggactgagacacggcccgaactcctacgggaggcagcagtggggaattttggacaatgggggcaaccctgatccagccatgccgcgtgagtgaagaaggccttcgggttgtaaagctctttcagtcgggaagaaacggggctctctaacatagggtcttaatgacggtaccgacagaa

SEQ ID NO: 1797 - DNA, 490 bp, Unknown
  Ascusbbf_715300, encodes 16S rRNA
agagtttgatcctggctcaggatgaacgctggcggcatgcctaacacatgcaagtcgagcggagatagtctgaagcctagcgatttctatcttagcggcggatgggtgagtaacacgtgggtaacctgccctgtactggggaataacagttggaaacgactgttaatgccgcatatgcgcacgctgccgcatggcagtgggcggaaagatttatcggtacaggatgggcccgcgccggattaactagttggcggggtaacggcccaccaaggtgatgatccgtagccgacctgagagggtgaccggccacattggaactgagacacggcccaaactcctacgggaggcagcagtgggggatattgcacaacgggggaaaccctgatgcagcgacgccgcgtgaaggatgacgtatctcggtatgtaaacttctatcagcggggaagaagatgacggtacccgactaagaagccccggctaactacgtgcc

SEQ ID NO: 1798 - DNA, 490 bp, Unknown
  Ascusbbf_79362, encodes 16S rRNA
agagtttgatcatggctcaggatgaacgctagcggcaggcttaacacatgcaagtcgaggggcagcggggagtagcaatactctgccggcgaccggcggaagggtgcgtaacgcgtgagcaacctgcccgtaaccgggacataaccgatggaaacgtcgcctaatttcccataacaacagggtcggcatcgaccttgtttgaaagcttcggtggttacggatgggctcgcgagacattagctggttggtagggtaacggcctaccaaggctacgatgtctaggggttctgagaggaaggtcccccacactggaactgagacacggtccagactcctacgggaggcagcagtgaggaatattggtcaatgggcggaagcctgaaccagccatgccgcgtgcaggaataaggccctatgggtcgtaaactgcttttgtgcgggagcaataagggctacgtgtagcctgatgagagtaccgtacgaataagca

SEQ ID NO: 1799 - DNA, 490 bp, Unknown
  Ascusbbf_115411, encodes 16S rRNA
agagtttgatcctggctcaggatgaacgctagctacaggcttaacacatgcaagtcgcggggcagcatggaggttgcttgcaacctctgatggcgaccggcgcacgggtgcgtaacgcgtatccaacctgccccttactctggaatagcccggcgaaagtcggattaatgccggatgttgtcagacgaggacatctgaatctgaccaaaggcccgaaagggttggtaagggatggggatgcgtacgattaggtagacggcggggtaacggcccaccgtgccaatgatcgttaggggttctgagaggaaggtcccccacactggtactgagacacggaccagactcctacgggaggcagcagtgaggaatattggtcaatgggcgcgagcctgaaccagccaagtagcgtgcaggatgactgccctatgggttgtaaactgcttttatgcggggataaagtgacgtacgtgtacgttattgtaggtaccgc

SEQ ID NO: 1800 - DNA, 490 bp, Unknown
  Ascusbbf_132873, encodes 16S rRNA
agagtttgatcatggctcaggatgaacgctagcggcaggcctaatacatgcaagtcgaggggtaacaggggagcttgctcctgctgacgaccggcaaacgggtgaggaacacgtacacaaccttccttctagtggaggatagcccagggaaacttggattaatactccgtaagatgttagggaggcatctcccagacattatagtagcgatacgctagaagacgggtgtgcgtctgattaggtagttggcggggtaacggcccaccaagccgacgatcagtaactggtgtgagagcacgaccagtcacacgggcactgagacacgggcccgactcctacgggaggcagcagtaaggaatattggtcaatggacgaaagtctgaaccagccatgccgcgtgaaggatgaaggtcctctggattgtaaacttcttttatatgggacgaaaaaagggttttctaactctactgacggtaccatatgaataagc

SEQ ID NO: 1801 - DNA, 482 bp, Unknown
  Ascusbbf_1502377, encodes 16S rRNA
agagtttgatcatggctcagaacgaacgctggcggcacgcttaacacatgcaagtcggacgggaagaagttagtttactaatggaatctagtggcggactggtgagtataatacaggaatatgcccttaggtaggggatagctttgggaaactggaggtaataccgtataaggtcgagagaggaaagcagagatgcgcctgaggattagcctgtatctgattaggaagttggtggggtaaaggcctaccaatccggggatcagtagctgttctgagaggaagatcagccacattgggactgagatacggcccagactcctacgggaggcagcagtggggaatattggacaatggggggaaccctgatccagcgatgccgcgtgaatgaagaaggttttcggattgtaaagttcttttcttagggaagatgatgacggtacctgaggaataagcaccggcaaactctgtgccagcagcgcgat

SEQ ID NO: 1802 - DNA, 490 bp, Unknown
  Ascusbbf_106279, encodes 16S rRNA
agagtttgatcatggctcaggatgaacgctggcggcgtgcttaacacatgcaagtcgaacgggaagacatttaggaagttttcggatggaataaatgaattctagtggcggacgggtgagtaacgcgtaaacaatctgccttagagagggggataacagatagaaatatttgctaataccgcataagaccacagctaggcatctagcaggggtaaaaggagaaatccgctttaagatgagtttgcgtactattagctagttggtgaggtaacggcccaccaaggcgacgatggttagccggcctgagagggtgaacggccacattggaactgagatacggtccagactcctacgggaggcagcagtgaggaatattgggcaatgggggaaaccctgacccagcaacgccgcgtgaaggaagaaggttttaggattgtaaacttctgttatgggggaaaaagaaagtgatggtaccccatgagaaagctac

SEQ ID NO: 1803 - DNA, 490 bp, Unknown
  Ascusbbf_115315, encodes 16S rRNA
agagtttgatcatggctcagaacgaacgctggcggcgcgtcttaagcatgcaagtcgggcgggaacgggaagcttgcttcccgcgagagcggcggactggtgagtaacgcgtgggtgacgcaccctccggacggggatagcctgcagaaatgcagggtaataccgggtaaggtccgcggcattggaggccgcggaggaaaggagctcaggctccgccgggggaacggcccgcgtcccatcagctggttggcggggaaaaggcccaccaaggcgatgacgggtacccggcctcagagggcggacgggcacattgggactgagatacggcccagactcctacgggaggcagcagctaagaatattccgcaatggggggaaccctgacggagcgacgccgcgtggacgaggaaggccggaaggttgtaaagtccttttccgcgcgaggaaatagcggggcagggaatggtcccgcggtgactgtagcgcggga

SEQ ID NO: 1804 - DNA, 490 bp, Unknown
  Ascusbbf_543777, encodes 16S rRNA
agagtttgatcctggctcaggacgaacgctggcggcgtgcttaacacatgcaagtcgaacgatgaagtggcacttgtgtcatggattagtggcgaacgggtgagtaacacgtgagtaacctgcccctgacttcgggataagcccgggaaactgggtctaataccggatacgactcctgcccgcatgggtgggggtggaaagttttgtcggttggggatgggctcgcggcctatcagcttgttggtggggtaatggcctaccaaggcgtttacgggtagccggcctgagagggcgaccggccacactgggactgagacacggcccagactcctacgggaggcagcagtggggaatattgcacaatgggcgcaagcctgatgcagcgacgccgcgtgggggatgacggccttcgggttgtaaacctctttcagtagggaacaaggcctccttgatgggggtggagggtacctgcagaagaagtaccggctaa

SEQ ID NO: 1805 - DNA, 490 bp, Unknown
  Ascusbbf_52937, encodes 16S rRNA
agagtttgatcatggctcaggataaacgctggcggcatgcctaatacatgcaagtcaaacgggtgtacttgtacaccagtggcgaacgggtgagtaatatataggtaacctacccttaagacgaggataaccattggaaacgatggataatactggatagtatacatttccgcatgaagatgtatttaaagacgcttcaaagcgtcacttaaggaggggcctatatcgcattagctagttggtgaggtaacggcccaccaaggcgacgatgcgtaactgtgctgagaggcaaaacagtcacattggaacttagacacggtccaaactcctacgggaggcagcagtagggaattttcggcaatggaggaaactctgaccgagcaatgccgcgtgaacgaagaagatcttcggattgtaaaattctgttattggggaagaacttacttagtaggaaatgactaagtattgacggtacctgattagaaagccc

SEQ ID NO: 1806 - DNA, 490 bp, Unknown
  Ascusbbf_289610, encodes 16S rRNA
agagtttgatcatggctcaggatgaacgctggcggcgtgcttaacacatgcaagtcgaacgggcagattttgatgaagttttcggatggaatcaaaggaagctagtggcggacgggtgagtaacgcgtaaacaatctgccttagagagggggataacagatagaaatatttgctaataccgcataagaccacagtgaggcatctcacaggggtaaaaggagcaatccgctttaagatgagtttgcgtactattagctagttggtgaggtaacggcccaccaaggcaacgatggttagccggcctgagagggtgaccggccacattggaactgagatacggtccagactcctacgggaggcagcagtgaggaatattgggcaatgggcgaaagcctgacccagcaacgccgcgtgaaggaagaaggttttaggattgtaaacttctgttataggggaaaaagaaagtgatggtaccctatgagaaagctac

SEQ ID NO: 1807 - DNA, 490 bp, Unknown
  Ascusbbf_166452, encodes 16S rRNA
agagtttgatcatggctcaggatgaacgctggcggcgtgcctaatacatgcaagtcgaacgcacattttcggatgtgagtggcgaacgggtgagtaacacgtaggtaacctgcccataagacgaggataactactggaaacggtagctaatactggataggatattggatcgcatgatttaatatttaaaggtgctctcaagcatcacttatggatggacctgcggcgcattagctagttggtgagataaaagcccaccaaggcgacgatgcgtagccggactgagaggttgaacggccacattgggactgagacacggcccagactcctacgggaggcagcagtagggaattttcggcaatggacgcaagtctgaccgagcaacgccgcgtgagtgatgaagttcttcggaacgtaaaattcttttatttggaaaaaacgtatagcataggaaatgatgttatagtgatggtaccaaatgaataagccc

SEQ ID NO: 1808 - DNA, 490 bp, Unknown
  Ascusbbf_297098, encodes 16S rRNA
agagtttgatcctggctcaggacgaacgctggcggcgtgcttaaaacatgcaagtcgaacggggttatttgttaacactaagggatgttgtagacattctttagtgttaacaaaaaatctagtggcggacgggtgagtaacacatgagcaacctgcctttcacagggggataacagatagaaatatctgctaataccgcataagaccacgcttgggcatccaagaggggtcaaaggagcgatccggtggaagaggggcttgtggctcattagctagttggcggggtagaggcccaccaaggcgacgatgagtagccgatctgagaggatgaacggccacattggaactgagatacggtccagactcctacgggaggcagcagttaggaatattgggcaatggaggaaactctgacccagcaacgccgcgtgaaggaagaaggttttcggattgtaaacttctgatctaagggaaaaagaaagtgatggta

SEQ ID NO: 1809 - DNA, 490 bp, Unknown
  Ascusbbf_190606, encodes 16S rRNA
agagtttgatcctggctcaggatgaacgctagcggcaggcttaacacatgcaagtcgaggggcagcgcggaggtagcaatacttctggcggcgaccggcgcaagggtgcgtaacgcgtgagcaacatgcccgtatcagggggataagcgatggaaacgtcgtctaataccgcataacaacttgggaggcatcttccgggtttgaaagattcgtcggatacggattggctcgcgagacattagctagtcggcggggtaacggcccaccgaggctacgatgtctaggggttctgagaggaaggtcccccacactggaactgagacacggtccagactcctacgggaggcagcagtgaggaatattggacaatggccggaaggctgatccagccatgccgcgtgaaggcagacggtcctatggattgtaaacttcttttgtacgggagcaataagtgtcacgtgtgatacgatgagagtaccgtacgaataag

SEQ ID NO: 1810 - DNA, 490 bp, Unknown
  Ascusbbf_47774, encodes 16S rRNA
agagtttgatcatggctcaggacgaacgctggcggcgtgcttaacacatgcaagtcgaacgagaatctaatgaaagaggcttcggctgatggagttagaggaaagtggcggactggtgagtaacgcgtgagcaacctacctttcagagggggacaacagctggaaacggctgctaataccgcatgaagcatatttttcgcatgggagatatgtcaaagatttatcgctgagagatgggctcgcgtctgattagctagttggtgaggtagaggctcaccaaggcgacgatcagtagccggactgagaggttgaccggccacattgggactgagatacggcccagactcctacgggaggcagcagtggggaatattgggcaatggacggaagtctgacccagcaacgccgcgtgaaggaagaaggccttcgggttgtaaacttctttgacaggggaagagtagaagacggtaccctgaaaacaagccacggc

SEQ ID NO: 1811 - DNA, 490 bp, Unknown
  Ascusbbf_102521, encodes 16S rRNA
agagtttgatcatggctcaggatgaacgctggcggcgtgcttaatacatgcaagtcgaacgaagcacttttcccggaagccttcgggccgaagggagctgtgacttagtggcggacgggtgagtaacgcgtgggtaacctgcctcatacagggggacaacagctggaaacgactgctaataccccataagcgcacaataccgcatggtgatgtgtgaaaagatttatcggtatgagatggacccgcgtccgattagctagttggcggggtaacggcccaccaaggctgcgatcggtagccgacttgagagagtgatcggccacattgggactgagacacggcccagactcctacgggaggcagcagtagggaatattgcacaatgggggaaaccctgatgcagcgacgccgcgtgagtgatgaagcatttcggtgcgtaaaactctatcagcagggaagacaatgacggtacctgactaagaagccccgg

SEQ ID NO: 1812 - DNA, 490 bp, Unknown
  Ascusbbf_211259, encodes 16S rRNA
agagtttgatcatggctcaggacgaacgctggcggcgtgcctaatacatgcaagtagaacgctgaagaggagcttgctccttggatgagttgcgaacgggtgagtaacgcgtaggtaacctacctgatagcgggggataactattggaaacgatagctaataccgcataacagttttggtcgcatgactgaagcttgaaaggagcaattgcttcactatcagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgttgagtagagtggaaagttactcaagtgacggtatcttacc

SEQ ID NO: 1813 - DNA, 490 bp, Unknown
  Ascusbbf_308777, encodes 16S rRNA
agagtttgatcatggctcaggataaacgctggcggcatgcctaatacatgcaagtcaaacgggaagtagcaatacttctagtggcgaacgggtgagtaacacgtgggcaacctgtcctaaagattgggataacagttggaaacgactgataataccgaataataagtcgtctcgcatgagatgattttgaaaggcgcttcaaagcgtcacttcaggaggggcctgcggcgcattagctagttggtgaggtaacggcttaccgaggcgatgatgcgtagctgcgctgagaggcgatacagccacattgggactgagaacggcccaaactcctacgggaggcagcagtagggaattttcggcaatgggggaaaccctgaccgagcaatgccgcgtgaatgatgaaggtcttcggattgtaaagttctgttgttgaggaagaatcgtagctataggaaatgatagttacttgacggtacttaacgagaaagcc

SEQ ID NO: 1814 - DNA, 490 bp, Unknown
  Ascusbbf_1809112, encodes 16S rRNA
agagtttgatcatggctcaggacgaacgctggcggcgtgcttaacacatgcaagtcgaacggaactgttatggaatgtcttcggacaggaagtttcagtttagtggcgaacgggtgagtaacgcgtgaggaacctgcctttcagagggggacaacagttggaaacgactgctaataccgcataacacagcaacttcgcatgaagatgttgtcaaagattttatcgctgaaagatggcctcgcgtctgattagatagttggtggggtaacggcctaccaagtcgacgatcagtagccggactgggaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttaccagggacgaaggatgtgacggtacctggagaaaaagccacggc

SEQ ID NO: 1815 - DNA, 490 bp, Unknown
  Ascusbbf_113924, encodes 16S rRNA
agagtttgatcctggctcaggacgaacgctggcggcgtgcttaaaacatgcaagtcgaacgaacgaagttgggtacttgtacccgaccaagttagtggcggacgggtgagtaacgcgtgagcaatctgcctatcacaggggaataacaactggaaacgggtgctaataccgcatatgaccacaacctggcatcaggaaggggtgaaaggagcaatccggtgatagatgagcttgcgtctcattagctagttggtgagatagaggcccaccaaggcaacgatgagtagccgatctgagaggatgaacggccacattggaactgagagacggtccaaactcctacgggaggcagcagttaggaatattgggcaatgggcgaaagcctgacccagcaacgccgcgtgaaggaagaaggtcttcggattgtaaacttctgatctgtggaaaaaataaagtgatggtaccacaggagcaagccacggctaactac

SEQ ID NO: 1816 - DNA, 490 bp, Unknown
  Ascusbbf_198642, encodes 16S rRNA
agagtttgatcatggctcaggatgaacgctagcgggaggcttaacacatgcaagccgaggggtatttgtagcttgctacagagagaccggcgcacgggtgcgtaacgcgtatgcaacttgccctactgaaagggatagcccagagaaatttggattaataccttataataaatttcattgcatgatgagattttgaaagatttatcgcagtaggataggcatgcgtcagattagctagttggtgaggtaacggctcaccaaggcgatgatctgtagggggcctgagagggtgaacccccacactggtactgagacacggaccagactcctacgggaggcagcagtgaggaatattggacaatgggtgtaagcctgatccagccatcccgcgtgaaggatgacggccttatgggttgtaaacttcttttatatggggataaaccttatcacgtgtgataagctgaaggtaccatatgaataagcaccggct

SEQ ID NO: 1817 - DNA, 490 bp, Unknown
  Ascusbbf_394777, encodes 16S rRNA
agagtttgatcatggctcaggatgaacgctggcggcgtgcttaacacatgcaagtcgaacggacatgcatcaccgaagcggatctagcttgctaatgaagcttcaccgatgcatgttagtggcggacgggtgagtaacgcgtgggtaacctgcctttatccgggggataacagttagaaatgactgctaataccgcataagcgcacactgtcgcatgacagagtgtgaaaaactccggtggatagagatggacccgcgttagattagccagttggcggggtaacggcccaccaaagcgacgatctatagccggcctgagagggcgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaacgacggtacctgcaca

SEQ ID NO: 1818 - DNA, 490 bp, Unknown
  Ascusbbf_379616, encodes 16S rRNA
agagtttgatcctggctcaggatgaacgctggcggcgtgcataacacattcaagtcgaacggacgagagggcttcggtcctcgagtcagtggcggacgggtgagtaacgcgtgagcaacctgcccccttgtgcgggataacgtttggaaacgaacgctaataccgcatgatccacagaggccgcatggtcgttgtggcaaagattgatttgcaaggggatgggctcgcgtccgattagatagttggcggtgcaacggaccaccaagtcgacgatcggtagccggactgagaggttgaacggccacattggaactgagaaacggtccagactcctacgggaggcagcagtggggaatattgggcaatgggcgaaagcctgacccagcgacgccgcgtgaaggaagacggtcctcggattgtaaacttcttttatgcaggacgaaggtagtgacggtactgcatgaataagccacggctaactacgtgccag

SEQ ID NO: 1819 - DNA, 490 bp, Unknown
  Ascusbbf_278580, encodes 16S rRNA
agagtttgatcctggctcaggatgaacgctggcggcgtgcctaacacatgcaagtcgaacggtgaaacagaagcggaggttttcggactgaagcatttgtggaacagtggcggacgggtgagtaacgcgtggataacctgccccatacagggggatagcagttggaaacgactgataataccgcataagcgcacgaggggacatccccaggtgtgaaaaacttaaggtggtatgggatgggtccgcgtccgattagttagttggcggggtaagagcccaccaagacgacgatcggtagccggcctgagagggcggacggccacattgggactgagacacggcccagactcctacgggaggcagcagtgggggatattgcacaatggagggaactctgatgcagcgacgccgcgtgggtgaagaagtatttcggtatgtaaagccctatcagcagggaagaaagtgacggtacctgagtaagaagccccgg

SEQ ID NO: 1820 - DNA, 490 bp, Unknown
  Ascusbbf_261880, encodes 16S rRNA
agagtttgatcatggctcaggatgaacgctggcggcgtgcctaacacatgcaagtcgaacggaccttcccaaccgaaagcggatctagcttgctattgaagctttcacctgggacggtcagtggcggacgggtgagtaacgcgtgggtaacctgcctctgtcagggggataacagatagaaatgcctgctaataccgcataagcgcacagcaccgcatggtgcagtgtgaaaagatttatcggacagagatggacccgcgttagattagccagttggcggggtaacggcccaccaaagctacgatctatagccggcctgagagggcgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaagatgacggtacctgca

SEQ ID NO: 1821 - DNA, 490 bp, Unknown
  Ascusbbf_465262, encodes 16S rRNA
agagtttgatcatggctcaggatgaacgctggcggcgtgcctaacacatgcaagtcgaacgttaggatatagcaatatgtccaaaagtggcgaacgggtgagtaacacgtaggtaacctgccgcgcagagggggataacgactggaaacggtcgctaataccgcatggtactatcgagaggggactcttgatagttaaaaccttggtgctgcgcgaggggcctgcgtccgattagttagttggtgaggtaatggctcaccaaggcgatgatcggtagctggtctgagaggatgatcagtcacacgggaactgagacacggtcccgactcctacggggggcagcagtgaggaatattgcacaatggacgaaagtctgatgcagcaacgccgcgtggaggatgacggcccttgggttgtaaactccttttttcagggaagagtgaggacggtacctgaagaataagtcacggctaactacgtgccagcagcc

SEQ ID NO: 1822 - DNA, 490 bp, Unknown
  Ascusbbf_443451, encodes 16S rRNA
agagtttgatcatggctcaggacgaacgctggcggcatgcctaatacatgcaagtcgtgcggatgcttcaaagagcttgctctttgaagtgttagcggcggatgggtgagtaacacgtgggcaacctgccctacagatggggataactccgggaaaccggggctaataccgaataaacagtttgtccgcatggacaaactctgaaagacggtttcggctgtcactgtaggatgggcccgcggcgcattagctagttggtgggataacggcctaccaaggcaacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtatgggagtaactgcccgtaccttgacggta

SEQ ID NO: 1823 - DNA, 490 bp, Unknown
  Ascusbbf_213940, encodes 16S rRNA
agagtttgatcctggctcaggacaaacgctggcggcgtgcttaacacatgcaagtcgaacggagtacccatgacagaagcttcggcagacggaatggaatacttagtggcggacgggtgagtaacacgtgagtaacctgcccctgagtgggggataacactccgaaaggagtgctaataccgcataacatgaggatatcgcatggtaacctcatcaaagatatattgctcagggatgggctcgcgcccgattaggtagttggagaggtaacggctcaccaagccgacgatcggtagccggactgagaggttgaacggccacattgggactgagacacggcccagactcctacgggaggcagcagtggggaatattgcacaatgggggaaaccctgatgcagcgacgccgcgtgaaggaagaaggtcttcggattgtaaacttttgtcttcggggacgaaaagaatgacggtacccggggaggaagccacg

SEQ ID NO: 1824 - DNA, 490 bp, Unknown
  Ascusbbf_714955, encodes 16S rRNA
agagtttgatcctggctcgggacgaacgctggcggcgtgcctaatacatgcaagtcgagcgggtttgtcccttcggggacaagcaagcggcggacgggtgagtaacacgtaggcaacctgcccatgggaccgggataacgtcgggaaaccgatgctaataccggatagatgaacttctcgcatgagaggatctggaaagacggcgcaagctgtcaccgatggatgggcctgcggcgcattagctagttggtggggtaacggctcaccaaggcgacgatgcgtagccgacctgagagggtgatcggccacactgggactgagacacggcccagactcctacgggaggcagcagtagggaatcttcggcaatgggcgaaagcctgaccgagcaacgccgcgtgagtgatgaaggctttcgggtcgtaaaactctgttgccagagaagaacgtccggtagagtaactgctgccggagtgacggtatctgagaa

SEQ ID NO: 1825 - DNA, 490 bp, Unknown
  Ascusbbf_256312, encodes 16S rRNA
agagtttgatcatggctcaggacgaacgctggcggcgtgcttaacacatgcaagtcgaacggagttacaggagagcttgcttgaatgtaacttagtggcggacgggtgagtaacgcgtgagtaacctgtctcacacaggggaataacgcatcgaaagatgtgctaataccgcgtaggaccacggtgtcgcatggcactgaggtgaaagacgaaagtcggtgtgaggtgggctcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcggaagcctgacccagcaacgccgcgtgaaggaagaaggttttcggatcgtaaacttctgtcctatatgaagatagtgacggtagtataggaggaagccccggctaactacgtg

SEQ ID NO: 1826 - DNA, 490 bp, Unknown
  Ascusbbf_261378, encodes 16S rRNA
agagtttgatcctggctcaggacgaacgctggcggcatgcctaacccatgcaagtcgaacggatgcgacgacttcggttgtcaagtcagtggcggacgggtgagtaacacgtgaacaaccaacctcatactgggggacaacatttggaaacgaatgctaataccgcataagaccacagagccgcatggctcagaggtcaaaggagaaatccggtgtgagacgggttcgcgtcctattagttagatggtgaggtaacggcccaccatgaccgcgataggtagccgagctgagaggctgatcggccacactggaactgagagacggtccagactcctacgggaggcagcaggggggaatattgggcaatgggggaaaccctgacccagcaatgccgcgtgaatgaagaaggccttcgggttgtaaagttctgtgacagaggacgaagaaatgacggtactctgagaggaagctccggcaaactacgtgccag

SEQ ID NO: 1827 - DNA, 490 bp, Unknown
  Ascusbbf_141755, encodes 16S rRNA
agagtttgatcatggctcaggatgaacgctggcggcgcgcttaacacatgcaagtcgaacgagattggtggcttcggctacaaatttagtggcggacgggtgagtaacgcgtggataacttgcctttcagtgggggatagccgagagaaatctcgattaataccgcatagtatagtctgtttgcatgaatagactattaaagatgtaaatcgctgaaagagaggtctgcgtctgattagctggttggggtggtaatggcacaccaaggcaacgatcagtaaccggtttgagagaatgaacggtcacattgggactgagatacggcccagactcctacgggaggcagcagtggggaatattgcgcaatggaggaaactctgacgcagcgacgccgtgtgaaggatgaaggccttcgggttgtaaacttttatcgattgtgaaaagaaaggatggtagcaaagtaagaagctccggctaactacgtgccagc

SEQ ID NO: 1828 - DNA, 490 bp, Unknown
  Ascusbbf_712552, encodes 16S rRNA
agagtttgatcatggctcaggacgaacgcttgcgacgtgcctaagaaatgcaagtcgagcgatgacgggggcttcggctccttgattagcggcgaacggtcgcgtaacacgtaagcaatctgccccaaagtttgggatagccatccgaaaggatgattaataccggatgtggaacataaatcgcatgttttatgttctaaagcagcgatgcgctttgggatgagcttgcggcctatcagctagttggtaaggtgatggcttaccaaggcgacgacgggtagctggtctgagaggatggtcagccggattgggactgagatacggcccagactcctacggggggcagcaattaggaatcttgcgcaatggggggaaccctgacgcagcgacgtcgcgtgaatgaagaagtctttcgggatgtaaaattctttttaccgggaagataatgacgttaccggtggaataagccccggctaactccgtgccagca

SEQ ID NO: 1829 - DNA, 490 bp, Unknown
  Ascusbbf_150577, encodes 16S rRNA
agagtttgatcatggctcaggatgaacgctggcggcgtgcttaacacattcaagtcgaacgagcgaggggaagcaattccttttgcgagtggcggacgggtgagtaacgcgtgagcaatctgcctctgtgagtggaataccagttggaaacgactgttaataccgcataatgtatggatgccgcatgacaaccataccaaagggaaaccgcgcagagatgagctcgcgtcccattagacagttggtgaggtaacggcccaccaaatctacgatgggtagccggactgagaggttgaacggccacattggaactgagaaacggtccagactcctacgggaggcagcagtggggaatattgggcaatggacgaaagtctgacccagcgacgccgcgtgaaggatgaaggtcttcggattgtaaactttagtcaacagggaagaagaaagtgacggtacctgtagaggaagccacggctaactacgtgccagc

SEQ ID NO: 1830 - DNA, 490 bp, Unknown
  Ascusbbf_261017, encodes 16S rRNA
agagtttgatcctggctcaggatgaacgctagcggcaggcttaatacatgcaagtcgtggggcagcagaatgtagcaatacattgctggcgaccggcaaacgggtgcggaacacgtacacaaccttcctacaagtggggcatagcccagagaaatttggattaataccccgtaatatatagaaaaggcatcttttctatattatagcttcggcgcttgttgatgggtgtgcggctgattagatagttggcggggtaacggcccaccaagtctacgatcagtagctgatgtgagagcatgatcagccacacgggcactgagacacgggcccgactcctacgggaggcagcagtaaggaatattggacaatggacgaaagtctgatccagccatgccgcgtgaaggattaaggtcctctggattgtaaacttcttttatatgggacgaaaaaagggaattctttcccacttgacggtaccatgtgaataagc

SEQ ID NO: 1831 - DNA, 490 bp, Unknown
  Ascusbbf_1827870, encodes 16S rRNA
agagtttgatcctggctcaggacgaacgctggcggcgtgcctaatacatgcaagtagaacgctgaagaggagcttgctccttggatgagttgcgaacgggtgagtaacgcgtaggtaacctggctcatagcgggggataactattggaaacgatagctaataccgcataacagttttggccgcatggctgaggcttgaaaggcgcaattgcgtcactatgagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgttgagtagagtggaaagttactcaagtgacggtatcttacc

SEQ ID NO: 1832 - DNA, 490 bp, Unknown
  Ascusbbf_1806154, encodes 16S rRNA
agagtttgatcatggctcaggacgaacgctggcggcgtgcctaatacatgcaagtcgagcgaatctgagggagcttgctcccaaaggttagcggcggacgggtgagtaacacgtgggcaacctgcctgtaagactgggataacttcgggaaaccggagctaataccggataattcttaccaacacatgttggtaagctaaaagacggcgcaagctgtcacttacagatgggcccgcggcgcattagctagttggtgaggtaatggcttaccaaggcaacgatgcgtagccgacctgagagggtgatcggccacactgggactgagacacggcccagactcctacaggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtaccta

SEQ ID NO: 1833 - DNA, 490 bp, Unknown
  Ascusbbf_1501581, encodes 16S rRNA
agagtttgatcatggctcaggatgaacgctggcggcgtgcctaatacatgcaagtcgaacggagggatgggagcttgctccctgaacttagtggcgaacgggtgagtaacacgtaggtaacctgccctttagcttgggatacccagaggaaactttggctaataccggataacaacaaccgaggcatctcggatgcttgaaaggccctttcgggtcactaaaggatggacctgcggcgcattagctagttggtgagataatagcccaccaaggcgaggatgcgtagccgaactgagaggttgatcggccaaattggaactgagacacggtccaaactcctacgggaggcagcagtaaggagttttcggcaatgggggaaaccctgaccgagcaacgccgcgtgagtgatgacggccctatgggttgtaaagctctgttgtaaggaaagaactgtaagagtaggaaatgacttttacttgacggtacctta

SEQ ID NO: 1834 - DNA, 490 bp, Unknown
  Ascusbbf_1484665, encodes 16S rRNA
agagtttgatcatggctcagggtgaacgctggcggcgtgcttaagacatgcaagtcgaacgatcgtcttcggacggtagtggcgcacgggtgagtaacgcgtaactgacctgcccccaggaccgaactaactccccgagaggggagctaatgtgggatgtgctgtccggctgtggccggacagtaaaggctgaggccgcttggggatggggttgcgttccatcagctagatggtggggtaaaggcctaccatggcgacgacggataaccggcctgagagggtggccggtcacaggggcactgagacacgggccccactcctatgggaggcagcagttaggaatcttccccaatgggcgcaagcctgagggagcgacgccgcgtgagggatgaaggtcctcggattgtaaacctctgaacgagtgacgaaaggccccggatggggagatgacggtaactcggtaatagcaccggctaactccgtgccagca

SEQ ID NO: 1835 - DNA, 490 bp, Unknown
  Ascusbbf_1351885, encodes 16S rRNA
agagtttgatcctggctcaggatgaacgctagctacaggcttaacacatgcaagtcgaggggcatcatggtggtagcttgctaccgccgatggcgaccggcgcacgggtgagtaacacgtatccaacctgccttcagctcggggatagccctctgaaaggaggattaatacccgatgtgtttgcagtccggcatcgggcggcaattaaagatttatcggctgtggatggggatgcgtctgattaggttgttggcggggtaacggcccaccaagccaccgatcagtaggggttctgagaggaaggtcccccacataggaactgagacacggtcctaactcctacgggaggcagcagtgaggaatattggtcaatggtcgagagactgaaccagccaagtagcgtgaaggatgactgccctacgggttgtaaacttcttttatgcgggaataaagttcgccacgtgtggcgttttgtatgtaccgcatgaat

SEQ ID NO: 1836 - DNA, 490 bp, Unknown
  Ascusbbf_824319, encodes 16S rRNA
agagtttgatcatggctcaggacgaacgctggcggcgtgcctaatacatgcaagtcgaacgcttctttcctcccgagtgcttgcactcgattggaaagaggagtggcggacgggtgagtaacacgtgggtaacctacccatcagagggggataacacttggaaacaggtgctaataccgcataacagtttatgccgcatggcataagagtgaaaggcgctttcgggtgtcgctgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggacgttagtaactgaacgtcccc

SEQ ID NO: 1837 - DNA, 490 bp, Unknown
  Ascusbbf_725801, encodes 16S rRNA
agagtttgatcctggctcaggatgaacgctggcggcgtgcctaacacattcaagtcgaacggtgaaggggcttcggccccggatcagtggcggacgggtgagtaacgcgtgagcaacctacctttctgtgggggataacacagggaaacttgtgctaataccgcataacgtatctgtcccgcatggggcggataccaaagatttattgcagagagatgggctcgcgtccgattagatagttggtgaggtaacggctcaccaagtcgacgatcggtagccggactgagaggttgaacggccacattggaactgagatacggtccagactcctacgggaggcagcagtggggaatattgggcaatgggcgaaagcctgacccagcgacgccgcgtgagggaagaaggtcttcggattgtaaacctttgttgacagggaagaaacaaatgacgtaacctgtcgaggaagccacgactaactacgtgccagcag

SEQ ID NO: 1838 - DNA, 490 bp, Unknown
  Ascusbbf_1778398, encodes 16S rRNA
agagtttgatcatggctcaggatgaacgctggcggcgtgcataacacattcaagtcgaacgggcgaagggagcttgctccccgagctagtggcggacgggtgagtaacgcgtgagcaacctgcctctgtgtgtgggataccgtctggaaacggacgttaataccgcatgacccatatagaacgcatgttaggtatggcaaagatttattgcacagagatgggctcgcgtctgattaggcagttggtgaggtaacggcccaccaaaacctacgatcagtagccggactgagaggttgaacggccacattggaactgagaaacggtccagactcctacgggaggcagcagtggggaatattgggcaatgggcgaaagcctgacccagcgacgccgcgtgaaggaagacggtcttcggattgtaaacttcttttatgagggacgataatgacggtacctcatgaataagccacggctaactacgtgccagcag

SEQ ID NO: 1839 - DNA, 490 bp, Unknown
  Ascusbbf_388614, encodes 16S rRNA
agagtttgatcatggctcaggatgaacgctggcggcgtgcttaacacatgcaagtcgaacggagtatctctcccgagatcaaagaagcttgcttctgcgaaatcatttgagatacttagtggcggacgggtgagtaacgcgtgggtaacctgcctcacacagggggataacagttggaaacgactgttaataccgcataagcgcacggtatcgcatgatacagtgtgaaaaactccggtggtgtgagatggacccgcgtctgattagctagttggtgaggtaacggcccaccaaggcgacgatcagtagccggcctgagagggtaaacggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagataatgacggtacctgacta

SEQ ID NO: 1840 - DNA, 490 bp, Unknown
  Ascusbbf_421406, encodes 16S rRNA
agagtttgatcatggctcagagttaacgctggcagcgtgcataacacatgcaagtcgaacggggattattcgatgtagcaatacattggataattctagtggcagacgagtgagtaatacataagaaatctacccgaaagtggggaataacgggccgaaaggttcgctaataccccataatatttgaaagcggcatcgctttcttcttaaaggtttttcgctttcggacgatcttatggtctatcagctagttggtagggtaacggcctaccaaggcgacgacggatagccggcctgaaagggcgaccggccacgggggcactgagatacgggccccactcctacgggaggcagcagtggggaattttggacaatggacgaaagtctgatccagcaacgctgcgtgaaggacgaaggttctcggattgtaaacttcttttgcaggggaagaaacaaatgacggtaccctgtgaataagccacggctaact

SEQ ID NO: 1841 - DNA, 490 bp, Unknown
  Ascusbbf_389768, encodes 16S rRNA
agagtttgatcatggctcaggatgaacgctggcggcgtgcttaacacatgcaagtcgaacgaagctatttatgacgtttagggattcgtccacgaactgattaagtaacttagtggcggacgggtgcgtaacgcgtgggcaacctgccttcttccgggggataacacagggaaacttgtgctaataccgcataaagtcacgaggggacatccccatgtgaccaaaggagcaatccgggggaagaggggcccgcgtctgattagctagttggtgaggtaacggcccaccaaggcgacgatcagtagccgaactgagaggttgatcggccacattgggactgagacacggcccagactcctacgggaggcagcagtggggaatattgcgcaatgggggaaaccctgacgcagcaacgccgcgtggaggatgaaggtcttcggattgtaaacttctttaataggggacgaacaatgacggtaccctaagaaaa

SEQ ID NO: 1842 - DNA, 490 bp, Unknown
  Ascusbbf_482643, encodes 16S rRNA
agagtttgatcctggctcaggataaacgctggcggcgcacataagacatgcaagtcgaacggaagtcgttacgacggaagtggattgaagatttatcagattgaagcagaagatgtaacaatggctttagtggcggactggtgagtaacacgtaagtaacctggctattagaggggaataacagtgagaaatcattgctaataccgcataagcttgtaatatcgcatgatatagcaagaaaaggagaaatccgctaatagatgggcttgcggctgattagctagttggttaggtaacggctgaccaaggcgacgatcagtagccgggctgagaggctcatcggccacattgggactgagatacggcccagactcctacgggaggcagcagtcgggaatattgcgcaatggaggaaactctgacgcagtgacgccgcgtataggaagaaggttttaggattgtaaactattttagacagggaagataaaag

SEQ ID NO: 1843 - DNA, 490 bp, Unknown
  Ascusbbf_1791513, encodes 16S rRNA
agagtttgatcatggctcaggatgaacgctggcggcatgcctaagacatgcaagtcgaacgaggaagcccaatgaaatttgcgtgcttgcacaaaaatggatttggattacttcctagtggcagacgggtgagtaacacgtgggtaatctacctcggagattgggataacttctggaaacggatgctaataccgaataattcatatttagataactagatatgctaaaaggagcttcggcttcacttcgagatgagcttgcggtgtattagcttgttggtggggtaatggcctaccaaggcaacgatgcatagccgggctgagaggctgatcggccacattggaactgagatacggtccaaacttctacgggaggcagcagttaggaatattcgtcaatgggggaaaccctgaacgagcaatgccgcgtgagtgatgacggtcctagtgattgtaaaactctgttgtaaagaaagaacctacactatagg

SEQ ID NO: 1844 - DNA, 490 bp, Unknown
  Ascusbbf_1882367, encodes 16S rRNA
agagtttgatcatggctcaggatgaacgctagcggcaggcctaatacatgcaagtcgaacggtaaaatccccttcgggggattgagagtggcggacgggtgcgtaacgcgtatgcaaccaacccccctcaccgggatagccggtggaaacgccggataacaccggatgcgccgcgagggaggcatctcccatgcggcaaggcggcgacgcggagggggacgggcatgcgtgccattagcttgttggcggggcgacggcccaccaaggcgacgatggctaggggatctgagaggacggtcccccaaactggtactgagacacggaccagactcctgcgggaggcagcagtaagggatattggtcaatggggggaaccctgaaccagccatgccgcgtgagggaatgaggccctacgggtcgtgaacctcttttatctggggacaatacggggcacgggatgccccgttgagggtaccagaggaataagcat

SEQ ID NO: 1845 - DNA, 490 bp, Unknown
  Ascusbbf_726766, encodes 16S rRNA
agagtttgatcatggctcagattgaacgctggcggcatgctttacacatgcaagtcgaacggtaacaggtcttcggatgctgacgagtggcgaacgggtgagtaatacatcggaacgtgcctagtagtgggggataactactcgaaagagtagctaataccgcatgagatctacggatgaaagcaggggaccttcgggccttgtgctactagagcggctgatggcagattaggtagttggtggggtaaaggcttaccaagcctgcgatctgtagctggtctgagaggacgaccagccacactgggactgagacacggcccagactcctacgggaggcagcagtggggaattttggacaatgggcgaaagcctgatccagcaatgccgcgtgcaggatgaaggccctcgggttgtaaactgcttttgtacggaacgaaaagcctggggctaatatccccgggtcatgacggtaccgtaagaataagcaccg

SEQ ID NO: 1846 - DNA, 490 bp, Unknown
  Ascusbbf_740911, encodes 16S rRNA
agagtttgatcatggctcaggacgaacgctggcggcgtgcctaacacatgcaagtcgaacggagttaacaatggaagttccttcggggacggaagctgttaacttagtggcggacgggtgagtaacgcgtgagtaacctgcctttcagagggggataacgttcggaaacgaacgctaataccgcatgacatagcgataccgcatggtaatgctatcaaaggagcaatccgctgagagatggactcgcgtctgattagatagttggtgaggtaacggctcaccaagtcgacgatcagtagccggactgagaggttgaacggccacattgggactgagacacggcccagactcctacgggaggcagcagtgagggatattgcacaatgggcgcaagcctgatgcagcaacgccgcgtgagggaagacggtcttcggattgtaaacctttgtctttggtgaagaagaaagtgacggtagccgaggaggaagcc

SEQ ID NO: 1847 - DNA, 490 bp, Unknown
  Ascusbbf_1653471, encodes 16S rRNA
agagtttgatcctggctcaggatgaacgctagcggcaggcctaacacatgcaagtcgaggggtagaaagagcttgcttttttgagaccggcgcacgggtgagtaacgcgtatgcaacctaccttatacaggggaatagcccgaagaaattcggattaatgctccatggtttatcgatatggcatcgtattgataataaagatttatcggtataagatgggcatgcgtatcattagctagttggtgtggtaacggcataccaaggcaacgatgattaggggtcctgagagggagatcccccacactggtactgagacacggaccagactcctacgggaggcagcagtgaggaatattggtcaatggaggcaactctgaaccagccatgccgcgtgcaggatgacggtcctatggattgtaaactgcttttgtacaggaagaaacctccctacgagtagggacttgacggtactgtaagaataaggatcggc

SEQ ID NO: 1848 - DNA, 490 bp, Unknown
  Ascusbbf_1883806, encodes 16S rRNA
agagtttgatcctggctcaggatgaacgctggcggcacgcttaacacatgcaagtcgagcggagaacagacttcggtttgttcttagcggcggacgggtgaggaacgcgtgggtaatctgccctatacaggggaataacactgagaaattagtgataaagccgcataagcccacgggatcgcatgatcctgtgggaaaaactccggtggtataggatgagcccgcgtccgattagctagttggtgaggtaatggcccaccaaggcgatgatcggtagccggtctgagaggatggacggccacattgggactgagacacggcccaaactcctacgggaggcagcagtggggaatattgcacaatgggggaaaccctgatgcagcgatgccgcgtgaaggaagaagattttcggattgtaaacttctatcagcgaggaagagaacggacagtactcgagtaagcagccccggctaactacgtgccagcagcc

SEQ ID NO: 1849 - DNA, 490 bp, Unknown
  Ascusbbf_1678535, encodes 16S rRNA
agagtttgatcatggctcaggacgaacgctggcggcgtgcctaatacatgcaagtcgaacgcgtcttggtcaatgaagttgagtgcttgcatttaactgatttgacattaagacgagtggcgaactggtgagtaacacgtgggtaacttgccccgaagcgggggataacatttggaaacaggtgctaataccgcataacaacaaaaaccacatggtttttgtttaaaagatggtttcggctatcactttgggatggacccgcggcgtattagctagttggtgaggtaatggctcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacgggtgtcagagt

SEQ ID NO: 1850 - DNA, 490 bp, Unknown
  Ascusbbf_453241, encodes 16S rRNA
agagtttgatcctggctcaggattaacgctggcggcgtgcataacacattcaagtcgaacggacataggggcttgcccctatgtgagtggcggacgggtgagtaacgcgtgagcaacctgcccctgtgtaagggataacgaccggaaacagtcgctaataccttatgacccgatagtaccgcatggtacagacggcaaagatttattgcacagggatgggctcgcgtccgattaggcagttggtgaggtaacggctcaccaaaccgacgatcggtagccggactgagaggttgaacggccacattggaactgagatacggtccagactcctacgggaggcagcagtggggaatattgggcaatgggcgaaagcctgacccagcgacgccgcgtgagggaagaaggtcttcggattgtaaaccttgaacaacagggacgaaagaaatgacggtacctgttaggaagccacggctaactacgtgccagcagc

SEQ ID NO: 1851 - DNA, 490 bp, Unknown
  Ascusbbf_716912, encodes 16S rRNA
agagtttgatcatggctcaggacgaacgctggcggcgtgcctaacacatgcaagtcgaacggaactgctgtggaagctcttcggagcggaagcttcagtttagtggcggacgggtgagtaacgcgtgagcaacctgcctttcagagggggacaacggttggaaacgaccgctaataccgcatgaagcaattggttcgcatgaactgattgttaaagattttatcgctgaaagatgggctcgcgtctgattagatagttggtggggtaacggcctaccaagtcaacgatcagtagccggactgagaggttgaacggccacattgggactgagatacggcccagactcctacgggaggcagcagtggggaatattgggcaatgggggcaaccctgacccagcaacgccgcgtgaaggaagaaggctttcgggttgtaaacttcttttaccgaggacgaagaacgtgacggtactcggagaaaaagccacggc

SEQ ID NO: 1852 - DNA, 490 bp, Unknown
  Ascusbbf_1795218, encodes 16S rRNA
agagtttgatcctggctcagaacgaacgccggcggcgcgtcttaagcatgcaagtcgggcgggatcagggtgcttgcaccctgtgagagcggcggactggcgaggaacgcgtgggtgacgtgccctccgcaccgggacagccggcagaaatgccgggtgatacgggatgagctcgtttcctgtggtggggaacgaggaaagctgccacggcagcggcggaggagcggcccgcgtcccatcagctagtaggcggggcaaaagcccacctaggcgacgacgggtacccggactgagaggtcggacgggcgcattgggactgagatacggcccagactcctacgggaggcagcagctaagaatattccgcaatgggggaaaccctgacggagcgacgccgcgtggacgatggaggccggaaggttgtaaagtcctctggcgcctgaggaaggacccgggcagggaatggcccgggggtgactgtagggcgaga

SEQ ID NO: 1853 - DNA, 490 bp, Unknown
  Ascusbbf_208897, encodes 16S rRNA
agagtttgatcatggctcaggacgaacgctggcggcgtgcctaacacatgcaagtcgaacgagcgcacgggagcttgctcccgtgctgcgagtggcggacgggtgagtaacgcgtgaggaacctgccttacagagggggataacgtccggaaacggacgctaataccgcataacatatttttgccgcatggcagagatatcaaaggagcaatccgctgtaagatggcctcgcgtctgattagatagttggtgaggtaacggctcaccaagtcgacgatcagtagccggactgagaggttgatcggccacattgggactgagacacggcccagactcctacgggaggcagcagtgagggatattgcacaatgggggaaaccctgatgcagcaacgccgcgtgaaggaagacggttttcggattgtaaacttctgttttgggtgacgataatgacggtagcccgatagaaagccacggctaactacgtgcca

SEQ ID NO: 1854 - DNA, 490 bp, Unknown
  Ascusbbf_403931, encodes 16S rRNA
agagtttgatcatggctcaggacgaacgctggcggcgtggattaggcatgcaagtcgcacgagaaacattccttcgggaatgtagacagtggcgaactggtgagtaacacgtgaacaacctgcccttacattccggatagccggccgaaaggccggataatacgggcgaggatctttttaaggcatcttaaaaagaaggaaggcgcaagccgtgcaaggaggggttcgcggactatcaggtagttggtggggtaaaggcctaccaagccgacgacggatagctggtctgagaggatggtcagccacactgggactgagacactgcccagactcctacgggaggctgcagtcgagaatcttggacaatgtacgaaagtatgatccagcgacgccgcgtggaggatgaaggagctatgcttcgtaaactccttttatgggggaagaagatctgacggtaccccatgaataagccacggctaactacgtgcca

SEQ ID NO: 1855 - DNA, 490 bp, Unknown
  Ascusbbf_1841061, encodes 16S rRNA
agagtttgatcctggctcaggacgaacgctggcggcgtgcctaacacatgcaagtcgagcggagtaaagggaagagcttgctcggaactttactcagcggcggacgggtgagtaacgcgtgagcaacctggcctgcacagggggataacagttggaaacgactgctaataccgcataagaccacagcatcgcatggtgcaggggtcaaagaaattcggtgcaggatgggctcgcgtcccattagctagttggcaggataacagcctaccaaggcgacgatgggtagccgacctgagagggtgatcggccacactgggactgagacacggcccagactcctacgggaggcagcagtggggaatattgggcaatgggcgaaagcctgacccagcaacgccgcgtgaaggaagaaggtcttcggattgtaaacttttgtcgccagggacgatgatgacggtacctggtaagaaagccccggctaactacgtgc

SEQ ID NO: 1856 - DNA, 490 bp, Unknown
  Ascusbbf_1824790, encodes 16S rRNA
agagtttgatcatggctcaggatgaacgctggcggcatgcctaagacatgcaagtcgaacgaagtgtcccgttgaagtttggagtgcttgcacaaaaaatggatacggattcgcacttagtggcagacgggtgagtaacacgtgggtaatctacctcggagactgggataactattagaaatgatagctaataccggataattcgtaatcggataactgattatgctaaaaggggcttcggcctcacttcgagatgagcttgcggtgtattagctagttggtgaggtaatggcccaccaaggcgacgatgcatagccggactgagaggttgaacggccacattgggactgagacacggcccagactcctacgggagacagcagttaggaatattcgtcaatggaggaaactctgaacgagcaatgccgcgtgagtgatgacggtctttatgattgtaaaactctgttgtaaaggaagaacccttgctata

SEQ ID NO: 1857 - DNA, 490 bp, Unknown
  Ascusbbf_728888, encodes 16S rRNA
agagtttgatcatggctcaggatgaacgctagctacaggcttaacacttgcaagtcgagcggaactgcttcggcagtttagcggcagacgggtgagtaacacgtatccaacctttcccttactcgggtatagcctcgggaaactgagagtaatccccgatgaagtgtacgaggagcattttttgcacaccaaagatttatcggtgaggggtggggatgcgttccattagttagtaggcggggcaacggcccacctagacgatgatggataggggttctgagaggaaggtcccccacattggaactgcgacacggtccaaactcctacgggaggcagcagtgaggaatattggtcaatggtcggaagactgaaccagccaagtagcgtgcaggatgacggccctatgggttgtaaactgcttttatcagggaataaagtgcggcacgtgtgccgttttgtatgtacctgatgaataaggaccggctaattc

SEQ ID NO: 1858 - DNA, 490 bp, Unknown
  Ascusbbf_740024, encodes 16S rRNA
agagtttgatcctggctcaggatgaacgctggcggcgtgcttaacacattcaagtcgtacggacaaagggacttcggtcccctagttagtggcggacgggtgagtaacgcgtgagcaatctgccttcgggtgtggaataacagacggaaacggctgctaataccgcataacgtatacggaccgcatgatctgtataccaaagatttattgcccgaagatgagctcgcgtcccattagacagttggtgaggtaacggcccaccaaatctacgatgggtagccggactgagaggtcgaacggccacattggaactgagaaacggtccagactcctacgggaggcagcagtggggaatattgggcaatgggcgaaagcctgacccagcgacgccgcgtgaaggaagaaggtcttcggattgtaaactttagtcgacagggaagaaacaaatgacggtacctgtagaggaagccacgactaactacgtgccagc

SEQ ID NO: 1859 - DNA, 490 bp, Unknown
  Ascusbbf_729482, encodes 16S rRNA
agagtttgatcatggctcaggacgaacgctggcggcgtgcttaacacatgcaagtcgaacggtccttttacgggtagcaatacctgtttaaggatagtggcggacgggtgagtaacgcgtgagcaacctgcccatcagaggggaatagcgtctggaaacggacgataataccgcataaaactgagtcaccgcatgatgacacagccaaaggagaaatccgctgatggatgggctcgcgtccgattagatagttggtggggcaacggcctaccaagtcgacgatcggtagccggactgagaggttgaacggccacattgggactgagacacggcccagactcctacgggaggcagcagtgaggaatattgcacaatggaggaaactctgatgcagcaacgccgcgtgaaggatgacggttttcggattgtaaacttctgttcttggtgatgataatgacataagccaaggagcaagccacggctaactacg

SEQ ID NO: 1860 - DNA, 490 bp, Unknown
  Ascusbbf_989572, encodes 16S rRNA
agagtttgatcatggctcaggatgaacgctggcggcgtgcttaaaacatgcaagtcgaacgagtgaaattgattgatccttcgggtgatttcaatgaatctagtggcgaacgggtgagtaatacataggcaatctgccccaaggactgggataacggttagaaatgaccgctaataccggataggtagtaggaaggcatcttcttactattaaagttgggtttccaacaccgtgggatgagcttatgctgtattagcttgttggcgggataacagcccaccaaggcgatgatacatagctggtctgagaggatgaacagccacattgggactgagacacggcccagactcctacgggaggcagcagtaaggaattttcggcaatggacgaaagtctgaccgagcaacgccgcgtgagtgatgaaggtcttcggatcgtaaagctctgttgtaaaggaagaatattatgttgaggaaatgctacataagtg

SEQ ID NO: 1861 - DNA, 490 bp, Unknown
  Ascusbbf_1807823, encodes 16S rRNA
agagtttgatcctggctcaggacgaacgctggcggcgtgcctaacacatgcaagtcgaacgaggttatttatttcggtaattaaccgagtggcggacgggtgagtaacgcgtgagcaacctgtccctttgagggggataacaattggaaacagttgctaataccgcataagaccacgacccggcatcgggatgaggtcaaaggagcaatccgcggagggaggggctcgcgtcccattagatagttggcggggcaatggcccaccaagtcgacgatgggtagccaggctgagaggctgattggccacactggaactgagacacggtccagactcctacgggaggcagcagtggggaatattgggcaatgggcgcaagcctgacccagcaacgccgcgtgagggaagaaggctttcgggttgtaaacctctgtccttggtgacgaacacaatgacggtagccaaggaggaagccccggctaactacgtgcca

SEQ ID NO: 1862 - DNA, 490 bp, Unknown
  Ascusbbf_1753280, encodes 16S rRNA
agagtttgatcctggctcaggacgaacgctggcggcgtgcctaacacatgcaagtcgaacgagaagtgatgaaaagatctcttcggagtgattagattcatggacagtggcggacgggcgagtaacgcgtgagtaacctgcccataagcgggggatagccgatggaaacgtcgggtaataccccatgacatagttgagtcgcatggcttaattatcaaagatttatcgtttatggatggactcgcgtctgattagatagttggtgaggtaacggctcaccaagtcgacgatcagtagccgaactgagaggttgatcggccgcattgggactgagacacggcccagactcctacgggaggcagcagtgggggatattgcgcaatggggggaaccctgacgcagcaacgccgcgtgcaggaagaaggtcttcggattgtaaactgttgtcgcaagggaagaagacagtgacggtaccttgtgagaaagtcac

SEQ ID NO: 1863 - DNA, 490 bp, Unknown
  Ascusbbf_1872533, encodes 16S rRNA
agagtttgatcatggctcaggacgaacgctggcggcatgcctaacacatgcaagtcgaacggtttaagagataaattatttataatttgttttttagatagtggcgaacgggtgagtaacgcgtgagcaacctaccttttagagggggataacgcttggaaacaggcgctaataccgcataagctccgagtattgagtggtacagggagaaaaggagaaatccgctaaaagatgggctcgcgtccgattagctagttggtgagataacagcccaccaaggcgacgatcggtagccggactgagaggttgaacggccacattgggactgagacacggcccagactcctacgggaggcagcagtgggggatattgcacaatggggggaaccctgatgcagcaatgccgcgtgagggaagaagtttttcggaatgtaaacctctgtccttcgggaagataatgacggtaccgaaggaggaagctccggctaac

SEQ ID NO: 1864 - DNA, 490 bp, Unknown
  Ascusbbf_630914, encodes 16S rRNA
aggtttgatcatggctcaggatgaacgctggcggcgtgcctaatacatgcaagtcgaacgggtgtagcaatacatcagtggcgaacgggtgagtaacacgttggtgacctgccccaaagatgggaatatcacctggaaacgggtggcaaaaccgaataagctttgctcagtcagagaaggcaaagtaaaagcgtaagctactttgggaggggcctgcggcccatcagttagttggtgcgggtaacggcccaccaagacgaagacgggtaggggacctgagagggtggtcccccacaatggaactgaaacacggtccatacacctgcgggtggcagcagtagggaatattgcttaatgggcgaaagcctgaagcagcaacgccgcgtggacgatggaggccttcgggtcgtaaagtccttttatgggggaaaaggaaggatggtaccgcatgaataaggaccggctaattccgtgccagcagccgcggtaa

SEQ ID NO: 1865 - DNA, 490 bp, Unknown
  Ascusbbf_743528, encodes 16S rRNA
agagtttgatcatggctcaggatgaacgctggcggcgtgcttaacacatgcaagtcgaacggagtatatcaatcgagaccttcgggtctcacccggtgtacttagtggcggacgggtgagtaacgcgtgagcaaccaaccttatgcagggggataacaattagaaatgattgctaataccccataagaccacggtagcgcatgatactgtgggaaaaactccggtggcataagacgggctcgcgttcgattagctggatggtgaggtaacggctcaccatggcgacgatcgatagccggactgagaggtcgaccggccacattgggactgagacacggcccagactcctacgggaggcagcagtggggaatattgcacaatgggggaaaccctgatgcagcgacgccgcgtgagtgatgacgtatttcggtatgtaaagctcttttagtagggaagaagatgacggtacctacagaaacagccccggcta

SEQ ID NO: 1866 - DNA, 490 bp, Unknown
  Ascusbbf_1890361, encodes 16S rRNA
agagtttgatcatggctcaggatgaacgctagctacaggcttaacacatgcaagtcgaacgggactttgcgctgtagcaatacagtgtaaagtttagtggcagacgggtgagtaatgtataagaaacctacctttgagtggggaataacagtccgaaaggattgctaataccccataacatattgaaaaggcatctttttaatatcaaagatttatcgcttgaagatggtcttatattctatcagcttgttggcagtgtaacggactaccaaggctacgacggatagccggcctgaaagggcgaccggccacaagggcactgagacacgggccctactcctacgggaggcagcagtggggaattttggacaatgggcgaaagcctgatccagcaacgatgcgtggaggatgaaggttctcggattgtaaactccttttgtaagggaagaaaaaaatgacggtaccttacgaataagccacggctaactac

SEQ ID NO: 1867 - DNA, 490 bp, Unknown
  Ascusbbf_1802180, encodes 16S rRNA
agagtttgatcctggctcaggacgaacgctggcggcgtgcttaacacatgcaagtcgaacgaggaatgagggagagcttgctctttcacatttcgaggggcggacgggtgagtaacgcgtgaggaacctgtctttcacagggggataacgttccgaaagggacgctaataccgcataagaccacattgccgcatggcagaggggtcaaaggagagatccggtgagaggtggcctcgcgtcccattaggcagttggcggggtaacggcccaccaaaccaacgatgggtagccgacctgagagggtgatcggccacattggaactgagacacggtccaaactcctacgggaggcagcagtggggaatattgggcaatgggcgcaagcctgacccagcaacgccgcgtgagggaagaaggttttcggattgtaaacctctgtcccgggagacgaggaagagacggtatcccgggaggaagccccggctaacta

SEQ ID NO: 1868 - DNA, 490 bp, Unknown
  Ascusbbf_1812892, encodes 16S rRNA
agagtttgatcatggctcaggataaacgctggcggcgtgcctaatacatgcaagtcgtacgctgaaagtctagcttgctagatgagtaggagtggcgaacgggtgagtaatacataagcaacctgcccacgaagactgggataatccttggaaacgaggactaataccggataggtaattggatggcatcttccgattattaaaggtttaaaacactggtggatgggcttatggcgcattagcttgttggtgaggtaacggctcaccaaggcgatgatgcgtagccggcctgagagggtgaacggccacattgggactgagacacggcccagactcctacgggaggcagcagtagggaattttcggcaatgggcgaaagcctgaccgagcaacgccgcgtgagtgatgacggccttcgggttgtaaagctctgttgtaagggaagaacaattaagagaaaatcttaaactgacggtaccttaccagaaag

SEQ ID NO: 1869 - DNA, 490 bp, Unknown
  Ascusbbf_1666734, encodes 16S rRNA
agagtttgatcctggctcaggacgaacgctgtcggcacgcttaacacatgcaagtcgaacgagcgaaagagtgcttgcactctctagctagtggcggacgggtgagtatcacgagagcaatctgcctttcggtgggggataccatttggaaacgaatgttaataccccataacatagaggatccgcatggattttctatcaaaggtttactgccggaagatgagctcgcgtctgattaggtagttggtgaggtaacggctcaccaagccgacgatcagtagccggactgagaggttgaacggccacattgggactgagacacggcccagactcctacgggaggcagcagtggggaatattgcacaatgggcgaaagcctgatgcagcgatgccgcgtgagggaagaaggttttaggattgtaaacctctgtctttggggacgataatgacggtacccaaggaggaagctccggctaactacgtgccagca

SEQ ID NO: 1870 - DNA, 490 bp, Unknown
  Ascusbbf_1341400, encodes 16S rRNA
agagttgatctggctcaggatgaacgctggcggcgtgcctaatacatgcaagtcgaacgagggtgcttgcaccctagtggcgaacgggtgagtaacacgtaggtaacctgcccttaagcttgggatacccagaggaaactttggctaataccggataacaacagaggaggcatctcttcagtttgaaaggccctttacggggtcacttaaggatggacctgcggcgcattagctagttggtgagataacagcccaccaaggcgaggatgcgtagccgacctgcgaggttgatcggccaaattgaaacttggacaaggtccaaactccgacgggaggcagcagtaaggagttttcggcaatgggggaaaccctgaccgagcaacgccgcgtgagtgatgacggccctatgggttgtaaagctctgttgtaagggacgaatgactaggttaggaaatgaacttagtttgacggtaccttaccagaaagccac

SEQ ID NO: 1871 - DNA, 490 bp, Unknown
  Ascusbbf_1834020, encodes 16S rRNA
agagtttgatcctggctcaggatgaacgctggcggcgtgcctaacacatgcaagtcgagcggtatatacttaaacaaaacttcggtcgagtgagagtatagagagcggcggacgggtgagtaacgcgtaggcaacctgccccatacagagggatagcctcgggaaaccgggattaaaacctcataacgcgaaaggatctcatggttctttcgccaaagatttatcggtatgggatgggcctgcgtctgattagctagttggtaaggtaacggcttaccaaggcaacgatcagtagccgacctgagagggtaatcggccacattggaactaagacacggtccaaactcctacgggaggcagcagtggggaatattgcacaatgggcgaaagcctgatgcagcaacgccgcgtgagcgatgaaggcctttgggtcgtaaagctctgtccttggggaagaaaaaaatgacggtacccttggaggaagccccgg

SEQ ID NO: 1872 - DNA, 490 bp, Unknown
  Ascusbbf_661041, encodes 16S rRNA
agagtttgatcatggctcagaatgaacgttggcggcatggattaggcatgcaagtcgagcgagaagctaaagattgaaacttcggtcgatttctttagtggaaagcggcgcaagggagagtaacgagtagttatctaccccagggtccggaatagctgcgggaaactgcgggtaatgccggataatatccccggatcaaaggtgtgattccgccctgggaggagactgctttgtactagcttgttggtggggtaatggcctaccaaggctacgatgcatagcgggcgtgagagcgtggcccgtctcactgggactgaaacactgcccagacacctacgggtggctgcagtcgagaatcttcggcaatgggcgaaagcctgaccgagcaatgccgcgtgcgggatgaaggccttcgggttgtaaaccgctgtcagttgggaggaagggtccgtgaagagcggatcttgacctatcttcagaggaagtccgg

SEQ ID NO: 1873 - DNA, 490 bp, Unknown
  Ascusbbf_1642234, encodes 16S rRNA
agagtttgatcctggctcaggacgaacgctggcggcgtgcttaacacatgcaagtcgaacgaagcttgattaaagatttcttcggaatgatttaagatatgactgagtggcggacgggtgagtaacgcgtgagcaacctgcccttcagagggggatagcgtctggaaacggacggtaataccgcataacgtgcagataaggcatcttaactgtaccaaagatttatcgctgaaggatgggctcgcgtctgattagatagttggtggggtaacggcctaccaagtcgacgatcagtagccggactgagaggttgaacggccacattgggactgagacacggcccagactcctacgggaggcagcagtggggaatattgcacaatgggggaaaccctgatgcagcaacgccgcgtggaggaagacggttttcggattgtaaactcctgttcttaaggaagaagaaagtgacggtacttaaggagcaagccac

SEQ ID NO: 1874 - DNA, 490 bp, Unknown
  Ascusbbf_1557135, encodes 16S rRNA
agagtttgatcatggctcaggatgaacgctagcggcaggcctaacacatgcaagtcgaggggtaacggggtgcttgcaccgccgacgaccggcgcacgggtgagcaacgcgtatagaacctacccgttacagggggatagcccagagaaatttggatcaataccccgtggggcccttgaccggcatcggtcttgggctaaagaacttcggtaacggatggctatgcgtcccattagctagttggcagggtaacggcctaccaaggcagcgatgggtaggggccctgagagggggatcccccacactggtactgagacacggaccagactcctacgggaggcagcagtgaggaatattggacaatgggcggtagcctgatccagccatgccgcgtgcaggaagaatgtcctatggactgtaaactgcttttgtacgggaagaaccgggggcacgcgtgcccccctgacggtaccgtaagaataaggatcgg

SEQ ID NO: 1875 - DNA, 490 bp, Unknown
  Ascusbbf_6428, encodes 16S rRNA
agagtttgatcatggctcaggatgaacgctggcggcgtgcctaacacatgcaagtcgaacggagacagagagacgttttcggacagacctctatcttagtggcggacgggtgagtaacgcgtggataacctgcctctttctgggggatagcagttggaaacgactgataataccgcataagttccttttctcgcatgagggaaggaagaaagatttatcgggaagagatggatccgcgtctgattagccagttggcggggtaacggcccaccaaagcgacgatcagtagccggcctgagagggtgaacggccacattgggactgagacacggcccaaactcctacgggaggcagcagtggggaatattgcacaatgggcgcaagcctgatgcagcgacgccgcgtgagtgaagaagtatttcggtatgtaaagctctatcagcagggaagaaaggcccgaaagggagatgacggtacctgactaagaagc

SEQ ID NO: 1876 - DNA, 490 bp, Unknown
  Ascusbbf_61187, encodes 16S rRNA
agagtttgatcatggctcaggatgaacgctggcggcgtgcttaacacatgcaagtcgaacggggaatactttaacagagacttcggttgaagttgctgtattcctagtggcggacgggtgagtaacgcgtgggtaacctgcctcacactgggggataacagtcagaaatgactgctaataccgcataagcgcacagcatcgcatgatgcagtgtgaaaaactccggtggtgtgagatggacccgcgttggattagctagttggcagggcagcggcctaccaaggcgacgatccatagccggcctgagagggtggacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagataatgacggtacctgactaagaagccccggc

SEQ ID NO: 1877 - DNA, 490 bp, Unknown
  Ascusbbf_205174, encodes 16S rRNA
agagtttgatcctggctcaggatgaacgctggcggcgtgcttaacacatgcaagtcgagcgaagcacttcacccgaaaaagggacctgcttgcagggaacggattcaaccgaagtgactgagcggcggacgggtgagtaacgcgtgggtaacctgcctcatacagggggataacagttagaaatgactgctaataccgcataagcgcacaggagggcatcctctggtgtgaaaaactccggtggtatgagatggacccgcgtcggattagccagttggcggggtaacggcccaccaaagcgacgatccgtagccggcctgagagggcgaccggccacattgggactgagacacggcccaaactcctacgggaggcagcagtggggaatattgcacaatgggggaaaccctgatgcagcgacgccgcgtgagtgatgaagtatttcggtacgtaaagctctatcagcagggaagaagacgacggtacctga

SEQ ID NO: 1878 - DNA, 490 bp, Unknown
  Ascusbbf_4758, encodes 16S rRNA
agagtttgatcatggctcagaacgaacgctggcggcaggcttaacacatgcaagttgagcgggaatggtttatagcttgctatgaatcatgagagcagcgcactggtgagtaacacgtgggaacgtaccttttagtgggggacaacatttggaaacggatgctaataccgcataatccctgagggggaaaggagagattcgctgaaagatcggcccgcggaagattaggtagtaggtggggcaacggcctacctagccgacgatctatagctggtctgagaggacgatcagccacattggaactgagacacggtccagactcctacgggaggcagcagtgaggaatattgggcaatggagggaactctgacccagccatgccgcgtgagtgaagaaggttttcggattgtaaagctctttcagatgggaagatgatgacggtaccatcagaagaagcaccggctaacttcgtgccagcagccgcggtaat

SEQ ID NO: 1879 - DNA, 490 bp, Unknown
  Ascusbbf_65482, encodes 16S rRNA
agagtttgatcctggctcaggatgaacgctagcggcaggcttaacacatgcaagtcgaggggcatcgtggagtagcaatactctgacggcgaccggcgaaagggtgagtaacgcgtgagcaacatgcccggtaccggaggatagtcgatggaaacgtcgcgtaatactccgtaacatacggaaccgcatgattctgtattgagagatttatcgctaccggattggctcgcgtcccattaggcagttggcggggtaacggcccaccaaaccgacgatgggtaggggttctgagaggaaggtcccccacattggaactgagacacggtccagactcctacgggaggcagcagtgaggaatattggacaatggccgagaggctgatccagccatgccgcgtgcgggaggacggccctatgggttgtaaaccgcttttgtcagggggcaataagggccacgtgtggcccgatgagagtacctggcgaataagca

SEQ ID NO: 1880 - DNA, 490 bp, Unknown
  Ascusbbf_12069, encodes 16S rRNA
agagtttgatcatggctcagaacgaacgctggcggcgcgtcttaagcatgcaagtcgagcggtaagttgtagcttgctacaacctagagcggcggactggtgagtaacgcgtgggtgacgtacccttttgacggggatagcctgtggaaacacagggtaataccggataagctggcttgtgtcagaggcaagtcaggaaaggttcttttgaaccgcgaaaggagcggcccgcgtgctattagttagttggcggggtaacggcccaccaagacgacgatagctacccggcctaagagggtgaacgggcacattgggactgagatacggcccagactcctacgggaggcagcagctaagaatattccgcaatggacgaaagtctgacggagcgacgccgcgtggatgatgaaggccggaaggttgtaaaatccttttgggagcgaggaataaggaatctgagagaaacggattctggtgacggtagcttctg

SEQ ID NO: 1881 - DNA, 490 bp, Unknown
  Ascusbbf_21248, encodes 16S rRNA
agagtttgatcctggctcaggatgaacgctggcggcgtgcttaacacattcaagtcgaacgaactgatttggaagcttgcttctgatgaaagttagtggcggacgggtgagtaacgcgtgagcaacctgcctttgcgcgggggataacacttggaaacgggtgctaataccgcataatgtatactgaccgcatgatcggtatatcaaagatttattgcgcaaagatgggctcgcgtctgattagctggttggtgaggtaacggctcaccaaggcgacgatcagtagccggactgagaggttgaacggccacattggaactgagatacggtccagactcctacgggaggcagcagtggggaatattgggcaatgggcgcaagcctgacccagcgacgccgcgtgagggaagaaggtcttcggattgtaaacctttgtagacagggacgaaacaaatgacggtacctgtaaagtaagccacggctaactacg

SEQ ID NO: 1882 - DNA, 468 bp, Unknown
  Ascusbbf_133735, encodes 16S rRNA
agagtttgatcctggctcagaacgaacgctggcggcaggcttaacacatgcaagtcgaacgccccgcaaggggagtggcgcacgggtgagtaacgcgtgggaacctacctatcggtacggaataacacagggaaacttgtgctaataccgtatgagctctacggaggaaagatttatcgccgatagatgggcccgcgtccgattagctagttggtgaggtaacggctcaccaaggcttcgatcggtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgtcggggaagataatgacggtacccgaagaagaagcctcggctaactccgtgccagcagccgcggtaat

SEQ ID NO: 1883 - DNA, 490 bp, Unknown
  Ascusbbf_17305, encodes 16S rRNA
agagtttgatcatggctcaggacgaacgctggcggcgtgcctaacacatgcaagtcgaacggagtgattgttttcggatgatcacttagtggcgaacgggtgagtaacgcgtgaacaacctgccttcctgagggggataacacctggaaacaagtgctaataccgcataagaccacatatccgcatggatgaggggtcaaaggagcgatccgcagggagaggggttcgcgtcccattagctagttggcggggcaacggcccaccaaggcgacgatgggtagccgagctgagaggctgatcggccacactggaactgagacacggtccagactcctacgggaggcagcagtggggaatattgggcaatgggcgcaagcctgacccagcaacgccgcgtgagggaagaaggtcttcggattgtaaacctctgtcctatgtgacgaaggaagtgacggtagcataggaggaagccccggctaactacgtgcca

SEQ ID NO: 1884 - DNA, 488 bp, Unknown
  Ascusbbf_1698, encodes 16S rRNA
agagtttgatcatggctcagaacgaacgctggcggcatggattaggcatgcaagtcgaacgaagcagcaatgcttagtggcggaagggtgaggaacgcgtgagtaatctgccctcaagttgggaataacagctggaaacggctgctaataccgaatgtggctgcaagaccgcatgattttgcagttaaagatttattgcttgaggatgagctcgcgtcccattagctagttggtgaggcaacggctcaccaaggcgatgatgggtagctggtctgagaggatggtcagccacactgggactgagacactgcccagactcctacgggaggctgcagtcgagaatcttgggcaatgcgcgaaagcgtgacccagcaatgccgcgtgcgcgatgaaggtcttcggattgtaaagcgctgtcaaccgggacgaaaaatgacggtaccggtggaggaagccacggctaactacgtgccagcagccgcggtaat

SEQ ID NO: 1885 - DNA, 490 bp, Unknown
  Ascusbbf_30748, encodes 16S rRNA
agagtttgatcatggctcaggacgaacgctggcggcgtgcctaacacatgcaagtcgaacgggacttattggaatgagacttcggtcaaaggaaaataagtttagtggcggacgggtgagtaacgcgtgagcaacctgcctttcagagggggacaacagttggaaacgactgctaataccgcataacgtacagaggaggcatcttccctgtaccaaagatttatcgctgaaagatgggctcgcgtctgattagatagttggcggggtaacggcccaccaagtcgacgatcagtagccggactgagaggttgaacggccacattgggactgagatacggcccagactcctacgggaggcagcagtggggaatattggtcaatgggggcaaccctgaaccagcaacgccgcgtgaaggaagaaggctttcgggttgtaaacttcttttgccggggacgaaacaaatgacggtacccggcgaataagccacgg

SEQ ID NO: 1886 - DNA, 490 bp, Unknown
  Ascusbbf_232636, encodes 16S rRNA
agagtttgatcctggctcagattgaacgctggcggcatgctttacacatgcaagtcggacggcagcggggtagtgcttgcactactgccggcgagtggcgaacgggtgagtaacgcatcggaacgtaccgggtagtgggggataaccgtccgaaagggcggctaataccgcatacgctttgagaaggaaagcgggggaccattcggcctcgcgctatccgagcggccgatgtctgattaggtagttggtggggtaaaggcctaccaagccgacgatcagtagcgggtctgagaggatgatccgccacactgggactgagacacggcccagactcctacgggaggcagcagtggggaattttggacaatgggggcaaccctgatccagccatgccgcgtgtctgaagaaggccttcgggttgtaaaggacttttgtcagggaagaaaggcaggatgctaatatcgttctgtgatgacggtacctgaagaat

SEQ ID NO: 1887 - DNA, 490 bp, Unknown
  Ascusbbf_62176, encodes 16S rRNA
agagtttgatcctggctcaggatgaacgctggcggcgtgcctaacacatgcaagtcgagcggagttatgagagaagcttgcttcacttttaacttagcggcggacgggtgagtaacacgtgagtaacctgccctcgagtggggaacaacatcgagaaatcggtgctaataccgcataatatcggagatccgcatgcttctccgatcaaaggatttattcgcttgaggatggactcgcgtccgattagttagttggtgaggtaacggcccaccaagacatcgatcggtagccgaactgagaggttgatcggccacattgggactgagacacggcccagactcctacgggaggcagcagtggggaatattgggcaatgggcgaaagcctgacccagcaacgccgcgtgaaggatgaaggtcttcggattgtaaacttctttgatcagggacgaaacaaatgacggtacctgaagaacaagccacggctaact

SEQ ID NO: 1888 - DNA, 490 bp, Unknown
  Ascusbbf_1024614, encodes 16S rRNA
agagtttgatcatggctcagaacgaacgctggtagcgtggattaggcatgcaagtcgaacgggatccgggaggtagcaatgtcgaccggtgagagtggcggattggggaggaacacgtgagcaacctgcctttgagtcggggaaaaccgttggaaacgacggctaataccggatgcggcgcccggagacatcttcggagcgctaaagggggccgcaaggctcccgctcgtagaggggctcgcgcaccatcagcttgttggcggggtaacggcccaccaaggcctacggttagctggtctgagaggatgaccagccccactgggactgagatactgcccagactcctacgagaggctgcagtcgaggatcatttgcaatgggcgaaagcctgacaatgcgacgctgcgtggaggatgaaggccttcgggtcgtaaactcctgtcatgggggaacaggcgaggggacccaacacgtcccttagttgagtgta

SEQ ID NO: 1889 - DNA, 490 bp, Unknown
  Ascusbbf_37669, encodes 16S rRNA
agagtttgatcctggctcaggacgaacgctggcggcgcgcctaacacatgcaagtcgaacggagcatagggacggaagcttcggcagaagatcctatgtttagtggcgaacgggtgagtaacacgtgaggaacctgcctttaagagggggataacacttagaaataggtgctaataccgcataagaccacaggatggcatcatccaggggtcaaaggaggaatccgcttaaagatggcctcgcgtccgattaggtagtaggcggggcaacggcccacctagccgacgatcggtagccggactgagaggtcgaacggccacattgggactgagacacggcccagactcctacgggaggcagcagtggggaatattgggcaatgggggaaaccctgacccagcgacgccgcgtgagggaagaaggttttcggattgtaaacctctgtcttcggggacgatagtgacggtacccgaggaggaagccacggcta

SEQ ID NO: 1890 - DNA, 490 bp, Unknown
  Ascusbbf_210470, encodes 16S rRNA
agagtttgatcctggctcaggataaacgctggcggcgtgcataacacattcaagtcgaacggactgatacgaaagcttgcttttgttgaaagttagtggcggacgggtgagtaacgcgtgagcaacctgcctatttgagcggaataacacccggaaacaggtgctaataccgcatgaagcacacgaatcgcatggtttgtgtgtcaaagatttatcgcagatagatgggctcgcgtctgattagctggttggtgaggtaacggctcaccaaggcgacgatcagtagccggactgagaggttgaacggccacattggaactgagatacggtccagactcctacgggaggcagcagtggggaatattgggcaatgggggcaaccctgacccagcgacgccgcgtgagggaagaaggtcttcggattgtaaacctttgttaacggggacgaaaaaaatgacggtacccgaatagaaagccacggctaactacg

SEQ ID NO: 1891 - DNA, 490 bp, Unknown
  Ascusbbf_391371, encodes 16S rRNA
agagtttgatcctggctcaggatgaacgctagctacaggcttaacacatgcaagtcgaacgaagcttgaagaaagattccttcgggatgaattcggatatgactgagtggcggacgggtgagtaacgcgtgagtaacctgcctcttggagggggatagtgtttggaaacgaacagtaataccgcataatgtgcattgatggcatcttcaatgtaccaaagatttatcgccaagagatggactcgcgtctgattagatagttggtgaggtaacggctcaccaagtcgacgatcagtagccggactgagaggttgaacggccacattgggactgagacacggcccagactcctacgggaggcagcagtggggaatattgcacaatgggcgcaagcctgatgcagcaacgccgcgtggaggaagacggttttcggattgtaaactcctgttcttagggaagaagaaagtgacggtacctaaggagcaagccac

SEQ ID NO: 1892 - DNA, 490 bp, Unknown
  Ascusbbf_2270, encodes 16S rRNA
agagtttgatcatggctcaggatgaacgctagcggcaggcttaacacatgcaagtcgaggggcagcatgagagcgtagcaatacattcttgatggcgaccggcgcaagggtgcgtaacgcgtgagcaacttgcccgcatcaggggcataatcggtggaaacgccgtctaactccccataacatacgaggtggcatcactttgtattgaaatccttggaggatgcggatgggctcgcgtgacattaggcagttggcggggtaacggcccaccaaacctacgatgtctaggggaactgagaggttaatcccccacactggaactgagacacggtccagactcctacgggaggcagcagtgaggaatattggacaatggagggaactctgatccagccatgccgcgtgcaggataaggtcctatggattgtaaactgcttttgtacgggagcaataaggtccacgtgtgggtcgatgagagtaccgtacgaat

SEQ ID NO: 1893 - DNA, 490 bp, Unknown
  Ascusbbf_4909, encodes 16S rRNA
agagtttgatcatggctcaggatgaacgctggcggcgtgcctaacacatgcaagtcgaacgaagttttaacgacggaagtcttcggacggaagatgttacaacttagtggcggacgggtgagtaacgcgtgagcaacctgcctttcagagggggacaacagttggaaacgactgctaataccgcataacgtatatttatggcatcatagatataccaaaggagcaatccgctgaaagatgggctcgcgttggattagatagttggtggggtaacggcctaccaagtcgacgatccatagccggactgagaggttgaacggccacattgggactgagacacggcccagactcctacgggaggcagcagtgggggatattgcacaatgggcgaaagcctgatgcagcaacgccgcgtgagggaagaaggtcttcggattgtaaacctttgtccttgctgacgaataaagtgacggtaagcaaggaggaagtc

SEQ ID NO: 1894 - DNA, 490 bp, Unknown
  Ascusbbf_8272, encodes 16S rRNA
agagtttgatcatggctcaggattaacgctggcggcatgcctaatacatgcaagtcgaatggtagcaataccatggcgaacgggtgagtaacacgtaggtaacctgtctttaagacgaggataaccgatggaaacgtcggataatactcgataggtgatttgaaggcatctttggatcattaaagatttatcacttagagaggggcctgcggcgcattagctagatggcggtgtaatggaccaccatggcgatgatgcgtagccggactgagaggttgaacggccacaatgggactgagaacggcccatactcctacgggaggcagcagtagggaattttcggcaatgggcgaaagcctgaccgagcaatgccgcgtgaacgaagaagtatttcggtatgtaaagttcttttatcggggaagaaaaatgaccaaattgacggtacctgatgaataagctccggctaactacgtgccagcagccgcggtaa

SEQ ID NO: 1895 - DNA, 490 bp, Unknown
  Ascusbbf_14983, encodes 16S rRNA
agagtttgatcctggctcaggatgaacgctggcggcgtgcttaacacattcaagtcgaacgagcgataacgggaagcttgctttctgttaaagcgagtggcggacgggtgagtaacgcgtgagcaacctgccttagactggggaataacatcgggaaaccggtgctaataccgcataacgcatcgaggtcgcatggccatgatgccaaaggagcaatccggtgtaagatgggctcgcgtctgattaggtagttggtgaggtaacggctcaccaagcctgcgatcagtagccggactgagaggtcgatcggccacattggaactgagatacggtccagactcctacgggaggcagcagtggggaatattgggcaatgggcgaaagcctgacccagcgacgccgcgtgaaggaagaagatcttcggattgtaaacttctgtcaacagggacgaaggaagtgacggtacctgtggaggaagccacggctaact

SEQ ID NO: 1896 - DNA, 490 bp, Unknown
  Ascusbbf_38213, encodes 16S rRNA
agagtttgatcatggctcaggatgaacgctggcggcacgcttaacacatgcaagtcgaacgaagcttacggaagggagttttcggacaaacagaagtaagacttagtggcggacgggtgcgtaacgcgtgggtaacctaccctggactgggggataacgtatagaaatgtacgctaataccgcataagctcacgggaccgcatggtccagtgggaaaagccgagacggtctaggatgggcccgcgtctgattagctggttggtggggtaacggcctaccaaggcaacgatcagtagccggtctgagaggatggacggccacattgggactgagacacggcccaaactcctacgggaggcagcagtggggaatattgcacaatgggggaaaccctgatgcagcgatgccgcgtgaaggaagaagtgtttcggcacgtaaacttctatcagcaaggaagaagaaagacagtacttgagtaagcagccccggc

SEQ ID NO: 1897 - DNA, 490 bp, Unknown
  Ascusbbf_79227, encodes 16S rRNA
agagtttgatcatggctcaggatgaacgctggcggcgtgcctaacacatgcaagtcgaacggtgatgagcagaaattttcggatggaagctgatcatagtggcggacgggtgagtaacgcgtggataacctgcctctcgctgggggatagcagccggaaacggctggtaataccgcatacgttcatttccccgcatggggaggtgaggaaagatttatcggcgagagatggatccgcgtctgattagccagttggcggggtaacggcccaccaaagcgacgatcagtagccggcctgagagggtgatcggccacattgggactgagacacggcccaaactcctacgggaggcagcagtgggggatattgcacaatgggcgcaagcctgatgcagcgacgccgcgtgagtgaagaagtatttcggtatgtaaagctctatcggcagggaagaaaggcccgcaagggagatgacggtacctgactaagaagc

SEQ ID NO: 1898 - DNA, 490 bp, Unknown
  Ascusbbf_27613, encodes 16S rRNA
agagtttgatcctggctcaggacgaacgctggcggcgtgcttaaaacatgcaagtcgaacggaattgtttgttagcactaagggatttggaaaaattccttagtgctgacaaagaatttagtggcggacgggtgagtaacacatgagcaacctgccttttacagggggataacacttagaaataggtgctaataccgcataagaccacggtgggacatcccacaggggtcaaaggagcaatccggtaaaagaggggcttgtggctcattagctagttggcggggtaacggcccaccaaggcgacgatgagtagccgacctgagagggtgaacggccacattggaactgagaaacggtccagactcctacgggaggcagcagttaggaatattgggcaatggacgaaagtctgacccagcaacgccgcgtgaaggaagaaggttttcggattgtaaacttctgatctaagggaaaaagaaagtgatggtac

SEQ ID NO: 1899 - DNA, 490 bp, Unknown
  Ascusbbf_100882, encodes 16S rRNA
agagtttgatcctggctcagaacgaacgctggcggcatggattaggcatgcaagtcgaacgggtgcagcaatgcaccagtggcgcaagggtgaggaacacgtgagtaatctaccctcaagattgggatagctcctggaaacgggaattaataccggatgaaacagtatgtccgcatggatgtacttttaaagcagcaatgcgcttgaggaggagctcgcgtcccattagctggttggtgaggtaacggcccaccaaggcgatgatgggtagctggtctgagaggacgatcagccacattgggactgagaaactgcccagactcctacgggaggctgcagtcgagaattttgggcaatgagcgaaagcttgacccagcaatgccgcgtgcgggatgaaggtcttcggattgtaaaccgctgttgagagggacgaagattgacggtacctctagaggaagccacggctaactacgtgccagcagccgcggta

SEQ ID NO: 1900 - DNA, 490 bp, Unknown
  Ascusbbf_123418, encodes 16S rRNA
agagtttgatcctggctcaggatgaacgctggcggcgtgcttaacacatgcaagtcgaacggagtgcccttgattgaggattcgtccaaatgatagggttacttagtggcggacgggtgagtaacgcgtgagtaacctgcctaggagtggggaataacacagagaaatctgtgctaataccgcataatgcagttgggtcgcatggctctgactgccaaagatttatcgctcttagatggactcgcgtctgattagctagttggcggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggatgaaggctttcgggttgtaaacttcttttctcagggacgaaagaaatgacggtacctgaggaataagccac

SEQ ID NO: 1901 - DNA, 490 bp, Unknown
  Ascusbbf_97754, encodes 16S rRNA
agagtttgatcatggctcaggatgaacgctggcggcgtgcctaacacatgcaagtcgaacggagcattggcgcagaggagggaattagcttgctaaggaacgaatcatgccaatacttagtggcggacgggtgagtaacgtgtggataacctggtccatgcagggggatagcagctggaaacggctgataataccgcataagcgcacagtaaggcatcttacggtgtgaaaaggagcaatccgggatggaatggatccgcatctgattagccagttggcggggtagaagcccaccaaagcgacgatcagtagccggcctgagagggcggacggccacattgggactgagacacggcccagactcctacgggaggcagcagtgggggatattgcacaatggggggaaccctgatgcagcgacgccgcgtgggtgaagaagtatttcggtatgtaaagccctatcagcagggaagataatgacggtacctga

SEQ ID NO: 1902 - DNA, 490 bp, Unknown
  Ascusbbf_209652, encodes 16S rRNA
agagtttgatcatggctcaggacgaacgctggcggcgtgcttaacacatgcaagtcgaacgaagccgttccaccgatacagagtacttcggtacgaagtatcaccggaaagacttagtggcggacgggtgagtaacgcgtgagcaacctgcccataagagggggataacagttggaaacgactgctaataccgcataagaccacattaccgcatggtagaggggtcaaagaacggaatcgcttatggatgggctcgcgtcccattaggtagttggcaggataaaagcctaccaagccgacgatgggtagccgacctgagagggtgatcggccacactggaactgagacacggtccagactcctacgggaggcagcagtggggaatattgggcaatgggcgcaagcctgacccagcaacgccgcgtgagggaagaaggccttcgggttgtaaacctctgtcctatgggaagaacgaaatgacggtaccatg

SEQ ID NO: 1903 - DNA, 490 bp, Unknown
  Ascusbbf_4428, encodes 16S rRNA
agagtttgatcatggctcaggatgaacgctagcggcaggcttaacacatgcaagtcgaggggcagcgggttgtagcaatacaatgccggcgaccggcgaaagggtgagtaacgcgtgagcaacatgcccggtactggaggatagtcgatggaaacgtcgcgtaatactccgtaacaacagggaccgcatgatccttgtttaagagatttattgatatcggattggctcgcgtgccattagctagttggcggggtaacggcccaccaaggcgacgatggctaggggttctgagaggaaggtcccccacattggaactgagacacggtccagactcctacgggaggcagcagtgaggaatattggtcaatggccgagaggctgaaccagccatgccgcgtgcgggaggacggccctatgggttgtaaaccgcttttgttggggagcaataagtgctacgtgtagcacgatgagagtacccagcgaataagca

SEQ ID NO: 1904 - DNA, 490 bp, Unknown
  Ascusbbf_21907, encodes 16S rRNA
agagtttgatcatggctcaggatgaacgctggcggcgtgcttaacacattcaagtcgaacgatgaagttccttcgggaacggattagtggcggacgggtgagtaacgcgtgagcaacctgccttgcagagggggataacacagggaaacttgtgctaataccgcatgatgcatactgatcgcatgttcggtatgccaaaggagcaatccgctgtaagatgggctcgcgtccgattaggtagttggtgaggtaacggcccaccaagccgacgatcggtagccggactgagaggtcgaacggccacattggaactgagatacggtccagactcctacgggaggcagcagtggggaatattgggcaatgggcgaaagcctgacccagcgacgccgcgtgagggaagaaggtcttcggattgtaaacctttgtcatcagggacgaagaaatgacggtacctgagaaggaagccacggctaactacgtgccagca

SEQ ID NO: 1905 - DNA, 490 bp, Unknown
  Ascusbbf_31297, encodes 16S rRNA
agagtttgatcatggctcaggacgaacgctggcggcatgcttaacacatgcaagtcgaacgggacgttgacaaatcagcgatgaggcggagacgtttagtggcgaacgggtgagtaacgcgtgagcaacctgccttgtacattgggataccagagggaaacttctgttaataccgaataagaccacagcaccgcatggtgcaggggtcaaagcgatttagcggtacaagatgggctcgcgtcccattagctagttggcgggataacagcccaccaaggcgacgatgggtagccgacttgagagagtgatcggccacaatggaactgagacacggtccatactcctacgggaggcagcagtggggaatattgggcaatgggcgaaagccttacccagcaatgccgcgtgaatgaagaaggtcttcggattgtaaagttcttttattggtgacgaacgcaatgacggtagccgatgaataagccccggctaa

SEQ ID NO: 1906 - DNA, 490 bp, Unknown
  Ascusbbf_1335597, encodes 16S rRNA
agagtttgatcctggctcagaacgaacgctggcggcgtggattaggcatgcaagtcgtacgagaaagcgtccttcggggcgtgagtacagtggcgaactggtgagtacaaggtgactaacctgcccttgagtgggggataacttcgggaaaccggagctaataccgcatagtctctttgccctgcggggtaacgagtaaagcagtaatgcgctcgaggatggggtcaccccccattagcttgttggtagggtaatggcctaccaaggctgcgatgggtagctggactgagaggttgaccagccacactgggactgggatacggcccagactcctacggggggaagcagtctagaggcttcgacaatgcccgaaagggtgatcgagcgacgccgcgtgcgggatgaaggccttcgggtcgtaaaccgcttttgtttgggaagaaggcttgtatcgtgaatatgagattgacggtaccaaacgaataagccc

SEQ ID NO: 1907 - DNA, 490 bp, Unknown
  Ascusbbf_39287, encodes 16S rRNA
agagtttgatcatggctcagaacgaacgctggcggcgtggattaggcatgcaagtcgaacgggactttatgttgtagcaatactttataaagtctagtggcgtaagggtgagtaacacgtgggtaatgtacccgatagtttgggataacgttccgaaagggacgctaataccggatgtgatgtcagatcgccggatctgacaagaaaggtggggaccgcaaggcctgccgctaacggaacggcccgcgacctattagctagttggtggggtaaaggcctaccaaggcaaggatgggtagccgaactgagaggttgaccggccacactgggactgagacactgcccagacttctacggaaggctgcagtcgagaatcattcacaatggacgaaagtctgatgatgcgacgccgcgtgcgcgatgaaggtcttcggattgtaaagcgctttgaacagggaagaatgccatgtatttaatagataacgtggag

SEQ ID NO: 1908 - DNA, 490 bp, Unknown
  Ascusbbf_567055, encodes 16S rRNA
agagtttgatcatggctcaggataaacgctggcggcgcacataagacatgcaagtcgaacgaacttaacctatagtttactattggagcggttagtggcggactggtgagtaacacgtaagcaacctgcctatcagaggggaacaacagttagaaatgactgctaataccgcatatgccttagcaacacatgttgcaaaagggaaagaagcaattcgctgatagatgggcttgcgtctgattagctagttggtggggcaaaggcctaccaaggcaacgatcagtagccgaactgagaggttgaacggccacattgggactgagatacggcccagactcctacgggaggcagcagtcgggaatattgcgcaatggaggaaactctaacgcagtgacgccgcgtgcaggaagaaggttttcggattgtaaactgctttagacagggaagaaacaagacagtacctgtagaataagctccggctaactacgtg

SEQ ID NO: 1909 - DNA, 490 bp, Unknown
  Ascusbbf_1827750, encodes 16S rRNA
agagtttgatcatggctcaggacgaacgctggcggcgtgcttaacacatgcaagtcgagcgaagccctcgccttcgggtggggtgacttagcggcgaacgggtgagtaacacgtgggcaacctgcccttagctctgggataagcgatggaaacgtcgtctaataccggatatgacactgggacgcatgttcttggtgtggaaagatttatcggctagggatgggcccgcggcctatcagtttgttggtggggtaatggcctaccaaggcggcgacgggtaaccggcctgagagggcgaccggtcacactgggactgagacacggcccagactcctacgggaggcagcagtgggaatattgcacaatgggcgcaagcctgatgcagcgacgccgcgtgagggatgacggccttcgggttgtaaacctctttcagcagggacgaagcgagagtgacggtacctgcagaagaagcgccggccaactacgtgcc

SEQ ID NO: 1910 - DNA, 490 bp, Unknown
  Ascusbbf_12265, encodes 16S rRNA
agagtttgatcatggctcagattgaacgctggcggtatgcttaacacatgcaagtcgaacggtaacaggccttcgggcgctgacgagtggcggacgggtgagtaacgcgtaggaatctgcctcatagtgggggacaacttggggaaactcaagctaataccgcatacgccctacgggggaaagcgggggaccttcgggcctcgcgctatgagatgagcctgcgttagattagctagttggtggggtaaaggcctaccaaggcgacgatctatagctggtctgagaggacgatcagccacactgggactgagacacggcccagactcctacgggaggcagcagtggggaatattggacaatgggcgcaagcctgatccagcaataccgcgtgtgtgaagaaggcctgagggttgtaaagcactttcaattgggaggaaaacctgccggtcaatacccggcagcttgacattacctttagaagaagcaccgg

SEQ ID NO: 1911 - DNA, 490 bp, Unknown
  Ascusbbf_18715, encodes 16S rRNA
agagtttgatcctggctcaggatgaacgctggcggcgtgcttaacacatgcaagtcgaacggagatatgttagtgaagttttcggatggaattgatatatcttagtggcggacgggtgagtaacgcgtaaacaatctgccttagagagggggataacagatagaaatatttgctaataccgcataagaccacgcttcggcatcgaggtggggtaaaaggagcaatccgctttaagatgagtttgcgtactattagctagttggtgaggtaacggcccaccaaggcaacgatggttagccggcctgagagggtgaacggccacattggaactgagatacggtccagactcctacgggaggcagcagtgaggaatattgggcaatgggcgaaagcctgacccagcaacgccgcgtgaaggaagaaggttttcggattgtaaacttctgttatgggggaagaaaaagatgacggtaccccatgagaaagctac

SEQ ID NO: 1912 - DNA, 490 bp, Unknown
  Ascusbbf_1507040, encodes 16S rRNA
agagtttgatcatggctcaggacgaacgctggcggcgtgcctaatacatgcaagtcgggcggggttttgaggggcttgcccttcaagacccagcggcgaacgggtgagtaacacgtgggcaacctgcccgcaagtccgggataacttcgggaaaccggagctaataccggataggaccccggatcgcatgatccggggtggaaaggcggcttcggctgccacttgcggatgggcccgcggcgcattagctagttggtgaggtaacggctcaccaaggtgacgatgcgtagccgacctgagagggtgaccggccacactgggactgagacacggcccagactcctacgggaggcagcagtagggaattttccgcaatgggcgcaagcctgacggagcaacgccgcgtgagcgaggacggccttcgggttgtaaagctctgttcttcgggaagaatggcgggagggcgaacaactctcccgcatgacggtac

SEQ ID NO: 1913 - DNA, 490 bp, Unknown
  Ascusbbf_1426947, encodes 16S rRNA
agagtttgatcctggctcaggatgaacgctggcggcgcatttaagacatgcaagtcgaacgaaagaattcaattgaaacggaatggaagatttatctgaaatgaagtttcgcccgagttctttagtggcggacgggtgagtaatacatagataatctgccttttagagggaaataactactggaaacggtagctaatgtcccataagaccacactaccgcatgatagagaggtcaaaggagaaatccgctaaaagatgagtctatggctgattagttagttggcagggtaagagcctaccaagactgtgatcagtagccgagctgagaggctggccggccacattgggactgagacacggcccagactcctacgggaggcagcagttgggaatattggacaatggaggaaactctgatccagtgacgccgcgtgaaggaagaaggtcttcggattgtaaacttattttatctgggaagaaaaaaatgact

SEQ ID NO: 1914 - DNA, 490 bp, Unknown
  Ascusbbf_91183, encodes 16S rRNA
agagtttgatcatggctcaggatgaacgctagcggcaggcttaacacatgcaagtcgaggggcagcgcgagtagcaatacttggcggcgaccggcgcaagggtgcgtaacgcgtgagcaacatgcccgtatcagggggataatccagggaaacttggtctaataccgcataataaacttaggaggcatctctttgagttttaaaatttcgatggatacggattggctcgcgtgacattagtcagatggtaaggtaacggcttaccataactatgatgtctaggggttctgagaggaaggtcccccacactggaactgagacacggtccagactcctacgggaggcagcagtgaggaatattggacaatggatggaaatctgatccagccatgccgcgtgcaggaagacggtcctatggattgtaaactgcttttttatgggagcaataaggtctacgtgtagatcgatgagagtaccataagaataagca

SEQ ID NO: 1915 - DNA, 490 bp, Unknown
  Ascusbbf_81144, encodes 16S rRNA
agagtttgatcctggctcaggatgaacgctggcggcgtgcttaacacatgcaagtcgaacgattaaaccgccctcgggcggacatagagtggcgaacgggtgagtaacacgtgaccaacctgccccgcactccgggataacctgcggaaacgcaggctaataccggatactccgcgcaggccgcatggcccgcgcgggaaagcccttacggtgcgggatggggtcgcggcccattaggtagacggcggggtgacggcccaccgtgcccgcgatgggtagccgagctgagaggctgaccggccacattgggactgagatacggcccagactcctacgggaggcagcagtggggaattttgcgcaatgggggcaaccctgacgcagcaacgccgcgtgcgggaagaaggccttcgggttgtaaaccgctttcagcggggacgataatgacggtacccgcagaagaagctccggctaactacgtgccagcagc

SEQ ID NO: 1916 - DNA, 490 bp, Unknown
  Ascusbbf_64933, encodes 16S rRNA
agagtttgatcatggctcaggatgaacgctagcggcaggcttaacacatgcaagtcgaggggcagcgggtgtagcaatacatgccggcgaccggcgaaagggtgagtaacgcgtgagcaacatgcccggaggagggggatagtcattggaaacgatgcgtaataccccgtaacataagtcatcgcatggtgatttattgaaagattcattgtctccggattggctcgcgtgccattaggcagttggcggggtaacggcccaccaaaccgacgatggctaggggttctgagaggaaggtcccccacattggaactgagacacggtccagactcctacgggaggcagcagtgaggaatattggacaatggaaggaattctgatccagccatgccgcgtgcgggaggacggccctatgggttgtaaaccgcttttttgagggagcaataagggtcacgcgtggcccgatgagagtaccttgagaataagcatc

SEQ ID NO: 1917 - DNA, 490 bp, Unknown
  Ascusbbf_43296, encodes 16S rRNA
agagtttgatcatggctcaggatgaacgctggcggcgtgcttaacacatgcaagtcgaacggagatatgtttaggaagttttcggatggaatgagcatatcttagtggcggacgggtgagtaacgcgtaaacaatctgccttagagagggggataacagatagaaatatctgctaataccgcataagaccacagctaggcatctagcaggggtaaaaggagcaatccgctttaagatgagtttgcgtactattagctagttggtgaggtaacggcccaccaaggcaacgatggttagccggcctgagagggtgaacggccacattggaactgagatacggtccagactcctacgggaggcagcagtgaggaatattgggcaatgggcgaaagcctgacccagcaacgccgcgtgaaggaagaaggttttcggattgtaaacttctgttataggggaagaacaaatgacggtaccctatgagaaagctacg

SEQ ID NO: 1918 - DNA, 490 bp, Unknown
  Ascusbbf_394044, encodes 16S rRNA
agagtttgatcctggctcaggatgaacgctggcggcatgcctaagacatgcaagtcgaacgaggtggcccacagattgatattgaaaatggagtgcttgcacaaagtcggatttatcttgacgtggattttccacctagtggcaaacgggtgagtaacacatgggttacctgcctctaagttggggataacagttggaaacgattgctaataccgaatgtgatctacggattaaaggtgcctttaaagcatcgcttagagatgggcctgtggcgtattagctagttggtggggtaatggcctaccaaggcaacgatgcgtagccgagctgagaggttaatcggccacactgggactgagacacggcccagactcctacgggagacagcagttaggaatattcgtcaatgggggaaaccctgaacgagcaatgccgcgtgagtgatgacggccctctgggttgtaaaactctgttgtttggaaagaatgat

SEQ ID NO: 1919 - DNA, 490 bp, Unknown
  Ascusbbf_408382, encodes 16S rRNA
agagtttgatcatggctcaggatgaacgctagcggcaggcttaacacatgcaagtcgaggggcatcgcggggtagcaataccctggcggcgaccggcgaaagggtgagtaacgcgtgagcaacgtgcccgcagttgggggatagtcgatggaaacgtcgcgtaataccccgtaacacattttcccgcatggggagatgttgaaagatattattgactgcggatcggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggaggacggccctatgggttgtaaaccgcttttgccggggagcaataagcgccacgcgtggcgcgacgagagtacccggcgaataagc

SEQ ID NO: 1920 - DNA, 490 bp, Unknown
  Ascusbbf_1567356, encodes 16S rRNA
agagtttgatcatggctcaggacgaacgctggcggcgtgcttaacacatgcaagtcgaacgatgaaccttccatgatctattcgtagagattggaagcggattagtggcgaacgggtgagtaacgcgtgagcaacctgccttaaacaacgggatagcctcgggaaaccgggattaataccgtatgagaccccgccttcacatgaagaagaggttaaagatttatcggtttaagatgggctcgcgtctgattagctagttggtgagataaaagcccaccaaggcaaccatcagtaaccggcttgagagagtgaacggtcacattggaactgagacacggtccaaactcctacgggaggcagcagtggggaatattgcacaatgggggaaactctgatgcagcgacgccgcgtgagcgatgaaggaattcgtttcgtaaagctctgtcctaggggaagataatgacagtacccttggaggaagccccggcta

SEQ ID NO: 1921 - DNA, 490 bp, Unknown
  Ascusbbf_1376752, encodes 16S rRNA
agagtttgatcatggctcaggatgaatgctggcggcgtgcctaatacatgcaagtcgagcggtaacagggcttcaccgtgcacttgacacctcgggccacaggcggagggaagaatcgagtgtacagtgaagctgctgacgagcggcggacggctgagtaacgcgtgggaacggaccccaaagtgagggataactactcgaaagagtggctaataccgcatatgatcttcggattaaagcttttagcgctttgggactggcctgcgtacgattagatagttggcggggtaaaggcccaccaagtggacgatcgttagatggtttgagaggatgatcatccagactgggactgagacacggcccagactcctacgggaggcagcagtagggaatctttcacaatgggcgaaagcctgatggagcaacgccgcgtgcaggatgaaggccttcgggttgtaaactgcttttaaaactgaggaatatgacggta

SEQ ID NO: 1922 - DNA, 469 bp, Unknown
  Ascusbbf_114956, encodes 16S rRNA
agagtttgatcatggctcaggatgaacgctggcggcgtgcctaacctatgcaagtcgaacgaggcttcgagccgagtggcggacgagtgagtaacacgtatcttatctgcctgtaagtggggaataactcgtcgaaaggcgaactaataccccatgtgctctacggagtaaagcttttgcgcttacagatgaggatgcggcctatcagctagttggtgaggtaaaagcttaccaaggctatgacgggtagctggtctgagaggatgatcagccacgctgggactgagaacggcccagactcctacgggaggcagcaagtgggaatattgcacaatggacgaaagtctgatgcagcgacgccgcgtgggggatgaaggttttcggatcgtaaaccccttttatcgattagaaagatatgatcagtcgatgaataagcacctgctaactacgtgccagcagccgcggtaat

SEQ ID NO: 1923 - DNA, 490 bp, Unknown
  Ascusbbf_6371, encodes 16S rRNA
agagtttgatcatggctcaggacgaacgctggcggcgtgcctaacacatgcaagtcgaacgagcgcacgggagcttgctcctgtgctgcgagtggcggacgggtgagtaacgcgtgaggaacctgcccttcagagggggataacgtcgggaaactgacgctaataccgcataacgtgtctgatccgcatggatcggataccaaaggagcaatccgctgaaggatggcctcgcgtctgattagatagttggtgaggtaacggctcaccaagtcgacgatcagtagccggactgagaggttgatcggccacattgggactgagacacggcccagactcctacgggaggcagcagtgagggatattgcacaatggggggaaccctgatgcagcaacgccgcgtgaaggaagacggttttcggattgtaaacttctgttttgggtgacgataatgacggtagcccgatagaaagccacggctaactacgtgcca

SEQ ID NO: 1924 - DNA, 490 bp, Unknown
  Ascusbbf_1445584, encodes 16S rRNA
agagtttgatcctggctcaggacgaacgctggcggcatgcttaacacatgcaagtcgaacggactgattccttcgggatgaaagttagtggcgaacgggtgagtaatgtatgagcaacctgcctctatcaacgggataacagttggaaacgactgctaatacggtataagaccacggcaccgcatgatgctgcggtaaaagatttttcggatagagatgggctcatatcccattatctagttggtgagataacagcccaccaaggcgacgatgggtagccgagctgagaggctgatcggccacgttgggaccgaaaaacggcccagacacctacgggaagcagcagaggggaatattgggcaatggaggcaactctgacccggcaatgccgcgtgagtgatgaaggtaattttattgtaaagctcttatctcaggaacgaataaagatgacggtacctgaggaataagccccggctaactacgtgccagc

SEQ ID NO: 1925 - DNA, 490 bp, Unknown
  Ascusbbf_3847, encodes 16S rRNA
agagtttgatcatggctcaggatgaacgctggcggcgtgcctaatacatgcaagtcgaacgaggtggatgggagcttgctccttgatgcctagtggcgaacgggtgagtaacacgtaggtaacctgcctttaagcttgggatacccagaggaaactttggctaataccggataacaacagaagcggcatcgcttttgcttgaaaggccctttcaagggtcacttaaagatggacctgcggcgcattagctagttggtgagataacagcccaccaaggcgaggatgcgtagccgacctgagagggtgatcggccacaatgaaactgagacacggttcatactcctacgggaggcagcagtaaggagttttcggcaatgggggaaaccctgaccgagcaacgccgcgtgaatgatgacggccctatgggttgtaaaattcttttatttgggacgaatgattagtttaggaaatgaaactaatttgacagtac

SEQ ID NO: 1926 - DNA, 490 bp, Unknown
  Ascusbbf_12537, encodes 16S rRNA
agagtttgatcatggctcaggacgaacgctggcggcgtgcttaacacatgcaagtcgaacggagcttaaggaagagcttgctctgagataagcttagtggcggacgggtgagtaacgcgtgaggaacctggtttacacagggggataacggcccgaaagggttgctaataccgcataagaccacaacaccgcatgatgaaggggtcaaaggagaaatccggtgtaaaatggactcgcgtcccattaggcagttggtgaggtaacggcccaccaaaccgacgatgggtagccgacctgagagggtgatcggccacattggaactgagagacggtccaaactcctacgggaggcagcagtggggaatattgggcaatgggcgcaagcctgacccagcaacgccgcgtgagggaagaaggttttcggattgtaaacctctgtccttgatgaaaagcaggagatggtaattaaggaggaagccccggctaacta

SEQ ID NO: 1927 - DNA, 490 bp, Unknown
  Ascusbbf_250175, encodes 16S rRNA
agagtttgatcatggctcaggatgaacgctggcggcgtgcctaacacattcaagtcgaacggagcaatacggaagcttgcttttgtatagcttagtggcggacgggtgagtaatgcatgagcaacctgccttgaagagggggataacacagagaaatttgtgctaataccgcgtaatctgccgaagcggcatcgcattggcaggaaaggagcaatccgctttaagatgggctcatgtctgattagatagttggtagggtaacggcctaccaagtctgcgatcagtagccggactgagaggttgaccggccacattggaactgagatacggtccagactcctacgggaggcagcagtggggaatattgggcaatgggcgcaagcctgacccagcaacgccgcgtgaaggaagaaggtcttcggattgtaaacttttttgacaggggacgaagcatgacggtaccctgaaaacaagccacgactaactacgt

SEQ ID NO: 1928 - DNA, 490 bp, Unknown
  Ascusbbf_11017, encodes 16S rRNA
agagtttgatcctggctcaggacgaacgctggcggcgtgcctaatacatgcaagtcgaacggacgatggggcttcggccccaaagttagtggcgaacgggtgagtaacgcgtgagcaacctgactcaaagagggggacaacagctggaaacggctgctaataccgcataagaccacagcgcggcatcgcaaaggggtcaaagaattatcgctttgagaggggctcgcgtcccattagatagttggtgaggtaacggcccaccaagtccgcgatgggtagccgagctgagaggctgatcggccacactggaactgagacacggtccagactcctacgggaggcagcagtagggaatattgggcaatgggcgcaagcctgacccagcaacgccgcgtgagggaagaaggttttcggattgtaaacctctgtcctatgtgacgaaggaagtgacggtagcataggaggaagccccggctaactacgtgccagc

SEQ ID NO: 1929 - DNA, 490 bp, Unknown
  Ascusbbf_148521, encodes 16S rRNA
agagtttgatcctggctcaggacgaacgctggcggcgtgcctaatacatgcaagtcgagcggacttgacggagcttgctctgttcaagttagcggcggacgggtgagtaacacgtgggtaacctgcctgtaagactgggataactccgggaaaccggggctaataccggatattctttttcttcgcatgaagaagaatggaaaggcggcttttagctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgtcagggaagaacaagtaccaaagtaactgttggtaccttgacggtacc

SEQ ID NO: 1930 - DNA, 490 bp, Unknown
  Ascusbbf_1886605, encodes 16S rRNA
agagtttgatcatggctcaggattaacgcttgcggcatgcctaagacatgcaagtcgaacgagagggcccattgataaggattgaaaatggagtgcttgcacaaagttggatttcctttgatttggattttccctctagtggcaaacgggtgagtaacacgtgggttacctgccctcaagttggggatatcatctggaaacggatagtaataccgaatgtgatctacggattaaaggagcctttaaagcttcgcttgaggatgggcctgcggtgcattagctagttggcgggataatagcccaccaaggcaacgatgcatagccgaactgagaggttgatcggccacactgggactgagacacggcccagactcctacgggagacagcagttaggaatattcgtcaatgggggaaaccctgaacgagcaatgccgcgtgaacgatgaaggccctccgggttgtaaagttctgttgtttggaaagaatatc

SEQ ID NO: 1931 - DNA, 490 bp, Unknown
  Ascusbbf_117007, encodes 16S rRNA
agagtttgatcctggctcaggatgaacgctggcggcgtgcttaacacatgcaagtcgagcgcggtccctttggtgcttgcaccaaagaagactgagcggcggacgggtgagtaacgcgtgggtaacctgccctatacacatggataacatgctgaaaagcatactaatacatgataacgtacactgatggcatcttcggtgtatcaaagcgttagcggtataggatggacccgcgtctgattagctagttggtggggtaaaagcctaccaaggccacgatcagtagccgacctgagagggtgatcggccacattggaactgagacacggtccaaactcctacgggaggcagcagtggggaatattgcacaatgggcgaaagcctgatgcagcaacgccgcgtgaacgatgaaggtcttcggatcgtaaagttctgtcgcaggggaagataatgacggtaccctgtgaggaagcaccggctaactacgtgc

SEQ ID NO: 1932 - DNA, 490 bp, Unknown
  Ascusbbf_168596, encodes 16S rRNA
agagtttgatcatggctcaggatgaacgctggcggcgtgcctaacacatgcaagtcgaacggagatgttccgccgatgaagcttcggccgaatcatggaacaacttagtggcggacgggtgagtaacgcgtgggcaacctgccctgcactgggggatagcagctggaaacggctggtaataccgcataagcgcacggtactgcatggtacagtgtgaaaaattccggtggtgcaggatgggcccgcgtccgattagccagttggcggggtaacggcccaccaaagcgacgatcggtagccggcctgagagggcggacggccacattgggactgagacacggcccagactcctacgggaggcagcagtgggggatattgcacaatgggggaaaccctgatgcagcgacgccgcgtgggtgaagaagtatttcggtatgtaaagccctatcagcagggacgataatgacggtacctgagtaagaagccccgg

SEQ ID NO: 1933 - DNA, 490 bp, Unknown
  Ascusbbf_146394, encodes 16S rRNA
agagtttgatcctggctcaggataaacgctggcggcgtgcataacacattcaagtcgaacgaagcgccgattgccgagacttcggtcaaagcaagaggatgacttagtggcggacgggtgagtaacgcgtgagcaacctgcctgttagtggggaataacgtttggaaacgaacgctaataccgcataatatatacatggcgcatgctaagtatatcaaagatatattgctgacagatgggctcgcgtccgattaggcagttggtgaggtaacggctcaccaaaccgacgatcggtagccggactgagaggttgaacggccacattggaactgagaaacggtccagactcctacgggaggcagcagtggggaatattgggcaatgggcgaaagcctgacccagcgacgccgcgtgagggaagacggtcttcggattgtaaacctctttcagcagggaagacaaaaggacggtacctgcagaagaagccacg

SEQ ID NO: 1934 - DNA, 490 bp, Unknown
  Ascusbbf_268394, encodes 16S rRNA
agagtttgatcctggctcaggataaacgctggcggcgcacataagacatgcaagtcgaacggaagtcgttataatcgaagctgaaatgaacagagaacttgttcgaaggaatttgacgtagactttataacaatggctttagtggcggactggtgagtaacgcgtgagcaacctgcctattagaggggaataacagtgagaaatcattgctaataccgcatatgccataggtaccacatggtactagtgggaaaggagtaatccgctaatagatgggctcgcgtctgattagatagttggtggggtaacggcctaccaagtcgacgatcagtagccggactgagaggttgaacggccacattgggactgagatacggcccagactcctacgggaggcagcagtcgggaatattgcgcaatggaggaaactctgacgcagtgacgccgcgtataggatgaaggtcttcggattgtaaactattgtcgttag

SEQ ID NO: 1935 - DNA, 490 bp, Unknown
  Ascusbbf_137775, encodes 16S rRNA
agagtttgatcatggctcaggatgaacgctagctacaggcttaacacatgcaagtcgaggggcagcatgatctgtgcttgcacagtttgatggcgaccggcgcacgggtgagtaacgcgtatccaaccttccccgcagcagggaatagcccggcgaaagtcggattaatgccctatgttttcctttgagagcatttgatttggaacaaagatttttcgctacgggatggggatgcgtccgattagcttgacggcggggtaacggcccaccgtggcttcgatcggtaggggttctgagaggaaggtcccccacattggaactgagacacggtccaaactcctacgggaggcagcagtgaggaatattggtcaatggtctgacgactgaaccagccaagtagcgtgcgggatgactgccctatgggttgtaaaccgcttttgcaggggaataaagtcaggaacgtgttcctgtttgcatgtaccctgagaat

SEQ ID NO: 1936 - DNA, 490 bp, Unknown
  Ascusbbf_6081, encodes 16S rRNA
agagtttgatcatggctcaggatgaacgctagcggcaggcttaacacatgcaagtcgaggggcagcgtggagtagcaatactctgacggcgaccggcgaaagggtgagtaacgcgtgagcaacatgcccgggactgggggatagtcgatggaaacgtcgcgtaataccccgtaacaacagagaccgcatgatctttgtttaagagatttatcgattccggattggctcgcgtcccattaggcagttggcggggtaacggcccaccaaaccgacgatgggtaggggttctgagaggaaggtcccccacattggaactgagacacggtccagactcctacgggaggcagcagtgaggaatattggacaatggccgagaggctgatccagccatgccgcgtgcgggaggacggccctatgggttgtaaaccgcttttgtcagggagcaataaggtctacgtgtagactgatgagagtacctggcgaataagca

SEQ ID NO: 1937 - DNA, 487 bp, Unknown
  Ascusbbf_52316, encodes 16S rRNA
agagtttgatcctggctcagaacgaacgctggcggcaggcttaacacatgcaagttgaacgggatttggatgtagcttgctacattcaatgagagtagcgcactggtgagtaacacgtgggaacgtacattgtagtgggggacaacagttggaaacgactgctaataccgcataatccctgagggggaaagatttatcgctataatatcggcccgcggcagattaggtagttggtggggtaaaggcctaccaagcctacgatctatagctggtctgagaggacgatcagccacattggaactgagacacggtccagactcctacgggaggcagcagtgaggaatattgggcaatggagggaactctgacccagccatgccgcgtgagtgagaaggttttcgaattgtaaagctctttcgggtgtgaagatgatgacggtagcaccagaagaagccccggcaaacttcgtgccagcagccgcggtaat

SEQ ID NO: 1938 - DNA, 490 bp, Unknown
  Ascusbbf_7397, encodes 16S rRNA
agagtttgatcctggctcaggacgaacgctggcggcgtgcctaacacatgcaagtcgaacgaagttttaaggagcttgctctttaaaacttagtggcggacgggtgagtaacgcgtgagcaacctgcctctcagagggggataacgttttgaaaagaacgctaataccgcataatatatcggaatcgcatgattctgatatcaaaggagcaatccgctgagagatgggctcgcgtccgattagttagttggtgaggtaacggctcaccaagactacgatcggtagccggactgagaggttgatcggccacattgggactgagacacggcccagactcctacgggaggcagcagtgggggatattgcgcaatgggggaaaccctgacgcagcaacgccgcgtgaaggaagaaggtcttcggattgtaaacttcttttgtcagggacgaagaaagtgacggtacctgacgaataagctccggctaactacgt

SEQ ID NO: 1939 - DNA, 490 bp, Unknown
  Ascusbbf_7131, encodes 16S rRNA
agagtttgatcatggctcaggatgaacgctggcggcgtgcttaacacatgcaagtcgaacgaagcactggcgtctgatctttcgggtgaagaggcctttgactgagtggcggacgggtgagtaacgcgtggggaacctgccccataccgggggacaacagccggaaacggctgctaataccgcataagcgcacggaagcgcatgcttttgtgtgaaaaactccggtggtatgggatggccccgcgtctgattaggcagttggcggggcaacggcccaccaaaccgacgatcagtagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgcacaagaagccccggct

SEQ ID NO: 1940 - DNA, 490 bp, Unknown
  Ascusbbf_5523, encodes 16S rRNA
agagtttgatcatggctcaggatgaacgctggcggcgtgcctaacacatgcaagtcgagcgagaagctcttttcggaagcttcggtagaagaagagagtggaaagcggcggacgggtgagtaacgcgtaggcaacctgccccttgcagagggatagcctcgggaaaccgggattaaaacctcataacgcatcgaggagacatcttcacgatgccaaagatttatcggcaagggatgggcctgcgtctgattagttagttggtggggtaacggcctaccaaggcagcgatcagtagccgacctgagagggtgatcggccacattggaactgagacacggtccaaactcctacgggaggcagcagtggggaatattgcacaatgggggaaaccctgatgcagcaacgccgcgtgaaggatgaaggcccttgggtcgtaaacttctgttctaagggaagataatgacggtaccttaggagcaagtcccggcta

SEQ ID NO: 1941 - DNA, 490 bp, Unknown
  Ascusbbf_81880, encodes 16S rRNA
agagtttgatcctggctcagattgaacgctggcggcaggcctaacacatgcaagtcgagcggtagcacagagaagcttgcttcttgggtgacgagcggcggacgggtgagtaacgcgtgggaatctacctggtagtgggggacaacagtcggaaacgactgctaataccgcatacgcccttcgggggaaagtgggggatcttcggacctcacgctatcagatgagcccgcgtcggattagcttgttggtgaggtaaaggctcaccaaggcgatgatccgtagctggtctgagaggatgaccagccacactgggactgagacacggcccagactcctacgggaggcagcagtggggaatattggacaatgggggcaaccctgatccagccatgccgcgtgtgtgaagaaggccttcgggttgtaaagcactttcagctgtgaggaaaggcgagtggttaatacccgcttgctgtgacgttaacagcagaag

SEQ ID NO: 1942 - DNA, 490 bp, Unknown
  Ascusbbf_125906, encodes 16S rRNA
agagtttgatcatggctcaggacgaacgctggcggcatgcttaacacatgcaagtcgaacggaacatcaacaattcagcgatgatgcggagatgtttagtggcgaacgggtgagtaacgcgtgagcaacctgccttgtacactgggataccagagggaaacttctgttaatacgggataagaccacagaaccgcatggttcaggggtcaaagcgatttagcggtacaagatgggctcgcgtcccattagctagttggcgggataacagcccaccaaggcgacgatgggtagccgacttgagagagtgatcggccacaatggaactgagacacggtccatactcctacgggaggcagcagtggggaatattgggcaatgggcgcaagccttacccagcaatgccgcgtgaatgatgaaggtcttcggattgtaaagttcttttattggtgacgaacgcaatgacggtagccaatgaataagccccggctaa

SEQ ID NO: 1943 - DNA, 490 bp, Unknown
  Ascusbbf_50117, encodes 16S rRNA
agagtttgatcctggctcaggacgaacgctggcggcatgcctaacacatgcaagtcgaacgaagcttgagagcttgcttttaagcttagtggcggacgggtgagtaacgcgtgagcaacctgcctttcagtggggaataatactttgaaaagagtactaataccgcataacgtataatggtcgcatgactgatataccaaagatttatcgctgagagatgggctcgcgtccgattagccagttggtggggtaacggcctaccaaagcgacgatcggtagccggactgagaggttgaacggccacattgggactgagacacggcccagactcctacgggaggcagcagtgggggatattgcgcaatgggggaaaccctgacgcagcaatgccgcgtggaggattgaaggtcttcggattgtaaactccttttgtcagggacgaaaatgacggtacctgacgaataagctccggctaactacgtgccagcag

SEQ ID NO: 1944 - DNA, 490 bp, Unknown
  Ascusbbf_25838, encodes 16S rRNA
agagtttgatcatggctcaggatgaacgctggcggcgtgcttaacacatgcaagtcgaacggacttgttccgctgtaagacgacgtgcttgcattgaatcttacttggaacaagttagtggcggacgggtgagtaacgcgtggggaacctgcctgtatctgggggataacagttagaaatgactgctaataccgcataagcgcacactgtcgcatgacagagtgtgaaaaactgaggtggatacagatggacccgcgttggattagccagttggtggggtaacggcctaccaaagcgacgatccatagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaa

SEQ ID NO: 1945 - DNA, 490 bp, Unknown
  Ascusbbf_101012, encodes 16S rRNA
agagtttgatcatggctcaggatgaacgctagctacaggcttaacacatgcaagtcgaggggcatcgggagagtagcttgctactcttgccggcgaccggcgcacgggtgcgtaacgcgtatccaacctgccgtgtacttggggatagccctctgaaaggaggattaatacccgatgtggtcatttgaagacatcttcttatgattaaagatttatcggtacaccgatggggatgcgtacgattaggtagatggcggggtaacggcccaccatgccatcgatcgttaggggttctgagaggaaggtcccccacataggaactgagacacggtcctaactcctacgggaggcagcagtgaggaatattggtcaatgggcgagagcctgaaccagccaagtagcgtgaaggatgactgccctatgggttgtaaacttcttttatgggagaataaagtgcgccacgtgtggcgttttgtaggtatcccatgaa

SEQ ID NO: 1946 - DNA, 490 bp, Unknown
  Ascusbbf_5986, encodes 16S rRNA
agagtttgatcctggctcaggacgaacgctggcggcatgcttaacacatgcaagtcgaacgggcatatttggttatagcgatataatcggatatgtttagtggcgaacgggtgagtaacgcgtgagcaacctgccttgtacaccgggataacagaccgaaagggctgctaataccggataagaccacgatgaggcatctcaacggggtcaaagtgatttagcggtacaagatgggctcgcgtcctattaggtagttggtgagataacagcccaccaagccgatgataggtagccgacttgagagagtgatcggccacaatggaactgagacacggtccatactcctacgggaggcagcagtggggaatattgggcaatgggcgaaagccttacccagcaatgccgcgtgaatgatgaaggtcttcggattgtaaaattcttttattggtgacgaacacaatgacggtagccgatgaataagccccggcta

SEQ ID NO: 1947 - DNA, 490 bp, Unknown
  Ascusbbf_4805, encodes 16S rRNA
agagtttgatcatggctcaggacgaacgctggcggcgtgcctaacacatgcaagtcgagcgagaaactcataaacgagccttcgggcaagtgagtgagcggaaagcggcggacgggtgagtaacgcgtgagtaatctgccttaaggtgggggataacacagagaaatttgtgctaataccgcataacacataattatcgcatgatagatatgtcaaaactccggtgccttaagatgagctcgcgtccgattagttagttggcggggtaatggcccaccaagacaacgatcggtagccggactgagaggttgaacggccacattgggactgagacacggcccagactcctacgggaggcagcagtgggggatattgcgcaatgggggaaaccctgacgcagcaacgccgcgtgaaggaagaaggtcttcggattgtaaacttttgtcttttgggacgaagaagtgacggtaccaaaggaggaagccacggc

SEQ ID NO: 1948 - DNA, 490 bp, Unknown
  Ascusbbf_256313, encodes 16S rRNA
agagtttgatcctggctcaggacgaacgctggcggcatgcttaacacatgcaagtcgaacgggcgcatttgggtatagcgatatacttggatgcgtttagtggcgaacgggtgagtaacgcgtgagcaacctgccgtatacactgggataacagaccgaaaggactgctaataccggataagaccacagtagggcatcctacaggggtcaaagtgatttagcggtatacgatgggctcgcgtcctattaggtagttggtgagataacagcccaccaagccgatgataggtagccgacttgagagagtgatcggccacaatggaactgagacacggtccatactcctacgggaggcagcagtggggaatattgggcaatgggcgaaagccttacccagcaatgccgcgtgaatgatgaaggtcttcggattgtaaatttcttttattggtgacgaacaaaatgacggtagccgatgaataagccccggcta

SEQ ID NO: 1949 - DNA, 490 bp, Unknown
  Ascusbbf_217247, encodes 16S rRNA
agagtttgatcatggctcaggacgaacgctggcggcgtgcctaacacatgcaagtcgagcggagatatgaggaacaagggcttcggcccaagggaaacatattttagcggcggacgggtgagtaacgcgtgaacaatctgtccctgacagggggataacacttggaaacaggtgctaataccgcataagaccacgaggcggcatcgccttgaggtaaaaggagaaatccggtgaggggtgagttcgcgtccgattagccagttggtgaggtaacggcccaccaaagcgacgatcggtagccgacctgagagggtgatcggccacattggaactgagagacggtccaaactcctacgggaggcagcagtgggaatattgggcaatgggcgaaagcctgacccagcaacgccgcgtgagggaagaaggttttcggattgtaaacctctgtccttggtgacgaaggaagtgacggtagccaaggaggaagccc

SEQ ID NO: 1950 - DNA, 490 bp, Unknown
  Ascusbbf_7317, encodes 16S rRNA
agagtttgatcatggctcaggatgaacgctggcggcgtgcctaacacatgcaagtcgagcggagatatatgtctaggagacttcggtcaaattaattatatcttagcggcggatgggtgaggaacgcgtggagaacctgcccttcacagggggataacagctggaaacggctgttaataccgcatatgctcacagcaccgcatggtgcagggaggaaagcctttacggtgaaggatggctccgcgtcggattagccagttggcggggtaacggcccaccaaagcgatgatccgtagccggcctgagagggcgaccggccacattgggactgagacacggcccaaactcctacgggaggcagcagtgggggatattgcacaatggggggaaccctgatgcagcgacgccgcgtgaaggaagacgtgcttcggcatgtaaacttctatcagcagggaagaagatgacggtacctgactaagaagccccggct

SEQ ID NO: 1951 - DNA, 490 bp, Unknown
  Ascusbbf_75691, encodes 16S rRNA
agagtttgatcatggctcaggatgaacgctggcggcgtgcctaacacatgcaagtcgaacgagggtgcttgcaccctagtggcgaacgggtgagtaacacgtaggtaacctgcctttaagcttgggatacccagaggaaactttggctaataccggataacaatggaagaggcatctcttctatttaaaaggccctttcaagggtcacttagagatggacctgcggcgcattagctagttggtgagataacagcccaccaaggcaaggatgcgtagccgacctgagagggtgatcggccacattggaactgagacacggtccaaactcctacgggaggcagcagtgaggagttttcggcaatgggggaaaccctgaccgagcaacgccgcgtgaatgatgacggccctatgggttgtaaagttcttttattagggacgaatgactagcttaggaaatgcagctagtttgacggtaccttttgaataagcc

SEQ ID NO: 1952 - DNA, 490 bp, Unknown
  Ascusbbf_19751, encodes 16S rRNA
agagtttgatcatggctcaggacgaacgctggcggcgtgcttaacacatgcaagtcgaacgaagatacgggagagcttgctcgaaggtatctgagtggcggacgggtgagtaacgcgtgaacaatctgtctcatacagggggataacgcgtcgaaagacgtgctaataccgcgtaggaccacggagtcgcatggctctggggtgaaaggagcaatccggtatgaggtgagttcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgaaagcctgacccagcaacgccgcgtgagggaagaaagttttcggattgtaaacctctgtcctacatgaagagttagagacggtagtgtaggaggaagccccggctaactacg

SEQ ID NO: 1953 - DNA, 490 bp, Unknown
  Ascusbbf_50932, encodes 16S rRNA
agagtttgatcctggctcaggataaacgctggcggcgcacataagacatgcaagtcgaacgaacttaacctttagtttactttaggagcggttagtggcggactggtgagtaacgcgtaagcaatctgcctataagagggggataacagtgagaaatcactgctaataccgcataagctgtgaatatcgcatgatataagcagaaaaggagcaatccacttatagatgagcttgcgtctgattagctagttggtgaggtaacggcccaccaaggcgatgatcagtagccggactgagaggttgaacggccacattgggactgagatacggcccagactcctacgggaggcagcagtcgggaatattgcgcaatggaggaaactctgacgcagtgacgccgcgtgcaggaagaaggttttcggattgtaaactgctttagatagggaagaaacaaatgacggtacctatagaataagctccggctaactac

SEQ ID NO: 1954 - DNA, 490 bp, Unknown
  Ascusbbf_1542621, encodes 16S rRNA
agagtttgatcctggctcaggacgaacgctggcggcgtgcctaatacatgcaagtcgtacgaattgattaaggagcttgctccttatgacgttagtggcgaacgggtgagtaacacgtgggtaacctaccttcaagagggggataacatccggaaacgggtgctaataccgcatagtttcagcttccacatggaagccgaaggaaagacggcctttgtgctgtcacttggagatggacccgcggcgcattagttagttggtagggtaacggcctaccaagacgatgatgcgtagccgacgtgagagggtgatcggccacattgggactgagacacggcccaaactcctacgggaggcagcagtagggaatcttccgcaatggacgaaagtctgacggagcaacgccgcgtgagtgaagaaggttttcggatcgtaaaactctgttgttggagaagaacaagtaggagagtaactgctcttaccttgacgg

SEQ ID NO: 1955 - DNA, 490 bp, Unknown
  Ascusbbf_100121, encodes 16S rRNA
agagtttgatcctggctcagaatgaacgctggcggcatggattaggcatgcaagtcgaacgggtcccttcggggactagtggcgcaagggtgagtaacacgtgagcaacctgcccccgaatccggaataatccagggaaacttggtctaaaaccggatgtcggcgtttacccgcatgggtttccgccgaaatattcatagttcggggatgggctcgcgtcccattagctggttggcggggtaacggcccaccaaggctacgacgggtaggtggtctgagaggatggtcacccacactgggactgagacactgcccagactcctacgggaggctgcagtcgagaatcttccgcaatgggcgcaagcctgacggagcgatgccgcgtgagggaagaaggccttcgggttgtaaacctctgtcacccgggacgaaatcaatgacggtaccgggaaaggaagccacggctaaccacgtgccagcagccgcggta

SEQ ID NO: 1956 - DNA, 490 bp, Unknown
  Ascusbbf_173640, encodes 16S rRNA
agagtttgatcatggctcagaacgaacgccggcggcgcgtcttaagcatgcaagtcgagcgggattgaggggcttgcccctcatgagagcggcggactggtgagtaacgcgtgggcgacgtaccccctgcaccgggacagccggcagaaatgccgggtgatacgggatgaggtcgcagcctgtggtgggctgcgaggaaagcggctacggccgcggcaggggaacggcccgcgtcccatcagctagtcggcggggtaaaggcccaccgaggcaacgacgggtacccggactgagaggttggacgggcacattgggactgagatacggcccagactcctacgggaggcagcagctaagaatattccgcaatgggcgaaagcctgacggagcgacgccgcgtggacgatggaggccggaaggttgtaaagtcctctggcgggggaagaagaagtccgggagggaatgcccggacggtgaccgtaccccgaga

SEQ ID NO: 1957 - DNA, 490 bp, Unknown
  Ascusbbf_351383, encodes 16S rRNA
agagtttgatcatggctcaggacgaacgctggcggcgtgcttcatacatgcaagtcgaacgataaggtctcttcggagacacataagtggcggacgggtgagtaatgtgtagagaatctgccttagagtgggggacaacagttggaaacgactgctaataccgcatatgcgcgtacctgtgatggtattcgtgaaaactccggtgctctaagatgagtctgcatctgattagctagctgggggtgtaatggaccaccaaggcgacgatcagtagctggtttgagaggataatcagccacaatgggactgagacacggcccatactcctacgggaggcagcagtagggaattttgcgcaatgggggaaaccctgacgcagcaacgccgcgtgattgaataagctcttcggggtgtaaagatctgtcagtagggacgaaacttgacggtacctacagaggaagcatcggctaactccgtgccagcagccgcg

SEQ ID NO: 1958 - DNA, 490 bp, Unknown
  Ascusbbf_10073, encodes 16S rRNA
agagtttgatcatggctcaggacgaacgctggcggcatgcctaacacatgcaagtcgaacggagttaaatcgagcttgcttgatttaacttagtggcggacgggtgagtaacgcgtgagcaacctgcctttcagtggggaataatgttctgaaaagagcactaataccgcataatgtataagtatcgcatggtacatataccaaagatttatcgctgagagatgggctcgcgtccgattagccggttggtggggtaacggcctaccaaagctacgatcggtagccggactgagaggttgaacggccacattgggactgagacacggcccagactcctacgggaggcagcagtgggggatattgcgcaatggggggaaccctgacgcagcaatgccgcgtgaaggaagaaggtcttcggattgtaaacttcttttgtcagggacgaacaatgacggtacctgacgaataagctccggctaactacgtgcca

SEQ ID NO: 1959 - DNA, 490 bp, Unknown
  Ascusbbf_65859, encodes 16S rRNA
agagtttgatcctggctcaggatgaacgctagctacaggcttaacacatgcaagtcgaggggcagcatgtatctggcttgccagatatgatggcgaccggcgcacgggtgcgtaacgcgtgttcgacctaccctttactcgggaacagcccatcgaaagatggattaatgcccgatgttctccctatatcgcatggtattcggagcaaagatttatcggtagaggatgggaacgcgtccgattagctggacggcggggtaacggcccaccgtggcgacgatcggtaggggttctgagaggaaggtcccccacactggaactgagacacggtccagactcctacgggaggcagcagtgaggaatattggtcaatggccgagaggctgaaccagccaagtagcgtgaaggatgactgccctatgggttgtaaacttcttttgtacgggaataacctggcccacgtgtgggctactgcatgtaccgtacgaat

SEQ ID NO: 1960 - DNA, 490 bp, Unknown
  Ascusbbf_9679, encodes 16S rRNA
agagtttgatcatggctcaggatgaacgctggcggtatgcctaacacatgcaagtcgaacggatgaaatgaaagcttgcttttattttgttagtggcggacgggtgagtaacgcgtgagtaatctgccttgaaatgggggataacacttggaaacaggtgctaataccgcgtagtatattagtttcgcatgaagcttttattatagtttttcgtttcaagatgagctcgcgtccgattagtttgttggcgaggtaaatgctcaccaagactgcgatcggtagccgggttgagagactgaacggccacattggaactgagacacggtccagactcctacgggaggcagcagtggggaatattgcacaatgggggaaaccttgatgcagcaataccgcgtgagggatgaaggctttcgggttgtaaacctctgtctgaagggatgaatttcgacggtaccttcgaaggaagctccggctaactacgtgccag

SEQ ID NO: 1961 - DNA, 490 bp, Unknown
  Ascusbbf_24043, encodes 16S rRNA
agagtttgatcatggctcaggatgaacgctagcggcaggcctaatacatgcaagtcgaacggtaaacgccccttcgggggtgtgagagtggcgcacgggtgcgtaacgcgtatgcaacccacccgctgtcgggggatagcccgtagaaatgcgaattaataccccatgaggaggagatgaggcatctcatttttttcaaaacttcggtgacggcggacgggcatgcgtgccattagatggttggcggggtaacggcccaccaagtcgacgatggctaggggatctgagaggacggtcccccacactggtactgagacacggaccagactcctacgggaggcagcagtaagggatattggtcaatggggggaaccctgaaccagccatgccgcgtgagggaataaggccctacgggtcgtaaacctcttttgccgggggataaggatagtcacgtgtgactgtttgaaggtacccggagaataagcatcgg

SEQ ID NO: 1962 - DNA, 490 bp, Unknown
  Ascusbbf_97019, encodes 16S rRNA
agagtttgatcctggctcagaacgaacgctggtggcgtgtcttatacatgcaagtcgagcggtgcagcaatgcatagcggcgaacgggtgagtaacgcgtaagcaatctgccccacactcgggaatagccgtgccaacgcgcgggtaataccggatatcgtggctccccacctggggggttgacaaaagatttatcggtgtgggatgagcttgcgtccgattagctagttggcggggcaacggcccaccaaggcgacgatcggtagccggcctgagagggtgatcggccacattgggactgagatacggcccagactcctacgggaggcagcagtagggaatattgcacaatgggggaaaccctgatgcagcaacgccacgtgtgggaagaagcatttcggtgtgtaaaccactgtcgtgagggaataaggcttgtccacgggcaagttgaatgtacctcgagaggaagcaccggcaaacttcgtgccag

SEQ ID NO: 1963 - DNA, 490 bp, Unknown
  Ascusbbf_68350, encodes 16S rRNA
agagtttgatcatggctcaggatgaacgctagcggcaggcttaacacatgcaagtcgaggggcagcgagggtagcaatacctgtcggcgaccggcggaagggtgcgtaacgcgtgagcaacttgcccgtatcagggggatagtcgatggaaacgtcgcgtaataccccataacaactgtggtcgcatggtcacagtttgaaagattcgtcggatacggataggctcgcgagacattagctagttggcggggtaacggcccaccaaggcgacgatgtctaggggttctgagaggaaggtcccccacattggaactgagacacggtccaaactcctacgggaggcagcagtgaggaatattggtcaatggccggaaggctgaaccagccatgccgcgtgcaggaagacggccctatgggttgtaaactgcttttgtggtggagcaataaggcgtacgagtacgccgatgagagtacatcacgaataagcatc

SEQ ID NO: 1964 - DNA, 490 bp, Unknown
  Ascusbbf_46334, encodes 16S rRNA
agagtttgatcctggctcaggatgaacgctagcggcaggcctaacacatgcaagtcgaggggtatagtaagcttgcttactagagaccggcgcacgggtgcgtaacgcgtatgcaatctaccttttactaaggaatagcccggagaaatccggattaatgccttatagtatattgagatggcctcattttaatattaaagatttatcggtaaaagatgagcatgcgtcccattagttagttggtgtggtaacggcataccaagacgatgatgggtaggggtcctgagagggagatcccccacactggtactgagacacggaccagactcctacgggaggcagcagtgaggaatattggtcaatggaggcaactctgaaccagccatgccgcgtgcaggacgacggtcctatggattgtaaactgcttttgtacgggaagaaaaagagttacgtgtaatttattgacggtaccgtaagaataaggatcggc

SEQ ID NO: 1965 - DNA, 490 bp, Unknown
  Ascusbbf_58102, encodes 16S rRNA
agagtttgatcatggctcaggacgaacgctggcggcgtgcctaacacatgcaagtcgaacgagaaattgatattggacttttcggaggaagatattaatggacagtggcggacgggcgagtaacgcgtgagtaacctgcccataagaaagggatagccgatggaaacgtcgagtaataccatataacacagataactcgcatgagatatctgtcaaagatttatcgcttatggatggactcgcgtcagattagatagttggagaggtaacggctcaccaagtcgacgatctgtagccgaactgagaggttgaacggccgcattgggactgagacacggcccagactcctacgggaggcagcagtgggggatattgcgcaatggggggaaccctgacgcagcaacgccgcgtgcaggaagaaggtcttcggattgtaaactgttgtcgcaggggaagaaaagaatgacggtaccctgtgagaaagtcacgg

SEQ ID NO: 1966 - DNA, 490 bp, Unknown
  Ascusbbf_138326, encodes 16S rRNA
agagtttgatcctggctcaggatgaacgctggcggcgtgcctaatacatgcaagtcgaacggagatgccttttcagaagccttcgggcggacgagttggtattcttagtggcggacgggtgagtaacacgtgagcaacctgcctttcagagggggataacggctggaaacggtcgctaataccgcatgatataccgaagtggcatcgctttggtatcaaaggagcaatccgctgaaagatgggctcgcgtctgattagatagttggtggggtaacggcctaccaagtcgacgatcagtagccggactgagaggttgaacggccacattgggactgagatacggcccagactcctacgggaggcagcagtagggaatattgcacaatgggggaaaccctgatgcagcaacgccgcgtgaaggacgacggtcttcggattgtaaacttcttttctttgtgaagaattctgacggtagcaaaggaataagcat

SEQ ID NO: 1967 - DNA, 490 bp, Unknown
  Ascusbbf_317115, encodes 16S rRNA
agagtttgatcctggctcaggatgaacgctggcggcgtgcctaatacatgcaagtcgaacgaggttccttcggggacctagtggcgaacgggtgagtaacacataaacaatctgccctggagactgggataacgtcgggaaaccgacgctaataccggataggcagtaagggggcatccccatactgttaaagctgggttgcagcgctgcaggatgagtttatgtcgcattagttagttggtgaggtaacggcccaccaagacgatgatgcgtagccggtctgagaggatgaacggccacattgggactgagacacggcccagactcctacgggaggcagcagtagggaattttcggcaatggggggaaccctgaccgagcaacgccgcgtgaacgaagaaggtttttggatcgcagagttctgttgtaggggaagaaagctatggatagggaatgatctgtagttgacggtaccctgccagaaagccac

SEQ ID NO: 1968 - DNA, 490 bp, Unknown
  Ascusbbf_271233, encodes 16S rRNA
agagtttgatcatggctcaggacgaacgctggcggcgtgcttaaaacatgcaagtcgaacggagtgtgtttcttgcacaaagcgatgtgttgaacattgttttgtgcagggaatagacttagtggcggacgggtgagtaacacatgagcaacctgcctttcacagggggataacagatagaaatatctgctaataccgcataagaccacgcttgggcatccaagaggggtcaaaggagcgatccggtggaagaggggcttgtggctcattagctagttggcggggtagaggcccaccaaggcgacgatgagtagccgatctgagaggatgaacggccacattggaactgagatacggtccagactcctacgggaggcagcagttaggaatattgggcaatggaggaaactctgacccagcaacgccgcgtgaaggaagaaggttttcggattgtaaacttctgatctaagggaaaaagaaagtgatggta

SEQ ID NO: 1969 - DNA, 490 bp, Unknown
  Ascusbbf_1836296, encodes 16S rRNA
agagtttgatcctggctcaggacgaacgctggcggcgtgcctaatacatgcaagtcgagcggaacctttggagcttgctccattggtttagcggcggacgggtgagtaacacgtgggcaacctgccctgcagatcgggataactccgggaaaccggtgctaataccgaatagtttgcggcctctcctgaggctgcacggaaagacggtttcggctgtcactgcaggatgggcccgcggcgcattagctagttggtggggtaatggcccaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgacgaaggttttcggatcgtaaaactctgttgtgagggaagaacacgtaccaggtaactactggtaccttgacggtacctca

SEQ ID NO: 1970 - DNA, 490 bp, Unknown
  Ascusbbf_116196, encodes 16S rRNA
agagtttgatcatggctcaggattaacgctggcggcatgcctaatacatgcaagtcgaacgagaatagcaatattctagtggcgaacgggtgagtaacacgtaggcaatctacccatgtgacgaggataactattggaaacgatagctaaaactggatagtatatcaagaggcatcttttgatatttaaaggtcctgaaagggaacgcgcatggatgagcctgcggtgcattagctagttggtgaggtaacggcccaccaaggcgacgatgcatagctgtgctgagaggcaaaacagccacattgggactgagacacggcccagactcctacgggaggcagcagtagggaattttcggcaatgggggaaaccctgaccgagcaatgccgcgtgaatgaagaagttcttcggaatgtaaaattctgttattcgtgaaagaaaggtattaagaggaaatgcttagtacttgacggtaccgaatgagaaagcc

SEQ ID NO: 1971 - DNA, 490 bp, Unknown
  Ascusbbf_138423, encodes 16S rRNA
agagtttgatcctggctcaggataaacgctagcggcaggcctaacacatgcaagtcgagcggtaacaggagtagcaatacttgctgacgagcggcagacgggtgagtaacgcgtatgcaacctaccccagacccggggacagccttccgaaaggaggattgatacccgatggttcaatacggacggcatcgtcacattgataaagattcatcagtttgggatgggcatgcgtggcattagttagttggcggggtaacggcccaccaagacgatgatgcctaggggttctaaaaggaaggtcccccacatcggtactgagacacggaccgaactcctacgggaggcagcagtgaggaatattggacaatggaggcaactctgatccagccaaaccgcgtgaaggatgaaggccctagtggtcgtaaacttcttttgcgaggggataattgccggtatgtatactggcttgcaggtaccttgcgaataagca

SEQ ID NO: 1972 - DNA, 490 bp, Unknown
  Ascusbbf_128478, encodes 16S rRNA
agagtttgatcatggctcaggattaacgctggcggcgtgcataacacattcaagtcgaacgggcaaaggggcttgcttctttgccagtggcggacgggtgagtaacgcgtgagcaacctgcccttgtgtgggggataacgacgggaaactgtcgctaataccgcatgacccgatagcatcgcatggtgcagtcggcaaagatttattgcacaaggatgggctcgcgtccgattaggcagttggtggggtaacggcctaccaaacctacgatcggtagccggactgagaggttgaacggccacattggaactgagatacggtccagactcctacgggaggcagcagtggggaatattgggcaatgggcgaaagcctgacccagcgacgccgcgtgagggaagaaggtcttcggattgtaaaccttgaacaacagggacgaacaaatgacggtacctgttaggaagccacggctaactacgtgccagcagcc

SEQ ID NO: 1973 - DNA, 490 bp, Unknown
  Ascusbbf_301649, encodes 16S rRNA
agagtttgatcatggctcaggacgaacgctggcggcgtgcctaacacatgcaagtcgaacggagcgcaggttttgatcttttcggagtgacgaatctgttgcttagtggcggacgggtgagtaacgcgtgaggaacctgcctttcagagggggacaacagttggaaacgactgctaataccgcataatgcagcgagatcgcatgatattgctgccaaagatttcatcgctgaaagatggcctcgcgtctgattagatagttggtgaggtaacggcccaccaagtctgcgatcagtagccggactgagaggttgaacggccacattgggactgagacacggcccagactcctacgggaggcagcagtggggaatattgcgcaatggggggaaccctgacgcagcaacgccgcgtgaaggaagaaggtcttcggattgtaaacttttgtcttcagggaagataatgacggtacctgaggaggaagctccggc

SEQ ID NO: 1974 - DNA, 490 bp, Unknown
  Ascusbbf_1837407, encodes 16S rRNA
agagtttgatcctggctcagattgaacgctggcggcatgctttacacatgcaagtcggacggcagcgcgggcttcggcctggcggcgagtggcgaacgggtgagtaatacatcggaacgtacctggtaatgggggatagctcggcgaaagccggattaataccgcatacgacctacgggagaaagcgggggaccttcgggcctcgcgttatcagagcggccgatggcagattagctggttggtgaggtaaaggcttaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgatgaaggccttcgggttgtaaagcacttttggcaggaacgaaaaggtctgtgctaataccacgggccgatgacggtacctgcagaataagcac

SEQ ID NO: 1975 - DNA, 490 bp, Unknown
  Ascusbbf_1547594, encodes 16S rRNA
agagtttgatcctggctcaggacgaacgctggcggcgtgcctaacacatgcaagtcgagcggggactatagaacggaaggcttcggccggaaggtttatagttctagcggcggacgggtgagtaacgcgtgagcaatctgtctcagacaggggggtaacgcagcgaaagctgcactaataccgcatgagaccacagaaccgcatggttgaggggtcaaaggagcaatccggtctgaggtgagctcgcgtcctattaggtagttggtggggtaacggcccaccaagcctgcggtaggtagccgacctgagagggtgatcggccacactggaactgagacacggtccagactcctacgggaggcagcagtggggaatattgggcaatgggcgaaagcctgacccagcaacgccgcgtgagtgaagaaggtcttcggattgtaaatctctgtcctaagagaagaggggaagacggtatcttaggaggaagccc

SEQ ID NO: 1976 - DNA, 490 bp, Unknown
  Ascusbbf_452686, encodes 16S rRNA
agagtttgatcatggctcagattgaacgctggcggcaggcttaacacatgcaagtcgaacggtagcacagggagcttgctcctgggtgacgagtggcggacgggtgagtaatgcttgggaatctggcttatggagggggataactactggaaacggtagctaataccgcgtaatctctttggagtaaagggtgggaccgtttggccacctgccataagatgagcccaagtgggattaggtagttggtgaggtaatggctcaccaagcctgcgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgatgaggaaggagtgaagtttaatagacttcattattgacgttagtcacagaagaa

SEQ ID NO: 1977 - DNA, 472 bp, Unknown
  Ascusbbf_380310, encodes 16S rRNA
agagtttgatcctggctcagagcgaacgctggcggcaggcctaacacatgcaagtcgagcgggcgtagcaatacgtcagcggcagacgggagagtaacacgtgggaacgtgccctttggttcggaataactcagggaaacttgagctaataccggataagcccttacggggaaagatttattgccattggagcggcccgcgtcggattagctagttggtgaggtaatggctcaccaaggcgacgatccgtagctggtctgagaggatgaccagcctcactgggactgagacacggcccagactcctacgggaggcagcagtggggaatattggacaatgggcgcaagcctgatccagccatgccgcgtggatgatgaaggccctagggttgtaaagtccttttaacggggaagataatgacggtacccgtagaataagccccggctaacttcgtgccagcagccgcggtaat

SEQ ID NO: 1978 - DNA, 490 bp, Unknown
  Ascusbbf_1739344, encodes 16S rRNA
agagtttgatcatggctcaggacgaacgctggcggcgtgcctaatacatgcaagtcgagcggaaattttattggtgcttgcacctttaaaattttagcggcggacgggtgagtaacacgtgggtaacctaccttatagattgggataactccgggaaaccggggctaataccgaataatactttttaacacatgtttgaaagttgaaagacggtttcggctgtcactataagatggacccgcggcgcattagctagttggtgaggtaacggctcaccaaggcaacgatgcgtagccgacctgagagggtgatcggccacactgggactgagacacggcccagactcctacgggaggcagcagtagggaatcttccacaatggacgaaagtctgatggagcaacgccgcgtgagtgaagaaggatttcggttcgtaaaactctgttgcaagggaagaacaagtagcgtagtaactggcgctaccttgacgg

SEQ ID NO: 1979 - DNA, 490 bp, Unknown
  Ascusbbf_1529482, encodes 16S rRNA
agagtttgatcatggctcaggacgaacgctggcggcgcgcctaacacatgcaagtcgaacgggactagtgaccggagagcagaagttttctactctgcgttcactagttcagtggcggacgggtgagtaaagcatgagcaacctggctattagagggggatagcttttggaaacagaagataataccgcatgaatcagagatttcgcatgaagtttttggaaaaggagcaatccgctaatagatgggctcatgtccgattagcttgttggtggggtaatggctcaccaaggcaacgatcggtagccgtactgagaggttcaacggtcacattgggactgagacacggcccagactcctacgggaggcagcagtgaggaatattgcgcaatggaggaaactctgacgcagcgacgccgcgtgaaggaagacggtcttcggattgtaaacttctgtcttcagggaagaaacaaatgacggtacctggggagg

SEQ ID NO: 1980 - DNA, 490 bp, Unknown
  Ascusbbf_412755, encodes 16S rRNA
agagtttgatcatggctcaggacgaacgctggcggcgtgcctaacacatgcaagtcgaacggggcgcagagacgaagaggcggtgcttgcaccaagacggaatccctgcgcttagtggcggacgggtgagtaacgcgtggacaacctagccccggcagggggacagcagctggaaacggctggtaataccccatatgcgcacagcggcgcatgccgaagtgcggaaagccgagacggccgggggtgggtccgcgtccgattagccagttggcggggtaacggcccaccaaggcgacgatcggtagccggcctgagagggcggacggccacattgggactgagacacggcccagactcctgcgggaggcagcagtgggggatattgcacaatgggggggaccctgatgcagcgacgccgcgtgggtgaaggagcgcctcggcgcgtaaagccctatcggcagggaagacagtgacggtacctgcggaagaa

SEQ ID NO: 1981 - DNA, 472 bp, Unknown
  Ascusbbf_239251, encodes 16S rRNA
agagtttgatcctggctcaggataaacgttggcggcgtgcctaacgcatgcaagtcgcacgagagcttcggctctagtggcggacgggtgagtaacacgtaggaacctgcccggaagtgggggacaactctccgaaaggggagctaataccgcatacggtctacggaccaaagcttcggcgcttccggaggggcctgcggtggattagctagttggtggggtaaaggcctaccaaggcgacgatccatagctggtctgagaggatggtcagccacactgggactgagacacggcccagactcctacgggaggcagcagcgaggaattttgcacaatcgacgcaagtcggatgcagcaacgccgcgtgcgggaagaaggccctcgggttgtaaaccgcttttgtgggggaagaagatctgacggtaccccacgaataagtcacggctaactacgtgccagcagccgcggtaat

SEQ ID NO: 1982 - DNA, 470 bp, Unknown
  Ascusbbf_153609, encodes 16S rRNA
agagtttgatcatggctcagagtgaacgctggcggcatgcttaacacatgcaagtcgcacgggcagcaatgtcagtggcggacgggtgagtaccgcgtaggaatgtgtccagaggtgggggacaaccttgggaaactgaggctaataccgcatatgagctgaggctcaaagcagcgatgcgcctttggagtagcctgcgtccgattagctagttggtggggtaaaggcctaccaaggcgacgatcggtagctggtctgagaggacgaccagccacactgggactgagacacggcccagactcctacgggaggcagcagtggggaatattggacaatgggcgcaagcctgatccagcaatgccgcgtgtgtgaagaaggtcttcggatcgtaaagcactttcgacggggacgatgatgacggtacccgtagaagaagccccggctaacttcgtgccagcagccgcggtaat

SEQ ID NO: 1983 - DNA, 490 bp, Unknown
  Ascusbbf_259650, encodes 16S rRNA
agagtttgatcctggctcagaatgaacgttggcggcatggattaggcatgcaagtcgtacggtgagaattggttcgccttttctcatagtggcgaaagggatagtaacgcgtagacacctaccttctggacggggatagctgcgggaaactgcaggtaatacccgataatgacgagagtccaaaggtgtaattccttcagaagacggatctgcgtcctaccagatagttggcggggtaacggcccaccaagtctaagacgggtagcgggtgtgagagcatgacccgcatcactgggactgagacactgcccagacacctacgggtggctgcagtcgagaatcttcgtcaatgggcgaaagcctgaacgagcgatgccgcgtgcgggatggaggccttcgggttgtaaaccgctgtcgaattggaggaaatgcatagtgtagaattatgcttgactgatagtagaaggaaggacgggctaagttcgtgcca

SEQ ID NO: 1984 - DNA, 470 bp, Unknown
  Ascusbbf_157978, encodes 16S rRNA
agagtttgatcctggctcagaacgaacgctggcggaatgcctaacacatgcaagtcgaacgaagtcttcggacttagtggcgcacgggtgagtaacgcgtgggaatctgccttggggtacggaataactcagggaaacttgagctaataccgtatgatgtcgtaagaccaaagatttatcgccctgagatgagcccgcgtcagattagctagttggtagggtaatggcctaccaaggcgacgatctgtagctggtctgagaggatgatcagccacactgggactgagacacggcccagactcctacgggaggcagcagtggggaatattggacaatgggcgaaagcctgatccagcaattccgcgtgagcgaagaaggccttcgggttgtaaagctctttcggcagggacgataatgacggtacctgcagaagaagccccggctaactccgtgccagcagccgcggtaat

SEQ ID NO: 1985 - DNA, 490 bp, Unknown
  Ascusbbf_1812699, encodes 16S rRNA
agagtttgatcctggctcaggataaacgctagcggcaggcctaacacatgcaagtcgggcggtaacaggagtagcaatacttgctgacgagcggcagacgggtgagtaacgcgtatgcaaccttccccccgcacggggacagccttccgaaaggaggattgatacccgatagcctcatcaggcggcatcgcctgatgattaaagattcatcggcaggggatgggcatgcgtggcattagctagacggcggggtaacggcccaccgtggcgatgatgcctaggggttctaaaaggaaggtcccccacatcggtactgagacacggaccgaactcctacgggaggcagcagtgaggaatattggacaatggaggcaactctgatccagccaaaccgcgtgaaggatgaaggccctagtggtcgtaaacttcttttgcttggggataactgaaggtatgcataccatcttgaaggtaccaagcgaataagcac

SEQ ID NO: 1986 - DNA, 490 bp, Unknown
  Ascusbbf_418555, encodes 16S rRNA
agagtttgatcctggctcaggatgaacgctggcggcgtgcctaacacatgcaagtcgaacgaagttagggaagagtttactttgaactaacttagtggcggacgggtgagtaacgcgtgagtaacctgcctttcagagggggacaacgtcttgaaaaggacgctaataccgcataatatattaagatggcatcgtcttaatatcaaaggagcaatccgctgaaagatggactcgcgtccgattagctggttggtgaggtaacggctcaccaaggcgacgatcggtagccggactgagaggttgaacggccacattgggactgagacacggcccagactcctacgggaggcagcagtgggggatattgcgcaatggggggaaccctgacgcagcaacgccgcgtgaaggaagacggttttcggattgtaaacttcttttgtaagggacgaagaatgacggtaccttacgaataagctccggctaactacgt

SEQ ID NO: 1987 - DNA, 490 bp, Unknown
  Ascusbbf_489728, encodes 16S rRNA
agagtttgatcctggctcaggacgaacgctggcggcacgcttaacacatgcaagtcgaacggagttttaagagcttgcttttaaaacttagtggcggacgggtgagtaacacgtgagcaatctgcctttcagagggggatagcagttggaaacgactgataataccgcataacataaggacatcgcatggtgtccatatcaaagatttatcgctgaaagatgagctcgcgtctgattagatagttggtgaggtaacggcccaccaagtcgacgatcagtagccggactgagaggttgaacggccacattgggactgagacacggcccagactcctacgggaggcagcagtggggaatattgcacaatgggcgcaagcctgatgcagcgatgccgcgtgagggaagaaggttttaggattgtaaacctctgtcttatgggacgataatgacggtaccataggaggaagctccggctaactacgtgccagca

SEQ ID NO: 1988 - DNA, 490 bp, Unknown
  Ascusbbf_304891, encodes 16S rRNA
agagtttgatcctggctcaggatgaacgctggcggcgtgcctaacacatgcaagtcgaacgattaagacgtcttcggacgtgtatagagtggcgaacgggtgagtaacacgtgaccaacctgccccttacttcgggataacgcaaggaaacctgcgctaataccgaatactccttttctgtcgcatgatggaatcgggaaagctcagacggtaagggatggggtcgcggcccattaggtagacggcggggtagaagcccaccgtgcctgcgatgggtagccgggttgagagaccgatcggccacattgggactgagatacggcccagactcctacgggaggcagcagtggggaattttgcgcaatgggggaaaccctgacgcagcaacgccgcgtgcgggatgacggccttcgggttgtaaaccgctttcagtagggaagatagtgacggtacctacagaagaagctccggctaactacgtgccagcagc

SEQ ID NO: 1989 - DNA, 490 bp, Unknown
  Ascusbbf_1763863, encodes 16S rRNA
agagtttgatcctggctcagattgaacgctagcggaatgctttacacatgcaagtcgaacggcagcacggacttcggtctggtggcgagtggcgaacgggtgagtaatgcatcggaatgtacccagtagcgggggataactacgcgaaagcgtggctaataccgcatacgccctacgggggaaagggggggatccttcgggacctctcactattggagcagccgatgtcggattagctagttggtggggtaaaggcctaccaaggcaacgatccgtagctggtttgagaggacgaccagccacactgggactgagacacggcccagactcctacgggaggcagcagtggggaattttggacaatgggggaaaccctgatccagccattccgcgtgtgtgatgaaggccttcgggttgtaaagcacttttgtcaggaaagaaattgctcgggctaataccccgagtggatgacggtacctgaagaataagc

SEQ ID NO: 1990 - DNA, 490 bp, Unknown
  Ascusbbf_1431286, encodes 16S rRNA
agagtttgatcatggctcaggacgaacgctggcggcgtgcctaacacatgcaagtcgaacggagttatgagagcggaagttttcggatggaagcgcttacaacttagtggcggacgggtgagtaacgcgtgagtaatctgcctctcagagggggacaacagttggaaacgactgctaataccgcataacggcatacctggcatcgggtgtgcataaaaggagaaatccgctgagagatgagctcgcgtccaattagctagttggtgagataacagcccaccaaggcgacgattggtagccggactgagaggtcgaacggccacattgggactgagacacggcccagactcctacgggaggcagcagtgggggatattgcgcaatgggggaaaccctgacgcagcaacgccgcgtgaaggaagaaggtcttcggattgtaaactttggtactcagaggagataatgacggtatctgaggttaagccacgac

SEQ ID NO: 1991 - DNA, 490 bp, Unknown
  Ascusbbf_466153, encodes 16S rRNA
agagtttgatcatggctcaggatgaacgctggcggcgtgcctaacacatgcaagtcgaacggaactgattttgatgaatttcttcggagatgattcggttttagtttagtggcggacgggtgagtaacgcgtgagtaacctgccctcaagagggggataacgtcttgaaaaagacgctaataccgcataacattactttgtcgcatggcagagtaatcaaaactcaggtgcttgaggatggactcgcgtccgattagatagttggagaggtaacggctccccaagtcgacgatcggtagccggactgagaggttgaacggccacattgggactgagacacggcccagactcctacgggaggcagcagtgggggatattgcgcaatgggggaaaccctgacgcagcaacgccgcgtggatgaagacggttttcggattgtaaagtccttttctgggggacgaagaatgacggtacctcaggaataagctcc

SEQ ID NO: 1992 - DNA, 490 bp, Unknown
  Ascusbbf_1821078, encodes 16S rRNA
agagtttgatcatggctcaggatgaacgctggcggcacgcttaacacatgcaagtcgaacggaacttgggagcttgctttcaagtttagtggcggacgggtgagtaacacgtgagcaacctgcctttcggcggggaataatgattggaaacgatcactaataccccataaaataggcttatcgcatgatagatttatcaaagattcatcaccgaaagatgggctcgcgtccgattaggcagttggtgaggtaacggctcaccaaaccgacgatcggtagccgtactgagaggtagaacggccacattgggactgagacacggcccagactcctacgggaggcagcagtggggaatattgcacaatggaggaaactctgatgcagcgatgccgcgtgagggaagaaggttttcggattgtaaacctctgtcttaagggacgaagaaagtgacggtaccttaggaggaagctccggctaactacgtgccagc

SEQ ID NO: 1993 - DNA, 158 bp, Unknown
  Ascusbbf_107095, encodes 16S rRNA
agagtttgatcctggctcagcagccgcggtaatgccagcagccgcggtaatgccagcagccgcggtaatagagtttgatcatggctcagagagtttgatcatggctcagcagccgcggtaatgccagcagccgcggtaatgccagcagccgcggtaat

SEQ ID NO: 1994 - DNA, 490 bp, Unknown
  Ascusbbf_867378, encodes 16S rRNA
agagtttgatcatggctcaggatgaacgctagcggcaggcctaatacatgcaagtcgaacgggatccaccagcttgctggtggtgagagtggcgcacgggtgcgtaacgcgtgagcaacctgcccgtcccagggggatagcccctcgaaagagggattaaaaccgcatgacgctggaggatggcatcatccaccagccaaatattcataggggacggatgggctcgcgtggcattagcttgttggtaaggtaacggcttaccaaggcaacgatgcctaggggctctgagaggagaatcccccacactggtactgagacacggaccagactcctacgggaggcagcagtaaggaatattggtcaatgggcgaaagcctgaaccagccatgccgcgtgcaggaagacggccctacgggttgtaaactgcttttgtcagggaacaaacccccgctcgtgagcggggctgagtgtacctgaagaataaggatcg

SEQ ID NO: 1995 - DNA, 490 bp, Unknown
  Ascusbbf_617514, encodes 16S rRNA
agagtttgatcctggctcagattgaacgctggcggcaggcttaacacatgcaagtcgaacggtaacataaagaagcttgcttctttgatgacgagtggcggacgggtgagtaatgcttgggaatctagcttatggagggggataactatgggaaactgtagctaataccgcgtagaatcgggagatgaaagtgtgggaccttcgggccacatgccataggatgagcccaagtgggattaggtagttggtgaggtaaaggctcaccaagccgacgatctctagctggtctgagaggatgaccagccacactgggactgagacacggcccaggctcctacgggaggcagcagtggggaatattgcgcaatgggggcaaccctgacgcagccatgccgcgtgaatgaagaaggccttcgggttgtaaagttctttcggtagcgaggaaggcatttagtttaatagactaggtgattgacgttaactacagaag

SEQ ID NO: 1996 - DNA, 490 bp, Unknown
  Ascusbbf_992826, encodes 16S rRNA
agagtttgatcctggctcaggatgaacgctggcggcgtgcctaatacatgcaagtcgaacggactgtagcaatacagttagtggcgaacgggtgagtaacacgtaggtaacctgccctcaagactgggatacccagacgaaagtttggctaataccggataacaactctggaggcatctccggagtttgaaaggcgcctttaaagcgccacttaaggatggacctgcggtgcattagctagttggtgagataacagcccaccaaggcgaggatgcatagccgatctgagaggatgaccggccacaatgggactgagacacggcccatactcctacgggaggcagcagtagggagttttcggcaatgggcgaaagcctgaccgagcaacgccgcgtgagtgatgaaggtcttcggatcgtaaagctctgttacgagggatgaacgatagcttcaggaaatggttgctatttgacagtacctcgccagaaag

SEQ ID NO: 1997 - DNA, 490 bp, Unknown
  Ascusbbf_1139124, encodes 16S rRNA
agagtttgatcatggctcagattgaacgctggcggcaggcttaacacatgcaagtcgaacggtaacagattagtacttgtactaatgctgacgagtggcggacgggtgagtaatgcttgggaatctggcttatggagggggataacgacgggaaactgtcgctaataccgcgtaatgtctacggactaaaggatgggactttcgagccattcgccataagatgagcccaagtgggattaggtagttggtgaggtaaaggcttaccaagccgtcgatctctagctggtctgagaggatgaccagccaaaccgggactgagacacggcccggactcctacgggaggcagcagtggggaatattgcacaatggggggaaccctgatgcagccatgccgcgtgaatgaagaaggccttcgggttgtaaagttctttcggtgacgaggaaggcgggtattttaatagaatacctgattgacgttaatcacagaag

SEQ ID NO: 1998 - DNA, 490 bp, Unknown
  Ascusbbf_740113, encodes 16S rRNA
agagtttgatcctggctcaggatgaacgctggcggcgtgcctaacacatgcaagtcgaacgggaactctgggatgaaggttcgctggattcctagaaattctagtggcggacgggtgagtaacgcgtgggtaacctgcccttaagaggcggataacattgagaaatcagtgctaatacgccatatgcttacggaatcgcatggttctgtgaggaaatgaatttcgcttaaggatggacccgcgtttgattagccagttggcagggtaacggcctaccaaagcgacgatcaatagccggcctgagagggtgaacggccacattggaactgagacacggtccaaactcctacgggaggcagcagtggggagtattgcacaatgggcgaaagcctgatgcagcaacgccgcgtgagtgaagaagtatttcggtatgtaaagctctatcgatggggaataaaatgaaggtacccaagtaagaagccccggctaa

SEQ ID NO: 1999 - DNA, 490 bp, Unknown
  Ascusbbf_941217, encodes 16S rRNA
agagtttgatcctagctcagagttaacgctggcatcgtgcataacacatgcaagtcgaacgggacttgatttgtagcttgctatagattaagtttagtggcagacgggtgagtaatgtataaggaatctacctccgagtggggaataacagtccgaaaggattgctaataccccataacataatcagatggcatcatttgattatcaaagatttatcgcttggagatgatcttatattctatcagctagttggcagtgtaacggactaccaaggctacgacggatagccggcctgaaagggcgaccggccacaagggcactgagacacgggccctactcctacgggaggcagcagtggggaattttggacaatgggcgcaagcctgatccagcaacgatgcgtggaggatgaaggttttcggattgtaaactccttttgtgagggaagaaacaaatgacggtacctcacgaataagccacggctaactac

SEQ ID NO: 2000 - DNA, 490 bp, Unknown
  Ascusbbf_494186, encodes 16S rRNA
agagtttgatcatggctcaggatgaacgctagctacaggcttaacacatgcaagtcgaggggcagcataggggtagcttgctacctttgatggcgaccggcggatgggtgagtaacgcgtatccaacctgccccgctcccggggacagcccttagaaatgaggattaacccccgatgttgtggcagtgccgcatggtgccgccacgaaatgtgaaggagcgggatggggatgcgttccattaggcagcaggcggggtaacggcccacctggccttcgatggataggggttctgagaggaaggtcccccacactggaactgagacacggtccagactcctacgggaggcagcagtgaggaatattggtcaatgggcgcgagcctgaaccagccaagtagcgtgcgggatgaaggccctacgggttgtaaaccgcttttgcgcgcggataaagagggtcacgtgtggcccgttgcaggtagcgcgcgaataa

SEQ ID NO: 2001 - DNA, 490 bp, Unknown
  Ascusbbf_742964, encodes 16S rRNA
agagtttgatcatggctcaggacgaacgctggcggcgtgcttaacacatgcaagtcgaacgagggccatttgggagcttgctcttgggtggctcgagtggcggacgggtgagtaacgcgtgaggaacctgtcttacacagggggataacgcaccgaaaggcgtgctaataccgcataagacacggtaccgcatggtattgaggtcaaaggagcaatccggtgtaaggtggcctcgcgtcccattaggcagttggtgaggtaacggcccaccaaaccgacgatgggtagccgacctgagagggtgatcggccacattggaactgagacacggtccaaactcctacgggaggcagcagtggggaatattgggcaatgggcgcaagcctgacccagcaacgccgcgtgagggaagaaggttttcggattgtaaacctctgtcctcaatgaaaagcaggagatggtaattgaggaggaagccccggctaactac

SEQ ID NO: 2002 - DNA, 490 bp, Unknown
  Ascusbbf_1331026, encodes 16S rRNA
agagtttgatcatggctcaggatgaacgctagcggcaggcttaacacatgcaagtcgaggggtaacgcgaggtagcaatactttggcgacgaccggcgcacgggtgcgtaacgcgtatgcaacctacctgtaacaggggtataacggggtgaaaatcccactaatcccccatattgttaaagaatcgcatgtttctttaacgaaagcttcggtggttacggatgggcatgcgtggcattagctagttggtaaggtaacggcttaccaaggcgacgatgtctaggggagctgagaggcttatcccccacactggtactgagacacggtccagactcctacgggaggcagcagtgaggaatattggacaatggaggcaactctgatccagccatgccgcgtgaaggacgaaggccctatgggtcgtaaacttcttttgtcagggagcaataagggccacgcgtggtccgacgagagtacctggcgaataagc

SEQ ID NO: 2003 - DNA, 490 bp, Unknown
  Ascusbbf_529679, encodes 16S rRNA
agagtttgatcctggctcaggatgaacgctggcggcgcgcctaacacatgcaagtcgaacggcgaagtcccttcggggacggaacagtggcggacgggtgagtaacgcgtgagtaacctgcccttatgagcggaataacgtcgggaaactgacgctaataccgcataacgcacgggagtggcatcgctaccgtgccaaagatttatcgcataaggatggactcgcgtcccattagacagttggcggggtaacggcccaccaaatcagcgatgggtagccggactgagaggttgaacggccacattggaactgagagacggtccagactcctacgggaggcagcagtggggaatattgggcaatgggcgaaagcctgacccagcgacgccgcgtgagcgaagaaggtcttcggattgtaaagctctgtgtacagggacgataatgacggtacctgtatagaaagccacggctaactacgtgccagcagccg

SEQ ID NO: 2004 - DNA, 490 bp, Unknown
  Ascusbbf_1444779, encodes 16S rRNA
agagtttgatcatggctcaggatgaacgctagcgggaggcttaacacatgcaagccgaggggtatagatagcttgctatctagagaccggcgcacgggtgcgtaacgcgtatgtaacttgccctattgagtgggatagcccttcgaaaggaggattaataccgcataacactaatacaggcatctgtattggttgaaagatttatcgcaataggatagacatgcgtcagattagctagttggtgaggtaacggctcaccaaggcgatgatctgtagggggcctgagagggtgaccccccacactggtactgagacacggaccagactcctacgggaggcagcagtgaggaatattggacaatgggtgagagcctgatccagccatcccgcgtgcaggaagacggccttatgggttgtaaactgcttttatataggaataaaccactttacgtgtagagtgttgaaggtactatatgaataagcaccggct

SEQ ID NO: 2005 - DNA, 490 bp, Unknown
  Ascusbbf_1737860, encodes 16S rRNA
agagtttgatcatggctcaggacgaacgctggcggagtgcttaacacatgcaagtcgaacgaggatattcctttcgggggatattcgagtggcggacgggtgagtaacgcgtgaacaatctgtccttcaaagggggataccaactggaaacagttgctaataccgcataagaccacagtgtcgcatggcacagaggtaaaagacggaagtcgatggagggtgagttcgcgtctgattaggcagttggcggggtaaaggcccaccaaaccgacgatcagtagccgacctgagagggtgaccggccacattgggactgagacacggcccagactcctacgggaggcagcagtgggaatattgggcaatgggcgaaagcctgacccagcaacgccgcgtgagggaagaaggttttcggattgtaaacctctgtcctaaaggacgaaggaagtgacggtactttaggaggaagccccggctaactacgtgccag

SEQ ID NO: 2006 - DNA, 490 bp, Unknown
  Ascusbbf_727531, encodes 16S rRNA
agagtttgatcctggctcaggatgaacgctggcggcgtgcctaacacatgcaagtcgaacggggttaagggaaattttcggatggaacttaacttagtggcggacgggtgagtaacgcgtggataacctgcctcacacagggggatagcagctggaaacggctggtaataccgcataagaccacaaagccgcatggctttgaggtaaaagatttatcggtgtgagatggatccgcgtctgattagccagttggcggggtaacggcccaccaaagcgacgatcggtagccgacctgagagggtgaacggccacattggaactgagagacggtccaaactcctacgggaggcagcagtggggaatattgggcaatgggcgaaagcctgacccagcaacgccgcgtgagtgaagaaggccttcgggttgtaaagctctgttatagttgacgaaggaagtgacggtaggctataagaaagccccggctaactac

SEQ ID NO: 2007 - DNA, 490 bp, Unknown
  Ascusbbf_726473, encodes 16S rRNA
agagtttgatcatggctcaggatgaacgctggcggcgtgcctaacacatgcaagtcgagcgagaaatacttgattgaaacttcggtagatagatggtatggaaagcggcggacgggtgagtaacgcgtaggcaacctgccccttacacagggatagccattggaaacgatgattaaaacctgatgacaccaagagatgacatcttctcctggtcaaagatttatcggtaagggatgggcctgcgtctgattagatagttggtgaggtaacggcccaccaagtcaacgatcagtagccgacctgagagggtgatcggccacattggaactgagacacggtccaaactcctacgggaggcagcagtggggaatattgcacaatgggggaaaccctgatgcagcaacgccgcgtgaaggatgaaggtcttcggatcgtaaacttctgtcctagaggaagataatgacggtactcttggaggaagccccggcta

SEQ ID NO: 2008 - DNA, 490 bp, Unknown
  Ascusbbf_386138, encodes 16S rRNA
agagtttgatcctggctcaggatgaacgctggcggcgtgcctaacacatgcaagtcgagcgggaaattccggaccgaagtttcggcagagggaaggaatggagagcggcggacgggtgagtaacacgtgggcaacctgccctgtacagagggatagccactggaaacggtgattaatacctcataatgctccaaggccacctggctttggggtcaaagatttatcggtacaggatgggcccgcgtctgattagctagttggtggggtaacggcctcccaaggcaacgatcagtagccgacctgagagggtaatcggccacattggaactgagacacggtccaaactcctacgggaggcagcagtggggaatattgcacaatgggggaaaccctgatgcagcaacgccgcgtgaatgatgaaggcctttgggtcgtaaaattctgttcttagggaagaaaaaaatgacggtacctaaggagaaagccccgg

SEQ ID NO: 2009 - DNA, 490 bp, Unknown
  Ascusbbf_714991, encodes 16S rRNA
agagtttgatcatggctcaggatcaacgctggcggcgtgcctaatgcatgcaagtcgaacgtggtcccttcggggatgcgcgtggcggacgggtgaggaacacgtgggaaacctgccttttggtggggggtagccctcggaaacggggggtaattccgcatgagctcgcatcttggtgagaggtgtgaggaaaggctcttcggagtcgccgaaagagggtcctgcgcccgattagctagatggtggggtaacggcctaccatggcgatgatcggtagctggtctgagaggacggccagccacaggggaactgagacacggtccccactcctacgggaggcagcagcaaggaattttccgcaatgggcgaaagcctgacggagcaacgccgcgtgggggaagacacctttcggggcgtaaaccccttttctgtgggatgacaaccgacagtaccacaggaagaaggcccggctaactacgtgccagcagcc

SEQ ID NO: 2010 - DNA, 490 bp, Unknown
  Ascusbbf_1442999, encodes 16S rRNA
agagtttgatcatggctcaggatgaatgctggcggcgtgcctaatacatgcaagtcgagcggtaacagggcttcaccgtttccttgacacacctagcgcttctatcgtaggttggttcgattcgagggaacagtgaagctgctgacgagcggcggacggctgagtaacgcgtgggaacgtaccccaaactgagggataacgcaccgaaaggtgtgctaataccgcatatgatcttcggattaaagcttacgggcggtttgggaatggcctgcgtacgattagatagttggtagggtaacggcctaccaagtcgacgatcgttagatggtttgagaagatgatcatccagactgggactgagacacggcccagactcctacgggaggcagcagtagggaatctttcacaatgggcgaaagcctgatggagcaacgccgcgtgcaggatgacggccttcgggttgtaaactgcttttatatctgagaaatat

SEQ ID NO: 2011 - DNA, 469 bp, Unknown
  Ascusbbf_1752787, encodes 16S rRNA
agagtttgatcatgctcagaacgaacgctggcggcaggcctaacacatgcaagtcgaacgcactcttcggagtgagtggcagacgggtgagtaacacgtgggaacatgcccttcggttcggaataactcagggaaacctgtgctaataccggatacgtcctatgggagaaagatttatcgccgaaggattggcccgcgtctgattagctagttggtagggtaaaagcctaccaagacgatgatcagtagctggtctgagaggacgaccagccacactgggactgagacacggcccagactcctacgggaggcagcagtggggaatattggacaatgggcgaaagcctgatccagccatgccgcgtggatgatgaaggctcttgggttgtaaaatcctttcgctagggaagataatgacggtacctagtaaagaagctccggctaacttcgtgccagcagccgcggtaat

SEQ ID NO: 2012 - DNA, 490 bp, Unknown
  Ascusbbf_1807486, encodes 16S rRNA
agagtttgatcctggctcaggatgaacgctggcggcgtgcctaacacatgcaagtcgaacgggactgcaataatatgaactcttcggagggaattgtttgtagtttagtggcggacgggtgagtaacgcgtgagtaacctgcccttgagagggggataacgttctgaaaaggacgctaataccgcataacattatgttatcgcatgataatataatcaaaactgaggtgctgaaggatggactcgcgtccgattagatagttggtgaggtaacggctcaccaagtcgacgatcggtagccggactgagaggttgaacggccacattgggactgagacacggcccagactcctacgggaggcagcagtgggggatattgcgcaatgggggaaaccctgacgcagcaacgccgcgtggatgaagacggttttcggattgtaaagtccttttcttggggacgaattctgacggtacccaaggaataagctccg

SEQ ID NO: 2013 - DNA, 488 bp, Unknown
  Ascusbbf_1445762, encodes 16S rRNA
agagtttgatcctggctcagaacgaacgctggcggcaggcttaacacatgcaagttgagcgggattgattgatagcttgctattgatcatgagagcagcgcactggtgagtaacacgtgggaacataccttttggtgggggacaacagttggaaacgactgctaataccgcataagccctgagggggaaagattaattgccgagagattggcccgcggaagattaggtagtaggtggggtaacggcctacctagccgacgatctatagctggtctgagagaacggacagctacattggaactgcggcacggtccagataccaacgggagtcagcagggaggaatattgggcaatggagggaactctgacccagccatgccgcgggagggaagaaggttttcggagtgtaaagctctttcagacgggaagatgatgacggtaccgtaagaagaagcaccggctaacttcgtgccagcagccgcggtaat

SEQ ID NO: 2014 - DNA, 490 bp, Unknown
  Ascusbbf_710964, encodes 16S rRNA
agagtttgatcatggctcaggacgaacgctggcggcgtgcttaacacatgcaagtcgaacgggcatagagaggagcttgcttcactctatgttagtggcggacgggtgagtaacgcgtgagcaacttaccttggacagtggaataacacagggaaacttgtgctaataccgcatgaagtgcgggaagggcatcctttctgtaccaaaggagcaatccggtctgagatgggctcgcgtccgattagatagttggtgaggtaacggcccaccaagtctgcgatcggtagccggactgagaggttggccggccacattgggactgagacacggcccagactcctacgggaggcagcagtggggaatattaggcaatggggggaaccctgacctagcaacgccgcgtgaaggatgaaggttttcggattgtaaacttctttggcaggggacgataatgacggtaccctgagaacaagccacggctaactacgtg

SEQ ID NO: 2015 - DNA, 490 bp, Unknown
  Ascusbbf_1854682, encodes 16S rRNA
agagtttgatcatggctcaggatgaacgctggcggcgtgcttaacacatgcaagtcgaacggagcttattaagaaagcggagcttgctccaatggatttttaagcttagtggcggacgggtgagtaacgcgtgggtaacctgccttgcacagggggacaacagttggaaacgactgctaataccgcataagccggtagcctcgcatgaggtatccggaaaagatttatcggtgcaagatgggcccgcgttggattagttagttggcggggtaaaggcccaccaagaccgcgatccatagccgacctgagagggtgatcggccacattgggactgagacacggcccaaactcctacgggaggcagcagtggggaatattgcgcaatgggggaaaccctgacgcagcaacgccgcgtgagtgaagaagtatttcggtatgtaaagctctatcagcagggaagaagatgacggtacctgcagaagaagtcccg

SEQ ID NO: 2016 - DNA, 490 bp, Unknown
  Ascusbbf_710448, encodes 16S rRNA
agagtttgatcatggctcaggacgaacgctggcggtgtgcctcacacatgcaagtcgagcggatgtttattagaagcttgcttttgataaacgttagcggcggacgggtgagtaatacgtaggaatctgcctcaaggagggggacaacgggtcgaaagatccgctaataccccatatgcgagcaatcgtgaaaggagtaatccacctagagatgagcctgcgtccgattagctagttggcggggtaaaagcccaccaaggcaacgatcggtagttggtctgagaggatgatcagccacaatgggactgagacacggcccatactcctacgggaggcagcagtggggaattttacgcaatgggggaaaccctgacgtagcgacaccgcgtgagcgaagaagccttttggggtgtaaagctctgtcagctggaacgaacacaatgacggtaccagcagaggaagcatcggctaactacgtgccagcagccgc

SEQ ID NO: 2017 - DNA, 490 bp, Unknown
  Ascusbbf_1395671, encodes 16S rRNA
agagtttgatcctggctcaggatgaacgctggcggcgtgcctaatacatgcgagtcgaacgagagtagcaatactcgagtggcgaacgggtgagtaacacgtagggaacctgcccttcagcttgggatacccgagggaaaccttggctaataccggataactgatttggaggcatctccagatcctaaaaggggcctttaaagcctcactgaaggatggacctgcggcgcattagctagttggtgagataatagcccaccaaggcgaggatgcgtagccgacctgagagggtgaacggccacactggaactgagacacggtccagactcctacgggaggcagcagtagggagttttcggcaatgggggaaaccctgaccgagcaacgccgcgtgagtgatgaaggtcttcggattgtaaaactctgttgtaggggaagaatgatactttgaggaaatgctaagtatttgacggtaccttattagaaagcc

SEQ ID NO: 2018 - DNA, 490 bp, Unknown
  Ascusbbf_718264, encodes 16S rRNA
agagtttgatcatggctcaggataaacgctagcggcaggcctaacacatgcaagtcgagcggtaacacggtgtagcaatatattggtgacgagcggcggacgggtgagtaacgcgtatgcaacctaccctttacacagggatagctttccgaaaggagaattaatacctgatagtactagaaacgggcatccgagaagagttaaagattaattggtaaaggatgggcatgcgtagcattagttagttggtgaggtaacggctcaccaagacgatgatgcttaggggttctaaaaggaagatcccccacatcggtactgagacacggaccgaactcctacgggaggcagcagtgaggaatattggacaatgggcgagagcctgatccagccaaaccgcgtgaaggaagaaggttcttagaatcgtaaacttcttttgagagagaataatagtaagtatgtatacttatttgaatgtatcttttgaataagc

SEQ ID NO: 2019 - DNA, 490 bp, Unknown
  Ascusbbf_1807344, encodes 16S rRNA
agagtttgatcatggctcaggacgaacgctggcggcgtgcttaacacatgcaagtcgaacgaagcttgatttatgatttcttcggaatgaataatgatatgacttagtggcggacgggtgagtaacgcgtgaggaacctgcctttcagagggggacaacatttggaaacgaatgctaataccgcataacgcattttaaggacatcctttaaatgccaaagatttatcgctgaaagatggcctcgcgtccaattagttagttggcggggtaacggcccaccaagacgacgattggtagccggactgagaggttgaacggccacattgggactgagacacggcccagactcctacgggaggcagcagtggggaatattgcacaatgggcgcaagcctgatgcagcaacgccgcgtgaaggaagacggttttcggattgtaaacttctgttcttagtgacgaaacaaatgacggtagctaaggagcaagccac

SEQ ID NO: 2020 - DNA, 490 bp, Unknown
  Ascusbbf_473260, encodes 16S rRNA
agagtttgatcatggctcaggatgaacgctggcggcgtgcataacacattcaagtcgaacggacgaagccccttcgggggctgagttagtggcggacgggtgagtaacgcgtgagcaacctgcctatgcgagggggataacagtgggaaactactgctaataccgcataaaacgtggtgaaggcatcttcggcacgtcaaagatatattgcgcatagatgggctcgcgtccgattagatagttggtgaggtaacggcccaccaagtcgacgatcggtagccggactgagaggttgaacggccacattggaactgagagacggtccagactcctacgggaggcagcagtggggaatattgggcaatgggcgaaagcctgacccagcgacgccgcgtgagtgaagaaggtcttcggattgtaaagcttagttatcggggaagaaggaagtgacggtacccgaagagaaagccacggctaactacgtgccagc

SEQ ID NO: 2021 - DNA, 490 bp, Unknown
  Ascusbbf_1804337, encodes 16S rRNA
agagtttgatcctggctcagattgaacgctggcggcatgccttacacatgcaagtcggacggtaacgcgggcttcggcctggcgacgagtggcgaacgggtgagtaatatatcggaacgtgcccttgagtgggggataactagtcgaaagattagctaataccgcatacgatctacggatgaaagtgggggaccgcaaggcctcacgctcgtggagcggccgatatctgattagctagttggtggggtaaaggcctaccaaggcgacgatcagtagctggtctgagagggcgatcagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaatcgttctggctaatacctggagcggatgacggtaccggaagaataagcac

SEQ ID NO: 2022 - DNA, 490 bp, Unknown
  Ascusbbf_942134, encodes 16S rRNA
agagtttgatcatggctcaggacgaacgctggcggcgtgcttaacacatgcaagtcgagcgaggccctccttcggggggtgccctagcggcgaacgggtgagtaacacgtgggcaacctgccctcagctctgggataactccaagaaattggtgctaataccggatgtgaccgctgaccgcatggtctggtggtggaaagattcatcggctgaggatgggcccgcggcctatcagcttgttggtggggtaatggcctaccaaggcgacgacgggtagccggcctgagagggtgaccggccacactgggactgagacacggcccagactcctacgggaggcagcagtggggaatattgcgcaatgggcgaaagcctgacgcagcgacgccgcgtgagggatgacggccttcgggttgtaaacctctttcagtagggacgaagcgcaagtgacggtacctacagaagaagcaccggccaactacgtgccagc

SEQ ID NO: 2023 - DNA, 490 bp, Unknown
  Ascusbbf_1865983, encodes 16S rRNA
agagtttgatcatgctcaggatgaacgctggcggcgtgcctaacacatgcaagtcgggcgggaatcatcggattgaaacttcggtcgaaagacggtgaggatagcggcggacgggtgagtaacgcgtaggtaacctgccccttacacagggatagcctcgggaaactgggattaatacctgataacgcgaaggagccacatggcttcatcgccaaagatttatcggtgagggatggacctgcgtctgattagctagttggtgaggtaacggcccaccaaggcaacgatcagtagccgacctgagagggtaatcggccacattggaactgagacacggtccaaactcctacgggaggcagcagtggggaatattgcacaatgggcgcaagcctgatgcagcaacgccgcgtgagcgaagaaggtcttcggatcgtaaagctctgtcctcaggaacgaagaagtgacggtacctgaggaggaagccccggct

SEQ ID NO: 2024 - DNA, 490 bp, Unknown
  Ascusbbf_1746791, encodes 16S rRNA
agagtttgatcctggctcaggatgaacgctagcggcaggcctaacacatgcaagtcgaacggtaacaggaattagcttgctaatttgctgacgagtggcgcacgggtgcgtaacgcgtatgcaacttacctctaacaggaggatagcctttcgaaaggaagaataatactccataatatttatttgtggcatcacagatttattaaaactacggtggttagagataggcatgcgtcctattagctagttggtgaggtaacagctcaccaaggcgatgataggtagggggcctgagagggttatcccccacactggtactgagacacggaccagactcctacgggaggcagcagtgaggaatattggtcaatggacgaaagtctgaaccagccatgccgcgtgcaggaagactgccctacgggttgtaaactgcttttatataggaataaaccctcgttcgtgaacgaggctgaaggtactataagaataa

SEQ ID NO: 2025 - DNA, 490 bp, Unknown
  Ascusbbf_1881501, encodes 16S rRNA
agagtttgatcatggctcaggatgaacgctggcggcgtgcctaacacattcaagtcgaacggaccttagagggcttgctctttaaggttagtggcggacgggtgagtaacgcgtgagcaacctgcctctgacagcgggataacattgggaaaccggtgctaataccgcatgacacaccgagtttgcatggacacggtgtcaaagaagcaattcggtcagagatgggctcgcgtctgattagttagttggcggggtaacggcccaccaagacgacgatcagtagccggactgagaggtcgaacggccacattggaactgagaaacggtccagactcctacgggaggcagcagtggggaatattgggcaatgggcgaaagcctgacccagcgacgccgcgtggaggaagaaggtcttcggattgtaaactcctgtcaacagggaagaagcaagtgacggtacctgtagaggaagccacggctaactacgtgc

SEQ ID NO: 2026 - DNA, 490 bp, Unknown
  Ascusbbf_1818978, encodes 16S rRNA
agagtttgatcatggctcaggatgaacgctagcggcaggcctaatacatgcaagtcgaggggcagcacaggtagcaatactgggtggcgaccggcaaacgggtgcggaacacgtacgcaaccttccttcaagcggggaatagcccagagaaatttggattaataccccataggaatgtagtctcgcatgagacagcatttaaagatttatcacttgaagatgggcgtgcgtctgattaggtagttggtgaggtaacggctcaccaagccgacgatcagtaactggcgtgagagcgcgaccagtcacacgggcactgagacacgggcccgactcctacgggaggcagcagtaaggaatattggtcaatggacgcaagtctgaaccagccatgccgcgtggaggatgaatgccctctgggttgtaaacttcttttatctgggacgaaacacttcttatctaaggagcttgacggtaccagatgaataagcac

SEQ ID NO: 2027 - DNA, 490 bp, Unknown
  Ascusbbf_1827667, encodes 16S rRNA
agagtttgatcctggctcaggataaacgctggcggcatgcctaatacatgcaagtcaaacgggtgtacttgtacaccagtggcgaacgggtgagtaatatgtaggtaacttgccctcaagacgaggataacagttggaaacgactgataatactggatagtaaacgaaaccgcatgattttgtttttaaagttcccccaaaggaacacttgaggagaggcctatatcgcattagctagttggtgaggtaacggcccaccaaggcgacgatgcgtaactgtgctgagaggcaaaacagtcacattggaacttagacacggtccaaactcctacgggaggcagcagtagggaattttcggcaatgggggaaaccctgaccgagcaatgccgcgtgaatgatgaagatcttcggattgtaaaattctgttgttaggaatgaattacattactaggaaatgagtagtgcttgacagtacctgactagaaagccc

SEQ ID NO: 2028 - DNA, 490 bp, Unknown
  Ascusbbf_1477389, encodes 16S rRNA
agagtttgatcctggctcagattgaacgctggcggcaggcctaacacatgcaagtcgagcggaaacgatgggagcttgctcccaggcgtcgagcggcggacgggtgagtaacgcgtaggaatctacccaatagtgggggatagctcgaggaaactcgaattaataccgcatacgccctacgggggaaaggccgggatcttcggaccggttgctattggaagagcctgcgttggattagctagttggtaaggtaaaagcttaccaaggcgacgatccatagctggtctgagaggatgatcagccacactgggactgagacacggcccagactcctacgggaggcagcagtggggaatattggacaatgggggcaaccctgatccagccatgccgcgtgtgtgaagaaggctttcgggttgtaaagcactttaagcgaggaggaaggctttgtggttaatagccacaaggattgacgttactcgcagaataa

SEQ ID NO: 2029 - DNA, 490 bp, Unknown
  Ascusbbf_1785101, encodes 16S rRNA
agagtttgatcatggctcaggatgaacgctagcggcaggcctaacacatgcaagtcgaggggtagaaaagagcttgctctttttgagaccggcaaacgggtgcggaacacgtacgcaatctgcccttatcacgggaatagcccagagaaatttggattaatgcccgatggtataatagagaggcatctctttattattaaagaatttcggataaggatgagcgtgcgcaagattagctagttggtagggtaacggcctaccaaggcgacgatctttagctgatgtgagagcatgatcagccacacgggcactgagacacgggcccgactcctacgggaggcagcagtgaggaatattggtcaatgggcggaagtctgaaccagccatgccgcgtgaaggatgaaggcgttctgcgttgtaaacttcttttattaggggagaaaccacttttgtctaagagtgttgacggtacctaatgaataagcaccgg

SEQ ID NO: 2030 - DNA, 490 bp, Unknown
  Ascusbbf_969117, encodes 16S rRNA
agagtttgatcctggctcagaacgaacgctggcagcgtggattaggcatgcaagtcgaacgggattgtctggatagcaatattcgggcatgagagtggcggattggggaggaacacgtgagcaacctgccctggagatggggaaaacctctggaaacggaggctaataccgaatgtggcgccggacggcatcgtccgagcgccgaagggggccgcaaggctcccgctccgggatgggctcgcgcaccatcagctagttggcggggtaacggcccaccaaggcctacggttagctggtctgagaggatgaccagccccactgggactgagatactgcccagactcctacgggaggctgcagtcgaggatcattcgcaatggacgcaagtctgacgatgcgacgctgcgtggaggatgaaggccttcgggttgtaaactcctgtcatgagggaagaggcgaggggacccaatacgtcccttagttgactgta

SEQ ID NO: 2031 - DNA, 490 bp, Unknown
  Ascusbbf_399408, encodes 16S rRNA
agagtttgatcctggctcaggacgaacgctggcggcgtgcctaacacatgcaagtcgagcgaagtttttatctttgatcccttcggggtgacgagataattatcttagcggcggacgggtgagtaacgcgtgagaaacctgccttttacaaagggatagcctctggaaacggggattaataccttatgatactttttttactcatgtagaaaaagtcaaagcgctttagcggtaaaagatggtctcgcgtcccattagctagttggtgagataaaagctcaccaaggcgacgatgggtagccggcctgagagggtgaacggccacactggaactgagacacggtccagactcctacgggaggcagcagtggggaatattgcacaatggaggaaactctgatgcagcgacgccgcgtgaacgatgaaggctttcgggtcgtaaagttctgtccttggggaagataatgacggtacccaaggaggaagcccc

SEQ ID NO: 2032 - DNA, 490 bp, Unknown
  Ascusbbf_1814069, encodes 16S rRNA
agagtttgatcctggctcaggatgaacgctggcggcgtgcataacacattcaagtcgaacggactgatttggtagcttgctaccgatgaaagttagtggcggacgggtgagtaacgcgtgagcaacctgcctctgtgtgtgggataccgtctggaaacggacgttaataccgcataatccatagggaccgcatgattcttatggcaaagatttattgcacagagatgggctcgcgtctgattaggcagttggtgaggtaacggcccaccaaaccgacgatcggtagccggactgagaagttgaacggccacattggaactgagatacggtccagactcctacgggaggcagcagtggggaatattgggcaatgggcgaaagcctgacccagcgacgccgcgtgaaggaagacggccctcggattgtaaacttcttttatgtgggacgatacaagacggtaccacatgaataagccacggctaactacgtg

SEQ ID NO: 2033 - DNA, 490 bp, Unknown
  Ascusbbf_1504271, encodes 16S rRNA
agagtttgatcctggctcaggacgaacgctggcggcgcgcctaacacatgcaagtcgagcggagatagtacttcggttctatcttagcggcggacgggtgagtaacgcgtgagcaacctgcccttgagcgggggatagcgtctggaaacggacggtaataccgcataatgtacgttggaggcatctccgatgtaccaaaggaggaatccactcaaggatgggctcgcgtccgattaggtagttggtgaggtaacggcccaccaagcctgcgatcggtagccggactgagaggttgtacggccacattgggactgagacacggcccagactcctacgggaggcagcagtgggggatattgcacaatggaggaaactctgatgcagcgacgccgcgtgagggaagaaggtcttcggattgtaaacctctgtctttcgggacgaaggaagtgacggtaccgaaagaggaagccacggctaactacgtgccagc

SEQ ID NO: 2034 - DNA, 490 bp, Unknown
  Ascusbbf_1809766, encodes 16S rRNA
agagtttgatcatggctcagattgaacgctggcggcatgccttacacatgcaagtcgaacggtaacagggagcttgctccgctgacgagtggcgaacgggtgagtaaagcatcggaacgtaccattgagtgggggataacgtagcgaaagttacgctaataccgcatattctctccggaggaaagcaggggatcgcaagaccttgtgctctttgagcggccgatgtcagattagctagttggtggggtaaaggcctaccaaggcgacgatctgtagcgggtctgagaggatgatccgccacactgggactgagacacggcccagactcctacgggaggcagcagtggggaattttggacaatgggggcaaccctgatccagccatgccgcgtgagtgaagaaggccttcgggttgtaaagctctttcggccgggaagaaatcgcaaaggctaatatcctttgtggatgacggtaccggaataagaagcac

SEQ ID NO: 2035 - DNA, 490 bp, Unknown
  Ascusbbf_974765, encodes 16S rRNA
agagtttgatcctggctcaggatgaacgctagcggcaggcttaatacatgcaagtcgaggggcagcaggggtgtagcaatacacctgctggcgaccggcaaacgggtgcggaacacgtacgcaacttaccctgaactggggcatagcccggggaaacccggattaataccccgtaacactattgggtggcatcacttgatagttaaagctttattgtggttcgggatgggcgtgcggctgattaggtagttggtaggggtaacggcccaccaagccgacgatcagtaactggtgtgagagcacgaccagtcacacgggcactgagacacgggcccgactcctacgggaggcagcagtaaggaatattgggcaatggaggcaactctgacccagccatgccgcgtggaggatgaaggccctctgggttgtaaacttcttttacctgggacgaaaccttctttttctaagggagttgacggtaccaggggaa

SEQ ID NO: 2036 - DNA, 487 bp, Unknown
  Ascusbbf_1888437, encodes 16S rRNA
agagtttgatcctggctcagaacgaacgctggcggcaggtcttaggcatgcaagtcgaacgagtgaagcagggcttgccctgtggagcgagtggcgcacgagtgagtaacgcgtgggaaactgcccaccactggggaataacgtttggaaacgaacgctaataccgcatacgccggaaacgggaaagatttatcggtggtggatgtgcccgcgttggattagcttgttggtggggtaatggcccaccaaggcgatgatccatagctggtctgagaggctggccggccacattgggactgagatacggcccagactcctacgggaggcagcagttgggaatattggacaatggaggaaactctgatccagtgacgccgcgtgaaggaagaaggtcttcggattgtaaacttattttatcagggaagaagaaagtgacagtacctgaagaaaaaggaccggcaaactacgtgccagcagccgcggtaat

SEQ ID NO: 2037 - DNA, 490 bp, Unknown
  Ascusbbf_1862725, encodes 16S rRNA
agagtttgatcatggctcaggacgaacgctggcggcgtgcctaacacacgcaagtcgaacggagttatttgaagcttgctttagataacttagtggcggacgggtgagtaacgcgtgagtaacctgcctttcagagggggataacgttctgaaaagaacgctaataccgcataacatatttaagccgcatggtttgaatatcaaaggagtaatccactgaaagatggactcgcgtccgattagctagttggtggggtaaaggcctaccaaggcgacgatcggtagccggactgagaggttgaacggccacattgggactgagacacggcccagactcctacgggaggcagcagtgggggatattgcacaatggaggaaactctgatgcagcaacgccgcgtgagggaagacggttttcggattgtaaacctctgtccttagggaagataatgacggtacctaaggaggaagctccggctaactacgtgcc

SEQ ID NO: 2038 - DNA, 490 bp, Unknown
  Ascusbbf_992605, encodes 16S rRNA
agagtttgatcatggctcaggatgaacgctggcggcgtgcttaacacatgcaagtcgaacggagagaaagtgcttgcactttctcttagtggcggacgggtgagtaacgcgtgggtaacctgccctatgcagggggataacgtttggaaacgaacgctaataccgcataatctatgagagtcgcatgacactcatagcaaagatttatcagcataggatggacccgcgttggattagctagttggtgagataatagcccaccaaggcgacgatccatagccggcctgagagggtgaacggccacactgggactgagacacggcccagactcctacgggaggcagcagtggggaatattgcacaatgggcgaaagcctgatgcagcgacgccgcgtgaaggatgaaggtcttcggattgtaaacttctatcagcagggaagaaggagagtattcggactctcttgacggtacctgactaagaagccccggc

SEQ ID NO: 2039 - DNA, 486 bp, Unknown
  Ascusbbf_1746281, encodes 16S rRNA
agagtttgatcctggctcagagtgaacgctggcggcgtgcttaacacatgcaagtcgaacgagtaagtgctgtagcaatacagattactgctagtggcagacgggtgagtaatacatgggaatctacctcgaagtctgggataactgttggaaacgatagctaataccggatattgccgagaggtgaaagtttttcgcttcgagatgagcccatgcaagattagctagttggtagggtaaaggcctaccaaggcgatgatctttagctggtctaagaggatgatcagccacactggaactgagacacggtccagactcctacgggaggcagcagtggggaatattggacaatgggcgaaagcctgatccagcgacgccgcgtgagtgatgaaggccttcgggttgtaaagctctttcagtagggaagataatgacggtacctacagaagaagctccggctaacttcgtgccagcagccgcggtaat

SEQ ID NO: 2040 - DNA, 490 bp, Unknown
  Ascusbbf_1805591, encodes 16S rRNA
agagtttgatcatggctcaggacgaacgctggcggcatgcctaacacatgcaagtcgaacggacgagggtagcaatacccgagttagtggcgaacgggtgagtaacacgtgagcaacctgccctacacactgggatagcagttggaaacgactgataataccggatgagaccacagtcccgcatgggacaggggtcaaagtgaattagcggtgtaggatgggctcgcgtccaattagctagttggtgaggtaacggcccaccaaggcgacgattggtagccgacttgagagagtgatcggccacactggaactgagacacggtccagactcctacgggaggcagaagtggggaatattgggcaatggaggaaactcttacccagcaatgccgcgtgagggatggaggtcctatggattgtaaaactctgttgtttggaaagaatgataagatgaggaaatgcatcttatttgacggtaccattcaagaaa

SEQ ID NO: 2041 - DNA, 490 bp, Unknown
  Ascusbbf_66930, encodes 16S rRNA
agagtttgatcatggctcagattgaacgctagcggcatgcttaacacatgcaagtcgaacggtaacaggtctagcttgctagatgctgacgagtggcggacgggtgagtaatgcgcaggaatctgccttatagtgggggataacttggggaaacttaagctaataccgcatgtgccttacgaggtaaagcaggggactttcgggccttgtgctataagatgagcctgcgtcggattagctagttggtggggtaaatgcctaccaaggcgacgatccgtagctggtctgagaggatgatcagccacactgggactgagacacggcccagactcctacgggaggcagcagtggggaatattggacaatgggcgcaagcctgatccagcaatgccgcgtgtgtgaagaaggcctgcgggttgtaaagcactttcagtagggaggaaggatttaatgttaataccattaaatattgacgttacctacagaagaa

SEQ ID NO: 2042 - DNA, 490 bp, Unknown
  Ascusbbf_1799186, encodes 16S rRNA
agagtttgatcctggctcaggatgaacgctagcgagaggcctaacacatgcaagtcgaggggtaacaggggagcttgctcccgctgacgaccggcgcacgggtgagtaacgcgtatgcaacctgcccgccacagggggatagccttccgaaagggagattaagaccgcataagaccacgccggggcatcccggaggggtaaaatattcataggtggcggctgggcatgcgtgacattagctagttggcggggcaacggcccaccaaggcgacgatgtctaggggaactgagaggtcgatcccccacactggtactgagacacggaccagactcctacgggaggcagcagtgaggaatattggtcaatggagggaactctgaaccagccatctcgcgtgaaggaatacggccctacgggtcttaaacttcttttatagggggataaagtgggccacgtgtggtctattgcaggtaccctatgaataagcat

SEQ ID NO: 2043 - DNA, 490 bp, Unknown
  Ascusbbf_103472, encodes 16S rRNA
agagtttgatcatggctcaggacgaacgctggcggcgcgcctaacacatgcaagtcgaacggacttccggatttagaaacttcggtggacgaagaaggaagttagtggcgaacgggtgagtaacacgtgaggaacctgcctttaagagggggataacacttagaaataggtgctaataccgcataagaccacgctccggcatcgggaagcggtcaaaggagcgatccgcttaaagagggcctcgcgtccgattaggtagttggtgaggtaacggcccaccaagccgacgatcggtagccggactgagaggttgaacggccacattgggactgagacacggcccagactcctacgggaggcagcagtggggaatattgggcaatgggggaaaccctgacccagcgacgccgcgtgagggaagaaggtcttcggattgtaaacctctgtcttcggggacgatagtgactgtacccgaggaggaagccacggc

SEQ ID NO: 2044 - DNA, 490 bp, Unknown
  Ascusbbf_64497, encodes 16S rRNA
agagtttgatcatggctcagaacgaacgctggcggcgcgtcttaagcatgcaagtcgaatggcaaggggagcttgctccccctagaatggcggactggtgagtaacacgtgggtgacataccctacagttggggatagctactagaaatagtagataataccgaatacgattacaggatttaaaggcctgtaaggaaaggagcttcggctccgctgaaggattggctcgcggcccattagttagttggtgaggtaacggctcaccaaggcaatgatgggtatccggcctgagagggtgatcggacacattgggactgagatacggcccagactcctacgggaggcagcagctaagaatattccgcaatggacgaaagtctgacggagcgacgccgcgtggatgatgaaggccgaaaggttgtaaagtccttttgaattggaagaataagtattgtaggtaatgacagtatggtgacagtacaatttgaat

SEQ ID NO: 2045 - DNA, 490 bp, Unknown
  Ascusbbf_109340, encodes 16S rRNA
agagtttgatcatggctcaggattaacgctggcggcatgcctaatacatgcaagtcaaacgggaagcttcggcttctagtggcgaacgggtgagtaacacgtaggcaatctgtcctaaagattgggataacagttggaaacggctgataataccggataatagattaagtcgcatgacttgattttgaaagatgcaattgcatcacttttggaggagcctgcggcgcattagatagttggtgaggtaacggcccaccaagtcgatgatgcgtagctgcgctgagaggcgaaacagccacattgggactgagaacggcccaaactcctacgggaggcagcagtagggaattttcggcaatgggggaaaccctgaccgagcaatgccgcgtgaatgatgacgatcttcggattgtaaagttctgttgtagaggacgaatggtaggtagagtggaaagctatctatttgacggtactttactagaaagccccg

SEQ ID NO: 2046 - DNA, 490 bp, Unknown
  Ascusbbf_862606, encodes 16S rRNA
agagtttgatcatggctcaggatgaacgctagcggcaggcttaacacatgcaagtcgaggggtaacgcggtgtagcaatacactggcgacgaccggcgcacgggtgcgtaacgcgtatgcaacctacctgtaacaggggtataacggggtgaaaatcccactaatcccccatattgttggagattcgcatgattttccaacgaaaggttattctggttacagatgggcatgcgtgacattagctagttggtagggcaacggcctaccaaggcgacgatgtctaggggagctgagaggcttatcccccacactggtactgagacacggaccagactcctacgggaggcagcagtgaggaatattggtcaatggacggaagtctgaaccagccatgccgcgtggaggaagaaggtcctatgggttgtaaactccttttgttcgagagtaataagaggcttgcgagcctcgatgagagtatcggacgaataag

SEQ ID NO: 2047 - DNA, 490 bp, Unknown
  Ascusbbf_74329, encodes 16S rRNA
agagtttgatcatggctcagaacgaacgctggcggcgcgtcttaagcatgcaagtcggacggcaagatgagagcttgctcttatcctagagtggcggactggtgagtaacgcgtgggtgacgtaccctccggacggggatagctcctagaaataggaggtaataccggatacggtgcactgtgtcagaggcagtgcaggaaaggaacttttgttccgccggaggagcggcccgcgtgctattagcttgttggcggggtaacggcccaccaaggcgacgatagctacccggcctaagagggtgatcgggcacattgggactgagatacggcccagactcctacgggaggcagcagctaagaatattccgcaatgggggaaaccctgacggagcgacgccgcgtggacgatgaaggccggaaggttgtaaagtccttttaagtacgaggaataaggaaagtgagagaaacgctttctggtgacggtagtgct

SEQ ID NO: 2048 - DNA, 490 bp, Unknown
  Ascusbbf_50127, encodes 16S rRNA
agagtttgatcatggctcaggatgaacgctggcggcgtgcttaacacatgcaagtcgaacgaagcaattcgattcaaagcttcggcagcgaagagaattgacttagtggcggacgggtgagtaacgcgtgggtaacctgcctcaagctgggggataacagttagaaatgactgctaataccgcataagaccccggtaccgcatggtacagaggtaaaagatttatcggcctgagatggacccgcgtctgattagctagttggtgaggtaacggcccaccaaggctgcgatcagtagccgacctgagagggtgatcggccacattgggactgagacacggcccaaactcctacgggaggcagcagtggggaatattgcacaatgggggaaaccctgatgcagcgacgccgcgtgagtgaagaagtatttcggtatgtaaagctctttaagcagggaagataatgacggtacctgcagaataagcaccggct

SEQ ID NO: 2049 - DNA, 490 bp, Unknown
  Ascusbbf_110581, encodes 16S rRNA
agagtttgatcatggctcaggacgaacgctggcggcgtgcttaacacatgcaagtcgaacggggtccaaccggtcgcaagaccggggaagaccgagtggcgaacgggtgcgtaacacgtgagaaacctgtcccggactctggaataacagtcggaaacgactgctaataccggatgccgtcggagcgtcgcatggcgcactgacgaaagtgttagcggttcgggagggtctcgcggcctatcagcttgttggtgaggtaacggctcaccaaggcatcgacgggtagctggtctgagaggatgatcagccacactgggactgagacacggcccagactcctacgggaggcagcagtggggaatcttgcacaatgggcgaaagcctgatgcagcaacgccgcgtgcgggaagaaggccctagggttgtaaaccgctttcagcagggaagaaaatgacggtacctgcagaagaaggtgcggccaactacgtgc

SEQ ID NO: 2050 - DNA, 490 bp, Unknown
  Ascusbbf_386387, encodes 16S rRNA
agagtttgatcctggctcaggacgaacgctggcggcgtgcttaacacatgcaagtcgaacgaggatcatttggaagcttgcttccgggtgattcgagtggcggacgggtgagtaacgcgtgaggaacctgtctcatacagggggataacgcatcgaaagatgtgctaataccgcataggaccacagcatcgcatggtgcaggggtgaaaggaggaatccggtatgaggtggactcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgcaagcctgacccagcaacgccgcgtgagggaagaaggttttcggattgtaaacctctgtcctatgcgaagagtgagagacggtagcataggaggaagccccggctaacta

SEQ ID NO: 2051 - DNA, 490 bp, Unknown
  Ascusbbf_1499256, encodes 16S rRNA
agagtttgatcatggctcaggatgaacgctagctacaggcttaacacatgcaagtcgagcggaacaccttcgggtgtttagcggcagacgggtgagtaacacgtatccaacctttcccttactcgggtatagcctcgggaaactgagagtaatccccgatgtggtgcacggaaagcattttttgcgcacgaaagattaatcggtaaggggtggggatgcgttccattaggtagtaggcggggtaacggcccacctagccgatgatggataggggttctgagaggaaggtcccccacattggaactgcgacacggtccaaactcctacgggaggcagcagtgaggaatattggtcaatgggcgagagcctgaaccagccaagtagcgtgcaggacgactgccctgtgggttgtaaactgcttttatcagggaataaagtgcggcacgtgtgccgttttgtatgtaccagatgaataaggaccggctaattc

SEQ ID NO: 2052 - DNA, 490 bp, Unknown
  Ascusbbf_142298, encodes 16S rRNA
agagtttgatcctggctcaggacgaacgctggcggcgtgcttaacacatgcaagtcgaacgaggtccagggagcttgctcccgaagacctagtggcgaacgggtgcgtaacacgtgagaaacctgccccggacttgggaataacagtcggaaacgactgctaataccgaataccgtcggagcgtcgcatggcgcatcgacgaaagcttttgcggtctgggagggtctcgcggcctatcagcttgttggtgaggtaacggctcaccaaggcatcgacgggtagctggtctgagaggatgatcagccacactgggactgagacacggcccagactcctacgggaggcagcagtggggaatcttgcacaatgggcgaaagcctgatgcagcaacgccgcgtgcgggaagaaggccctagggttgtaaaccgctttcagcagggaagaaaatgacggtacctgcagaagaaggtgcggccaactacgtgccagc

SEQ ID NO: 2053 - DNA, 490 bp, Unknown
  Ascusbbf_141568, encodes 16S rRNA
agagtttgatcatggctcagaacgaacgctggcggcgcgttttaagcatgcaagtcgagcggcagtagcaatacgagagcggcggacgggtgagtaacacgtgggtaatccgccttccagtcggggatagcctgtggaaacacaggataataccggatgcgatgtccaccacacaagtggaggacaggaaaggggccaaggccccgctgggagatgagcccgcgtcccattagcttgatggtgaggtaaaggcccaccatggcgatgatgggtagccggcctgagagggtgaacggccacattggaactgagacacggtccagactcctacgggaggcagcagctaagaatcttccacaatggacgaaagtctgatggagcgacgccgcgtgggcgatgaaggccgtgaggttgtaaagcccttttcttgagggggaataaacggaccagggaatgggtccgcgatgacgtgaatcaaggaataagcccc

SEQ ID NO: 2054 - DNA, 490 bp, Unknown
  Ascusbbf_726969, encodes 16S rRNA
agagtttgatcatggctcagaacgaacgctggcggcgcgtcttaagcatgcaagtcgagcgggattatccagcttgctggatatgagagcggcggactggtgagtaacgcgtgggtgacgtgcccttctgcccgggatagccggtagaaataccggataataccggatgagctccgcggcgctggaggccgcggaggaaaggagctattgttccgcggaaggagcggcccgcgtcccatcagctggttggcggggaaaaggcccaccaaggcgatgacgggtacccggcctcagagggcgaccgggcacattgggactgagatacggcccagactcctacgggaggcagcagctaagaatattccgcaatgggggaaaccctgacggagcgacgccgcgtggacgacgaaggccggaaggttgtaaagtccttttgtggctgaggaagaagggcaggtcggaagcctgtccggtgactgtaggccatgaa

SEQ ID NO: 2055 - DNA, 490 bp, Unknown
  Ascusbbf_189702, encodes 16S rRNA
agagtttgatcatggctcaggatgaacgctggcggcgtgcctaatacatgcaagtcgaacgaggtggatgggagcttgctccttgataccgagtggcgaacgggtgagtaacacgtaggtaacctaccttacagtttgggatacccgagggaaaccttggctaataccggataattctttaggaggcatctcctgaagctaaaaggggctccaaagcctcgctgaaagatggacctgcggcgcattagctagttggtgagataacagcccaccaaggcgaggatgcgtagccgacctgagagggtgaacggccacactggaactgagacacggtccagactcctacgggaggcagcagtagggagttttcggcaatgggggaaaccctgaccgagcaacgccgcgtgagtgatgaaggtcttcggattgtaaagctctgttgtaggggaagaatgatagcttgaggaaatgctagctatttgacggtacc

SEQ ID NO: 2056 - DNA, 490 bp, Unknown
  Ascusbbf_281979, encodes 16S rRNA
agagtttgatcatggctcaggatgaacgctggcggcgtgcttaacacatgcaagtcgaacgaagcactttttcttcttcggaagagaaagtgactgagtggcggacgggtgagtaacgcgtgggtaacctgccttatacagggggataacagttggaaacgactgctaataccgcataagccaacgaggccgcatggcctagttggaaaagatttatcggtataagatggacccgcgtctgattagctagttggtgaggtaacggcccaccaaggcgacgatcagtagccggcttgagagagtgaacggccacattgggactgagacacggcccaaactcctacgggaggcagcagtggggaatattgcacaatgggggaaaccctgatgcagcaacgccgcgtgaaggaagaagtatttcggtatgtaaacttctatcagcaggaaagaaaatgacggtacctgactaagaagccccggctaactacgt

SEQ ID NO: 2057 - DNA, 490 bp, Unknown
  Ascusbbf_715191, encodes 16S rRNA
agagtttgatcatggctcaggatgaacgctggcggcgtgcctaacacatgcaagtcgagcgagaaacttttgactgacgcttcggttgatttcaaaagcggaaagcggcggacgggtgagtaacgcgtaggcaacctgccctttgcagagggatagcctcgggaaaccgggattaaaacctcataacaccggagtacctcatggtgcaccggtcaaagatttatcggcagaggatgggcctgcgtctgattagctggttggtggggtaacggcctaccaaggcaatgatcagtagccgacctgagagggtgatcggccacattggaactgagacacggtccaaactcctacgggaggcagcagtggggaatattgcacaatgggcgaaagcctgatgcagcaacgccgcgtgagcgatgaaggcggattcgtcgtaaagctctgtccttggggaagaagaactgacggtacccttggaggaagccccggc

SEQ ID NO: 2058 - DNA, 490 bp, Unknown
  Ascusbbf_1741831, encodes 16S rRNA
agagtttgatcatggctcaggatgaacgctagcggcaggcttaacacatgcaagtcgaggggcatcgcgggggtagcaatacacctggcggcgaccggcggaagggtgcgtaacgcgtgagcaacatgcccgtcacagggggataacagatggaaacgtctcctaataccccgtaacatcttgggtggcatcatctgaggttgaaagctattatgcggtgacggattggctcgcgtgacattagctagttggagtggtaacggcacaccaaggcgacgatgtctaggggttctgagaagaaggtcccccacactggaactgagacacggtccagactcctacgggaggcagcagtgaggaatattggtcaatgggcggaagcctgaaccagccatgccgcgtgaaggaataaggtcctatggatcgtaaacttcttttgtacgggagcaataagggcgtcgagacgtccgatgagagtaccgtacgaata

SEQ ID NO: 2059 - DNA, 490 bp, Unknown
  Ascusbbf_320610, encodes 16S rRNA
agagtttgatcctggctcaggatgaacgctggcggcgtgcctaacacatgcaagtcgagcggagatatgcaccggaagaagattcgtctgattccaccgcgtatcttagcggcggatgggtgagtaacacgtggacaacctacccataactgggggatagcagttggaaacgactgataataccgcatatgctcacgggaccgcatggtccagggaggaaagatttatcggttatggatgggtccgcgtcggattaactagttggtgaggtaacggcccaccaaggtgatgatccgtagccggcctgagagggcgaccggccacattgggactgagacacggcccagactcctacgggaggcagcagtggggaatattgcacaatgggcgcaagcctgatgcagcgacgccgcgtgaaggaagaagtactccggtatgtaaacttctatcagcagggaagaagatgacggtacctgactaagaagccccg

SEQ ID NO: 2060 - DNA, 490 bp, Unknown
  Ascusbbf_715599, encodes 16S rRNA
agagtttgatcctggctcaggatgaacgctggcggcgtgcctaacacatgcaagtcgagcggagatgtcacaccggaagaagattcgtctgaatccaccgtgacattcttagcggcggatgggtgagtaacacgtggacaacctacccaggacagggggataacaaccggaaacgggtgctaataccgcatagattgtcggaccgcatgatctgacaaggaaagatttatcggttctggatgggtccgcgtcggattaactagttggtgaggtaacggcccaccaaggtgatgatccgtagccggcctgagagggcgaccggccacattgggactgagacacggcccagactcctacgggaggcagcagtgggggatattgcacaatgggggaaaccctgatgcagcgacgccgcgtgaaggaggaaatacttcggtatgtaaacttctatcagcagggaagaagatgacggtacctgactaagaagccc

SEQ ID NO: 2061 - DNA, 490 bp, Unknown
  Ascusbbf_83139, encodes 16S rRNA
agagtttgatcctggctcaggatgaacgctggcggcgtgcctaacacatgcaagtcgaacggaccttattacgacagagacttcggtcgaagaaattttaaggttagtggcggacgggtgagtaacgcgtggagaacctgccctgtactgggggataacagtgagaaattactgctaataccgcataagcgcacgggaccgcatggtcctgagtgaaaaactccggtggtacaggatggctccgcgttggattagccagttggcggggtaacggcccaccaaagcgacgatccatagccggcctgagagggtgaacggccacattgggactgagacacggcccagactcctacgggaggcagcagtggggaatattgcacaatggggggaaccctgatgcagcgacgccgcgtgaaggaagaagtatctcggtatgtaaacttctatcagcagggaagaaaatgacggtacctgactaagaagccccggc

SEQ ID NO: 2062 - DNA, 354 bp, Unknown
  Ascusbbf_188005, encodes 16S rRNA
agagtttgatcctggctcaggacgaacgctggcggcgtgcttcatacatgcaagtcgaacgagaatctctagcttgctagagaggaaagtggcggacgggtgagtaaaatgtagagaatctgcccttgagagggggacaacagttggaaacggctgctaataccccatatgagcgtacctgagatggtattcttgaaaactccggtgctcaaggatgagtctgcatctgattagctagttggcggggtaatggcccaccaaggcgacgatcagtagctggtttgagaggatgatcagccacaatgggactgagacacggcccatactcctacgggagccagcagccgcggtaat

SEQ ID NO: 2063 - DNA, 490 bp, Unknown
  Ascusbbf_1558883, encodes 16S rRNA
agagtttgatcctggctcagaacgaacgctggcggcaggcttaacacatgcaagtcgagcgggcccttcggggtcagcggcagacgggtgagtaacgcgtgggaacgtaccatttgctacggaataactcagggaaacttgtgctaataccgtatgagcccccctttaaaatttcaggaatcataaaatgccctggcattttatgggggggaaagatttatcggcaaatgatcggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaact

SEQ ID NO: 2064 - DNA, 490 bp, Unknown
  Ascusbbf_7341, encodes 16S rRNA
agagtttgatcatggctcagaacgaacgctggcggcgcgtcttaagcatgcaagtcgagcggtaagttatagcttgctataacctagagcggcggactggtgagtaacgcgtgggtgacgtacccttttgacggggatagcctgtggaaacacagggtaataccggataagctcgtatgtgtcagaggcatacgaggaaaggttcttttgaaccgcgaaaggagcggcccgcgtgctattagttagttggcggggtaacggcccaccaagacgacgatagctacccggcctaagagggtgaacgggcacattgggactgagatacggcccagactcctacgggaggcagcagctaagaatattccgcaatggacgaaagtctgacggagcgacgccgcgtggatgatgaaggccggaaggttgtaaaatccttttgggagcgaggaataatgaaagtgagagaaacgctttcaggtgacggtagcttctg

SEQ ID NO: 2065 - DNA, 490 bp, Unknown
  Ascusbbf_33567, encodes 16S rRNA
agagtttgatcatggctcaggatgaacgctggcggcgtgcttaacacatgcaagtcgaacgaggaataattgatgaagttttcggatggatttgattattccgagtggcggacgggtgagtaacgcgtgggtaacctgccccatacagggggacaacagagggaaacttctgctaataccgcataagcggatcggatggcatcgtccggttcggaaagctccggcggtatgggatgggcccgcgttggattaggcagttggcggggtaacggcccaccaaaccgacgatccatagccgacctgagagggtgaccggccacattgggactgagacacggcccagactcctacgggaggcagcagtggggaatattgcacaatgggcgaaagcctgatgcagcgacgccgcgtgagtgaagaagtatttcggtatgtaaagctctatcagcagggaagaagatgacggtacctgcacaagaagctccggcta

SEQ ID NO: 2066 - DNA, 490 bp, Unknown
  Ascusbbf_282570, encodes 16S rRNA
agagtttgatcctggctcaggatgaacgctggcggcatgcctaagacatgcaagtcgaacgaagaggccctttgaaattggagtgcttgcacaaagatggatttggattttctcttagtggcagacgggtgagtaacgcgtgggtaatctacctcaaagactgggataacttctggaaacggacgctaataccggataacacatatttagataactagatatgttaaaaggtgcttcggcatcactttgagatgagcttgcgttgtattagctagttggtggggtaatggcctaccaaggcaacgatgcatatccgagctgagaggctgatcggacacattgggactgagacacggcccagactcctacgggagacagcagttaggaatattcgtcaatgggggaaaccctgaacgagcaatgccgcgtgaatgatgacaatcctctggattgtaaaattctgttgtaaaggacgaacccttactatagg

SEQ ID NO: 2067 - DNA, 490 bp, Unknown
  Ascusbbf_37803, encodes 16S rRNA
agagtttgatcctggctcaggacgaacgctggcggcgtgcctaacacatgcaagtcgaacggagtgttgcgctgaattgatagcagcttgctgaaggattttcttgtaacacttagtggcggacgggtgagtaacgcgtgagcaacctgccttacagagggggacaacattgggaaaccgatgctaataccgcataacgtgcagacgggacatcccgactgtaccaaaggagcaatccgctgtaagatgggctcgcgtccgattagatagttggaggggtaacggcccaccaagtcgacgatcggtagccggactgagaggttgaacggccacattgggactgagacacggcccagactcctacgggaggcagcagtgggggatattgcacaatggaggaaactctgatgcagcaacgccgcgtgagggaagaaggttttcggattgtaaacctctgtttttagtgacgaaacaaatgacggtagctaaa

SEQ ID NO: 2068 - DNA, 490 bp, Unknown
  Ascusbbf_85601, encodes 16S rRNA
agagtttgatcctggctcaggacgaacgctggcggcgtgcttaacacatgcaagtcgaacgaagctctcacactcgagttttcggacaagagagtgagatgacttagtggcggactggtgagtaacgcgtgagcaacctgccctccggtgggggacaacagctggaaacggctgctaataccgcatgatgtgtatggaccgcatgatctgtacaccaaagctttatgtgccggaggatgggctcgcgtctgattaggtagttggtggggtaacggcctaccaagccgacgatcagtagccggactgagaggttgaacggccacattgggactgagatacggcccagactcctacgggaggcagcagtggggaatattgggcaatggacgaaagtctgacccagcaacgccgcgtgaaggaagaaggtcttcggattgtaaacttctttgacagaggacgataatgacggtactctgaaaacaagccacgg

SEQ ID NO: 2069 - DNA, 490 bp, Unknown
  Ascusbbf_29038, encodes 16S rRNA
agagtttgatcatggctcaggacgaacgctggcggcgtgcctaacacatgcaagtcgaacggagttttacgctgaaattgagattagcttgctaaaggatatttcttgtaacacttagtggcggacgggtgagtaacgcgtgaggaacctgccttacagagggggacaacagttggaaacgactgctaataccgcataacatagcgagaggacatcctcttgttatcaaaggagcaatccgctgtaagatggcctcgcgtccgattagatagttggtgaggtaacggcccaccaagtctacgatcggtagccggactgagaggttgaacggccacattgggactgagacacggcccagactcctacgggaggcagcagtgggggatattgcacaatggaggaaactctgatgcagcaacgccgcgtgagggaagaaggttttcggattgtaaacctctgtttttggtgaagaaacaaatgacggtagcca

SEQ ID NO: 2070 - DNA, 490 bp, Unknown
  Ascusbbf_179401, encodes 16S rRNA
agagtttgatcatggctcaggacgaacgctggcggcgtgcttaacacatgcaagtcgaacgaggctgtattgggagcttgcttttgatacagccgagtggcggacgggtgagtaacgcgtgagcaacctgtctcatacagggggataacgcaccgaaaggtgtgctaataccgcataagaccacagcctcgcatgggggaggggtcaaaggaggaatccggtatgaggtgggctcgcgtctgattagatagttggtgaggtaacggcccaccaagtcaacgatcagtagccgacctgagagggtgatcggccacattggaactgagagacggtccaaactcctacgggaggcagcagtggggaatattgggcaatgggcgcaagcctgacccagcaacgccgcgtgagggaagaaggttttcggattgtaaacctctgtcctgaatgaaaaggagtagatggtaattcaggaggaagccccggctaacta

SEQ ID NO: 2071 - DNA, 490 bp, Unknown
  Ascusbbf_108191, encodes 16S rRNA
agagtttgatcctggctcaggacgaacgctggcggcgtgcttcatacatgcaagtcgaacgataaggcaccttcgggtgtacataagtggcggacgggtgagtaaaatgtagagaatctgccctagagagtgggacaacagagggaaacttctgctaataccgcatatgcgcgtagctgagatgctattcgtgaaaactccggtgctctgggatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatggggggaaccctgacgcagcaacgccgcgtgaccgaagaagcccttcggggtgtaaaggtctgtcagtggggacgaaaaatgacggtacccacagaggaagcatcggctaactccgtgccagcagccgcg

SEQ ID NO: 2072 - DNA, 490 bp, Unknown
  Ascusbbf_20388, encodes 16S rRNA
agagtttgatcatggctcaggatgaacgctagcggcaggcttaacacatgcaagtcgaggggcagcgtggagtagcaatactctgacggcgaccggcgaaagggtgagtaacgcgtgagcaacatgcccgatagtggaggatagtcgatggaaacgtcgcgtaatactccgtaacacagggaaccgcatgattttctgttaatagatttatcgctatcggattggctcgcgtaccattagctagttggcggggtaacggcccaccaaggcgacgatggttaggggttctgagaggaaggtcccccacattggaactgagacacggtccagactcctacgggaggcagcagtgaggaatattggacaatggccggaaggctgatccagccatgccgcgtgcgggaagacggccctatgggttgtaaaccgcttttgttggggagcaataagtcctacgtgtaggatgatgagagtacccagcgaataagca

SEQ ID NO: 2073 - DNA, 490 bp, Unknown
  Ascusbbf_25166, encodes 16S rRNA
agagtttgatcatggctcaggacgaacgctggcggcgtgcctaacacatgcaagtcgaacggagctgaagagcttgcttttcagcttagtggcggacgggtgagtaacgcgtgagtaacctgcctccgagagtggaataacgttttgaaaagaacgctaataccgcataaagcacaagagtcgcatggctaatgtgccaaagattttatcgctcggagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggaaaccctgacgcagcaacgccgcgtgaaggatgaaggttttcggattgtaaacttcttttatcagggacgaaaaacgacggtacctgaagaataagctccggctaactacgtgccagca

SEQ ID NO: 2074 - DNA, 490 bp, Unknown
  Ascusbbf_70668, encodes 16S rRNA
agagtttgatcctggctcaggatgaacgctagcggcaggcttaacacatgcaagtcgaggggcagcggggcccagcaatgggctgccggcgaccggcgcacgggtgcgtaacgcgtatgcaacctgcccgcgacagggggataaccggtggaaacgccgactaataccccgtaatgcactaagtcgcatggcttggtgctgaaagcttcggtggtcgcggatgggcatgcgtggcattaggtagttggcggggcaacggcccaccaagcctacgatgcctaggggagctgagaggctaatcccccacactggtactgagacacggaccagactcctacgggaggcagcagtgaggaatattggtcaatgggcggaagcctgaaccagccatgccgcgtgtgggaagaaggccctatgggttgtaaaccacttttagccgggagtaataaggggcgtgcgcgccccgatgagagtaccggcggaataagca

SEQ ID NO: 2075 - DNA, 490 bp, Unknown
  Ascusbbf_13626, encodes 16S rRNA
agagtttgatcatggctcaggacgaacgctggcggcgtgcctaacacatgcaagtcgaacggactgattcccttcggggatgaaagtcagtggcggatgggtgagtaacgcgtgaggaacctgcctctcagagggggataacgtttggaaacgaacgctaataccgcataacgcttttgtaccgcatgatacggaagccaaaggagcgatccgctgagagatggcctcgcgtctgattagatagttggtgaggtaacggcccaccaagtcgacgatcagtagccggactgagaggttgaacggccacattgggactgagacacggcccagactcctacgggaggcagcagtgagggatattgcacaatgggcgaaagcctgatgcagcaacgccgcgtgagggaagacggttttcggattgtaaacctctgttccggggaaggaagacagtgacctacccgggagcaagccacggctaactacgtgccag

SEQ ID NO: 2076 - DNA, 490 bp, Unknown
  Ascusbbf_28027, encodes 16S rRNA
agagtttgatcatggctcaggatgaacgctggcggcgcgcctaacacatgcaagtcgaacggtgatactttcttcggaaagaggatcagtggcgaacgggtgagtaacgcgtgggtaacctgcccttgacacagggatagcaaagggaaacttttggtaatacctgatgacctcaaaaagtgacatctctttttgagcaaagaatttcggtcgaggatggacccgcgtcccatcagctagatggcggggtaacggcccaccatggcaattacgggtagccggactgagaggtcgatcggccacattgggactgagacacggcccagactcctacgggaggcagcagtggggaatattgcgcaatgggggaaaccctgacgcagcgacgccgcgtgcgggatggaggccttcgggctgtgaaccgctttcggtggggaggaaattgaccgtacccacataagaagccccggctaactacgtgccagcagcc

SEQ ID NO: 2077 - DNA, 490 bp, Unknown
  Ascusbbf_101197, encodes 16S rRNA
agagtttgatcctggctcaggatgaacgctagcggcaggcctaacacatgcaagtcgaggggtatatagtgcttgcactatagagaccggcgcacgggtgcgtaacgcgtatgcaacctaccttttacagggggatagcccggagaaatccggattaataccccatagtattgagtgccagcattggaattcaattaaagatttatcggtaaaagatgggcatgcgtcctattagctagttggtatggtaacggcataccaaggcaatgataggtaggggccctgagagggggatcccccacactggtactgagacacggaccagactcctacgggaggcagcagtgaggaatattggacaatgggcgagagcctgatccagccatgccgcgtgcaggaagactgccctatgggttgtaaactgcttttatacaggaagaataagaggcacgtgtgctttgatgacggtactgtatgaataagcatcggc

SEQ ID NO: 2078 - DNA, 490 bp, Unknown
  Ascusbbf_549008, encodes 16S rRNA
agagtttgatcctggctcaggatcaacgctggcggcgtgcctaatgcatgcaagtcgagcggggtgatcttcggatcacttacgcggcggacgggtgcggaacacgtgggcaacctgccccgaggtgggggatagccggtggaaacaccgggtaattccgcatgaggtcactggtcgggagacgagtgaggaaagggtcttcggactcgccttgggaggggcctgcggccgattagctagacggtggggtaacggcctaccgtggcgatgatcggtagctggtctgagaggacggccagccacacggggactgagacacggccccgactcctacgggaggcagcagcaaggaatcttccgcaatgggcgaaagcctgacggagcaacgccgcgtgtgggatgacgcctttcggggtgtaaaccacttttctcagggaagaagcactgacggtacctgaggaagaaggaccggctaactacgtgccagcag

SEQ ID NO: 2079 - DNA, 490 bp, Unknown
  Ascusbbf_30047, encodes 16S rRNA
agagtttgatcctggctcagaacgaacgctggcggcgcgttttaagcatgcaagtcgagcggcagcagcaatgcgagagcggcggacgggtgagtaacacgtgggtaatctgccctccggtcgggaatagcctgtggaaacacaggataataccggatgcgatggccaccacacaagtggaggtcaggaaaggagccaaggctccgccggaggatgagcccgcgtcccattagcttgatggtgaggtaaaggcccaccatggcgatgatgggtagccggcctgagagggtgaacggccacattggaactgagacacggtccagactcctacgggaggcagcagctaagaatcttccacaatggacgaaagtctgatggagcgacgccgcgtgggcgatgaaggccgtgaggttgtaaagcccttttcttgagggggaataagtccggcagggaatggccggatgatgacgtgaatcaaggaataagcccc

SEQ ID NO: 2080 - DNA, 490 bp, Unknown
  Ascusbbf_50534, encodes 16S rRNA
agagtttgatcatggctcaggacgaacgctggcggcgtgcttaacacatgcaagtcgaacgaggtttattgaagagcttgctctgaggtagaccgagtggcggacgggtgagtaacgcgtgaggaacctgtcttacacagggggataacgcaccgaaaggtgtgctaataccgcataagaccacactttcgcatggaagaggggtcaaaggagcgatccggtgtaaggtggactcgcgtcccattaggcagttggcggggtaacggcccaccaaaccgacgatgggtagccgacctgagagggtgatcggccacattggaactgagacacggtccaaactcctacgggaggcagcagtggggaatattgggcaatgggcgcaagcctgacccagcaacgccgcgtgagggaagaaggttttcggattgtaaacctctgtcctcgatgaaaaggagaagatggtaattgaggaggaagccccggctaacta

SEQ ID NO: 2081 - DNA, 490 bp, Unknown
  Ascusbbf_303159, encodes 16S rRNA
agagtttgatcctggctcaggacgaacgctggcggcgtgcttaacacatgcaagtcgaacgaagcttgatttcagatttcttcggaatgacgaatgatatgactgagtggcggacgggtgagtaacgcgtgagcaacctgcccttcagagggggatagcgtctggaaacggacggtaataccgcataacgtgcgaggaaggcatctttcttgtaccaaagatttatcgctgagggatgggctcgcgtctgattagatagttggtggggtaacggcctaccaagtcgacgatcagtagccggactgagaggttgaacggccacattgggactgagacacggcccagactcctacgggaggcagcagtggggaatattgcacaatgggcgcaagcctgatgcagcaacgccgcgtggaggaagacggttttcggattgtaaactcctgttcttaaggaagaagaaagtgacggtacttaaggagcaagccac

SEQ ID NO: 2082 - DNA, 490 bp, Unknown
  Ascusbbf_52307, encodes 16S rRNA
agagtttgatcatggctcaggatgaacgctggcggcgtgcttaacacatgcaagtcgaacggttaaaccgccttcgggcggacatagagtggcgaacgggtgagtaacacgtgaccaacctgccccgcgcaccgggacagccccccgaaagggggattaataccggatactccggcggccccgcatggggcggccgggaaggctccggcggcgcgggatggggtcgcggcccatcaggtagtaggtcgggtagaggccgacctagccgacgacgggtagccgggttgagagaccgaccggccacattgggactgagatacggcccagactcctacgggaggcagcagtggggaatattgcgcaatgggggaaaccctgacgcagcaacgccgcgtgcgggatgacggccttcgggttgtaaaccgctttcagcagggaagacatcgactgtacctgcacaagaagccccggctaactacgtgccagcagc

SEQ ID NO: 2083 - DNA, 490 bp, Unknown
  Ascusbbf_5721, encodes 16S rRNA
agagtttgatcatggctcaggatgaacgctggcggcgtgcttaacacattcaagtcgaacgggcgagaggaagcaattccttttgctagtggcggacgggtgagtaacgcgtgagcaacctacctttacgagtgggataacaattggaaacgattgctaataccgcataatgtatagataccgcatgatatctataccaaagaaaatcgcgtaaagatgggctcgcgtcccattagacagttggtgaggtaacggcccaccaaatctacgatgggtagccggactgagaggttgaacggccacattggaactgagaaacggtccagactcctacgggaggcagcagtggggaatattgggcaatgggcgaaagcctgacccagcgacgccgcgtgaaggaagaaggtcttcggattgtaaactttagtcaacagggaagaagaaagtgacggtacctgtagaggaagccacggctaactacgtgccagca

SEQ ID NO: 2084 - DNA, 490 bp, Unknown
  Ascusbbf_100583, encodes 16S rRNA
agagtttgatcatggctcaggacgaacgctggcggcgtgcctaacacatgcaagtcgaacggagtgttacgctgaaaccgagagcagcttgctgcaggaagtttcttgtaacacttagtggcggacgggtgagtaacgcgtgagcaacctgccttacagagggggacaacagttggaaacgactgctaataccgcataacatagcgagtgggcatccacttgttatcaaaggagcaatccgctgtaagatgggctcgcgtccgattagccagttggcggggtaacggcccaccaaagctacgatcggtagccggactgagaggttgaacggccacattgggactgagacacggcccagactcctacgggaggcagcagtgggggatattgcacaatggaggaaactctgatgcagcaacgccgcgtgagggaagaaggtcttcggattgtaaacctctgttttcggtgaagaaacaaatgacggtagccg

SEQ ID NO: 2085 - DNA, 490 bp, Unknown
  Ascusbbf_118811, encodes 16S rRNA
agagtttgatcctggctcaggacgaacgctggcggcatgcctaacacatgcaagtcgaacgagatagcaatatctagtggcgaacgggtgagtaacacgtgagcaatctgccccatatacagggataacagttagaaatgactgctaataccggataagaccacagcctggcatcgggcaggggtcaaagcgatttagcgatatgggatgagctcgcgtccaattagctagttggtgaggtaacggcccaccaaggcgacgattggtagccgacctgagagggtgatcggccacattggaactgagacacggtccaaactcctacgggaggcagcagtggggaatattgggcaatggaggaaactcttacccagcaatgccgcgtgagtgatgaaggtcctctggattgtaaaactctttgattagggacgaacgaatgacggtacctaaagaacaagccccggctaactatgtgccagcagccgcggta

SEQ ID NO: 2086 - DNA, 490 bp, Unknown
  Ascusbbf_1775092, encodes 16S rRNA
agagtttgatcatggctcaggatgaacgctggcggcgtgcctaacacatgcaagtcgagcggagtgcagtgtctaagaggcttcggccgaattaatctgtacttagcggcggatgggtgaggaacgcgtggagaacctgcccttcacagggggataacagttggaaacgactgttaataccgcatatgctcacagtgccgcatggcacagggaggaaagcctagacggtgaaggatggctccgcgtcggattagccagttggcggggtaacggcccaccaaagcgatgatccgtagccggcatgagagggcgaccggccacattgggactgagacacggcccaaactcctacgggaggcagcagtgggggatattgcacaatggggggaaccctgatgcagcgacgccgcgtgaaggaggaagtgcttcggcatgtaaacttctatcagcagggaagaagatgacggtacctgcacaagaagccccggct

SEQ ID NO: 2087 - DNA, 490 bp, Unknown
  Ascusbbf_154105, encodes 16S rRNA
agagtttgatcatggctcagattgaacgctggcggcatgcttaacacatgcaagtcgaacggcagcacggtctagcttgctagatgggtggcgagtggcgaacgggtgagtaacgcgtaggaatatgccttaaagtttgggataacatggggaaactcatgctaataccggatgagctcttaggaggaaagctggggacctgcaagggcctggcgctttaagattagcctgcgtccgattagctagttggtggggtaagggcctaccaaggcgacgatcggtagctggtctgagaggatggccagccacactgggactgagacacggcccagactcctacgggaggcagcagtggggaatattggacaatggggggaaccctgatccagcaatgccgcgtgtgtgaagaaggcctgagggttgtaaagcactttcagtggggaggaggattgattggttaagagctgattaattggacgttacccacaga

SEQ ID NO: 2088 - DNA, 352 bp, Unknown
  Ascusbbf_1500877, encodes 16S rRNA
agagtttgatcctggctcaggacgaacgctggcggcgtgcttcatacatgcaagtcgaacgataaggtctcttcggagacacataagtggcggacgggtgagtaatgtgtagagaatctgccttagagtgggggacaacagttggaaacgactgctaataccgcatatgcgcgtacctgtgatggtattcgtgaaaactccggtgctctaagatgagtctgcatctgattagctagttgggggtgtaatggaccaccaaggcgacgatcagtagctggtttgagaggatgatcagccacaatgggactgagacacggcccatactcctacgggagccagcagccgcggtaat

SEQ ID NO: 2089 - DNA, 490 bp, Unknown
  Ascusbbf_130363, encodes 16S rRNA
agagtttgatcctggctcaggatgaacgctggcggcgtgcttaacacatgcaagtcgaacggttaaagcccacttcggtgggtgcataaagtggcgaacgggtgagtaacacgtgaccaacccgccccccgcaccgggataaccggcggaaacgcccgctaataccggatactccgcgacggccgcatggccgacgcgggaaagcccaggcggcgggggatggggtcgcggcccatcagctagacggcggggtgacggcccaccgtggcgactacgggtagccgggttgagagaccgaccggccacattgggactgagacacggcccagactcctacgggaggcagcagtggggaatattgcgcaatgggggaaaccctgacgcagcaacgccgcgtgcgggacgaaggccttcgggtcgtaaaccgctttcatcggggaagacgtcgactgtacccgaagaagaagccccggctaaatacgtgccagca

SEQ ID NO: 2090 - DNA, 490 bp, Unknown
  Ascusbbf_75878, encodes 16S rRNA
agagtttgatcctggctcaggatgaacgctggcggcgtgcttaacacatgcaagtcgaacggttaaaccggcttcggccggacatacagtggcgaacgggtgagtaacacgtgaccaacctgccccgcgctccgggacagccccccgaaagggggattaataccgggtactccgggaggggcgcatgccccgcccgggaaagcccaggcggcgcgggatggggtcgcggcccatcaggtagtaggcggggtagaggcccgcctagccgacgacgggtagccgggttgagagaccgaccggccacattgggactgagatacggcccagactcctacgggaggcagcagtggggaatattgcgcaatggggggaaccctgacgcagcaacgccgcgtgcgggatgacggccctcgggttgtaaaccgctttcagcagggaagacatcgactgtacctgcagaagaagccccggctaactacgtgccagcagc

SEQ ID NO: 2091 - DNA, 490 bp, Unknown
  Ascusbbf_194500, encodes 16S rRNA
agagtttgatcatggctcaggacgaacgctggcggcgtgcctaatacatgcaagtcgagcgctggatggtttccttcggggaattatccggagcggcggacgggtgagtaacacgtaggcaacctgcccggaagaccgggataactaccggaaacggtagctaataccggataggtggcttcttcgcatgggggagccaagaaacgcggagcaatctgcggcttacggatgggcctgcggcgcattagctagttggcagggtaacggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgaggaaggtcttcggatcgtaaagctctgttgccaaggaagaacggcccggagagtcactgctccgggagtgacggtact

SEQ ID NO: 2092 - DNA, 490 bp, Unknown
  Ascusbbf_197051, encodes 16S rRNA
agagtttgatcctggctcagaatgaacgctggcggcatggattaggcatgcaagtcgaacgggacaccctcgggtgtctagtggcgaaagggtgagtaacacgtgagcaacctgcccccgagtctggaataagcgatggaaacgtcgtctaataccggatgaggactggggtctcctgactccaactccaaagatttatcgcttggggatgggctcgcgtcccattagctagttggcggggtaatggcccaccaaggctgtgacgggtaggtggactgagaggttggtcacccacactgggactgagacactgcccagactcctacgggaggctgcagtcgagaatcttccgcaatgggcgcaagcctgacggagcgatgccgcgtgagggaagaaggccttcgggttgtaaacctctgtcacccgggacgaaaacaatgacggtaccgggagaggaagtcacggctaactacgtgccagcagccgcggt

SEQ ID NO: 2093 - DNA, 490 bp, Unknown
  Ascusbbf_259915, encodes 16S rRNA
agagtttgatcctggctcaggataaacgctggcggcgcacataagacatgcaagtcgaacggaagtcgttgtaatgatgttgacatgaacagagaacttgttcaaagggaatgaagattgacttacaacaatggctttagtggcggactggtgagtaacacgtaagcaacctgcctatcagaggggaataacagcgagaaatcgttgctaataccgcatatgccatataaaccacatggtttaagtgggaaaggagaaatccgctgatagatgggcttgcgtctgattagctagttggtgaggtaacggcttaccaaggcaacgatcagtagccggactgagaggttcaacggccacattgggactgagatacggcccagactcctacgggaggcagcagtcgggaatattgcgcaatggaggaaactctgacgcagtgacgccgcgtataggaagaaggttttcggattgtaaactattgtcgatgggg

SEQ ID NO: 2094 - DNA, 490 bp, Unknown
  Ascusbbf_37879, encodes 16S rRNA
agagtttgatcctggctcaggatgaacgctggcggcgtgcttaacacatgcaagtcgaacgaagcattaaggatgaagttttcggatggatttctttttgacttagtggcggacgggtgagtaacgcgtggggaacctgccgtatgcagggggacaacagttggaaacgactgctaataccgcataagcgcacggaaccgcatggttctgtgtgaaaagatttatcggcatacgatggccccgcgttggattaggtagttggtgaggtaacggcccaccaagccgacgatccatagccgacctgagagggtgaccggccacattgggactgagacacggcccaaactcctacgggaggcagcagtggggaatattgcacaatgggggaaaccctgatgcagcgacgccgcgtgagtgaggaagtatttcggtatgtaaagctctatcagcagggaagaagatgacggtacctgcataagaagccccggct

SEQ ID NO: 2095 - DNA, 490 bp, Unknown
  Ascusbbf_16312, encodes 16S rRNA
agagtttgatcatggctcaggatgaacgctggcggcgtgcttaacacatgcaagtcgaacggagatgtttacgacagagacttcggtcaaagaagtttgcatcttagtggcggacgggtgagtaacgcgtgggcaacctgccgtatgcagggggacaacagttggaaacgactgctaataccgcataagcgcacagtaccgcatggtacagtgtgaaaagatttatcggcatacgatgggcccgcgttggattaggtagttggcggagtaacggcccaccaagcctacgatccatagccgacctgagagggtgatcggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggc

SEQ ID NO: 2096 - DNA, 490 bp, Unknown
  Ascusbbf_69415, encodes 16S rRNA
agagtttgatcatggctcaggatgaacgctggcggcgtgcataacacattcaagtcgaacggacttaggggcttcggtcccgaaagttagtggcggacgggtgagtaacgcgtgagcaacctgcctccggaagagggataacagttggaaacgactgctaataccgcataacaccaaaccaccgcatgatggtctggtcaaaggagcaatccgaccggagatgggctcgcgtccgattagatagttggtgaggtaacggctcaccaagtcgacgatcggtagccggactgagaggttgaacggccacattggaactgagatacggtccagactcctacgggaggcagcagtggggaatattgggcaatgggcgcaagcctgacccagcgacgccgcgtgaaggaagaagatcttcggattgtaaactttagttatcagggaagaaaaaaatgacggtacctgaagagaaagccacggctaactacgtgcc

SEQ ID NO: 2097 - DNA, 490 bp, Unknown
  Ascusbbf_246777, encodes 16S rRNA
agagtttgatcctggctcaggacgaacgctggcggcgtgcctaatacatgcaagtcgagcggaccgatgggagcttgctcccttaggtcagcggcggacgggtgagtaacacgtgggtaacctgcctgtaagactgggataactccgggaaaccggggctaataccggatgcttgattgaaccgcatggttcaatcataaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacc

SEQ ID NO: 2098 - DNA, 483 bp, Unknown
  Ascusbbf_46626, encodes 16S rRNA
agagtttgatcatggctcaggattaacgctggcggcatgcctaatacatgcaagtcgaatgagaagcttgcttctcatggcgaacgggtgagtaacacgtaggtaacctgccttacactcgaggataaccgttggaaacgacggataatactggataggacaaagattcgcatgaatcgttgtttaaaagcaatggtgtatgaggggcctgcggtgcattagctagttggtgaggtaacggctcaccaaggcgatgatgcatagctggactgagaggttgaacagccacaatgggactgagaacggcccatactcctacgggaggcagcagtagggaattttcggcaatgggggaaaccctgaccgagcaatgccgcgtgaacgatgaagtatttcggtatgtaaagttcttttattaggaaagatagtgacggtacctaatgaataagctccggctaactacgtgccagcagccgcggtaat

SEQ ID NO: 2099 - DNA, 490 bp, Unknown
  Ascusbbf_158517, encodes 16S rRNA
agagtttgatcctggctcaggatgaacgctagcggcaggcttaacacatgcaagtcgaggggcagcgcggttgtagtaatacaattggcggcgaccggcgcaagggtgcgtaacgcgtgagcgacatgcccgtaaccgggggataaccgatggaaacgtcgcctaaccccccataacactggaggttgcatgattttcagttgaaaactttggtggttacggattggctcgcgtgacattaggtagacggcggggtaacggcccaccgtgccgacgatgtctaggggttctgagaggaaggtcccccacaatggaactgagacacggtccatactcctacgggaggcagcagtgaggaatattggtcaatgggcggaagcctgaaccagccatgccgcgtgcgggaagacggccctatgggttgtaaaccgcttttgagagggagcaataaggtggtcgtgcaccatcgatgagagtacctttcgaataa

SEQ ID NO: 2100 - DNA, 490 bp, Unknown
  Ascusbbf_6288, encodes 16S rRNA
agagtttgatcatggctcaggatgaacgctagcggcaggcttaacacatgcaagtcgaggggcagcgcgagtagcaatacttggcggcgaccggcgaaagggtgagtaacgcgtgagcaacatgcccggtactggaggatagtcgatggaaacgtcgcgtaatactccgtaacaacagtcttcgcatggggattgtttaagagatttatcgataccggattggctcgcgttccattagctagttggcggggtaacggcccaccaaggcgacgatggataggggttctgagaggaaggtcccccacattggaactgagacacggtccagactcctacgggaggcagcagtgaggaatattggtcaatggccgagaggctgaaccagccatgccgcgtgcgggaggacggccctatgggttgtaaaccgcttttttgtgggagcaataagtcttacgtgtaggacgatgagagtaccatgagaataagcatc

SEQ ID NO: 2101 - DNA, 490 bp, Unknown
  Ascusbbf_46350, encodes 16S rRNA
agagtttgatcatggctcaggatgaacgctggcggcgtgcataacacattcaagtcgaacgaagcattagaacggaagccttcgggcggaagatttaatgacttagtggcggacgggtgagtaacgcgtgagcaacctgcctgcttgtgagggataacacagggaaacttgtgctaataccgcatgacgcatagggatcgcatggtttttatgccaaagatttattgcaagcagatgggctcgcgtctgattagatagttggcagggtaacggcctaccaagtcgacgatcagtagccggactgagaggttgaacggccacattggaactgagagacggtccagactcctacgggaggcagcagtggggaatattgggcaatgggcgaaagcctgacccagcgacgccgcgtgagggaagaaggtcttcggattgtaaacctctttcagcaaggaagaagaaagtgacggtacttgcagaagaagccacg

SEQ ID NO: 2102 - DNA, 490 bp, Unknown
  Ascusbbf_1377645, encodes 16S rRNA
agagtttgatcctggctcaggatgaacgctagcggcaggcttaacacatgcaagtcgaggggcagcgcggggtagcaatactctggcggcgaccggcggaagggtgcgtaacgcgtgagcaacttgcccgtcactgggggataggcactggaaacggtgtgtaatactccataacatatggattcacatggatttatatttaaagattcgttggtgtcggatggtctcacgtaacattagctagtcggcggggtaacggcccaccgaggctacgatgtttaggggttctgagaggaaggtccacaacacggaaactgagaaacgggccagactcctacgggaggcagaagtgaggaatattggtcaatgggcggaagcctgaaccagccatgccgcgtgcaggaagaaggccctatgggtcgtaaactgcttttcctggagggcagtaagggtcacgagtggcccgatgagagtatcaggggaataagca

SEQ ID NO: 2103 - DNA, 490 bp, Unknown
  Ascusbbf_230598, encodes 16S rRNA
agagtttgatcctggctcagattgaacgctggcggcaggcttaacacatgcaagtcgagcggtaacaggagaagcttgcttctcgctgacgagcggcggacgggtgagtaatacttaggaatctacctagtagtgggggatagctcggggaaactcgaattaataccgcatacgacctacgggagaaagggggcaacttgttgctctcgctattagatgagcctaagtcggattagctagatggtggggtaaaggcctaccatggcgacgatctgtagctggtctgagaggatgatcagccacaccgggactgagacacggcccggactcctacgggaggcagcagtggggaatattggacaatgggggcaaccctgatccagccatgccgcgtgtgtgaagaaggccttttggttgtaaagcactttaagcagtgaagaagactccatggttaatacccatggacgatgacattagctgcagaataagc

SEQ ID NO: 2104 - DNA, 490 bp, Unknown
  Ascusbbf_195889, encodes 16S rRNA
agagtttgatcatggctcaggatgaacgctggcggcgtgcttaatacatgcaagtcgaacgaagcacctgcgacggatccccttcgggggagaagatgcttgtgacttagtggcggacgggtgagtaacgcgtgggtaacctgccttatgcagggggataacagttagaaatgactgctaataccgcataagcgcacggggccgcatggccgtgtgtgaaaagatttatcggcataagatggacccgcgtctgattaggtagttggtgaggtaacggcccaccaagcctgcgatcagtagccgacttgagagagtgatcggccacattgggactgagacacggcccagactcctacgggaggcagcagtagggaatattgcacaatgggggaaaccctgatgcagcgacgccgcgtgagtgaagaagtatttcggtacgtaaagctctatcagcagggaagataatgacggtacctgactaagaagcccc

SEQ ID NO: 2105 - DNA, 490 bp, Unknown
  Ascusbbf_5114, encodes 16S rRNA
agagtttgatcatggctcaggatgaacgctagcggcaggcttaacacatgcaagtcgaggggtaacagggcgtagcaatacgccgctgacgaccggcgcacgggtgcgtaacgcgtatacaacctacctgtaacagggggataacggagtgaaaactccactaataccccatattgacgagtcttcgcatgggggttcgtcgaaagcttcggtggttacggatgggtatgcgtgacattaggtagttggcggggcaacggcccaccaagccgacgatgtctaggggagctgagaggctagtcccccacactggtactgagacacggaccagactcctacgggaggcagcagtgaggaatattggtcaatggacggaggtctgaaccagccatgccgcgtgagggaagaaggtcctatgggttgtaaacctcttttgctccggagcaataaggcggatgcgtccgccgacgagagtacggggcgaataagc

SEQ ID NO: 2106 - DNA, 490 bp, Unknown
  Ascusbbf_157043, encodes 16S rRNA
agagtttgatcctggctcagaacgaacgctggcggtatgctttaaccatgcaagtcgaacgagaaagggtagcaatacccgagtaaagtggcaaacgggtgagtaacacacaggaatctacccagtagagaggaataagcgctggaaacggcgtctaataccacatactacgattttagaaatatcttcggaaagggttggtagcaatatcaattcgctattggatgagcctatgtcggattagctagttggtggggtaatggcctaccaaggcgatgatccgtagctgatctgagagggtgatcagccacactggaactgcgacacggtccagactcctacgggaggcagcaggtgggaatattggacaatgggcgaaagcctgatccagcaataccgcgtgaatgatgaaggccttcgggttgtaaagttcttttaatagggaagataatgacggtacctatagaataagcaccggcaaacttcgtgc

SEQ ID NO: 2107 - DNA, 490 bp, Unknown
  Ascusbbf_74466, encodes 16S rRNA
agagtttgatcatggctcaggatgaacgctagctacaggcttaacacatgcaagtcgaggggcagcatgaacttagcttgctaagtttgatggcgaccggcgcacgggtgagtaacacgtatccaacctgcccatgactcagggatagccctctgaaaggaggattaatacctgatgcggttgacgggggacatcccctttcaaccaaagattcatcggtcatggatggggatgcgtctgattaggcagtcggcggggtaacggcccaccgagccatcgatcagtaggggttctgagaggaaggtcccccacataggaactgagacacggtcctaactcctacgggaggcagcagtgaggaatattggtcaatggtcgagagactgaaccagccaagtagcgtgaaggatgactgccctatgggttgtaaacttcttttatgagggaataaagtgtgccacgcgtggcattttgcatgtacctcatgaat

SEQ ID NO: 2108 - DNA, 361 bp, Unknown
  Ascusbbf_460740, encodes 16S rRNA
agagtttgatcctggctcaggatgaacgctggcggcgtgcctaatacatgcaagtcgaacgagcgagatccagcttgctggatttagcgagtggcgaacgggtgagtaatacgtaagcaacctgcctacacggactgggataacacctggaaacgggcgctaataccggataggtaacgagagggcatcctcttgttattaaaggtttgaaacacaagtagatgggcttacggtgcattagctagttggtgaggtaacggcccaccaaggcgatgatgcatagccggcctgagagggtgaacggccacattgggactgagacacggcccagactcctacgggagccagcagccgcggtaat

SEQ ID NO: 2109 - DNA, 490 bp, Unknown
  Ascusbbf_213036, encodes 16S rRNA
agagtttgatcctggctcaggatgaacgctagcggcaggcttaacacatgcaagtcgaggggcagcgcggggtagcaatactctggcggcgaccggcggaagggtgcgtaacgcgtgagcaacatacccgtatcagggggataggagatggaaacgtcttataataccccataacaacagaagttgcatgacttttgtttgaaagattcattggatacggattggctcgcgtgacattagctagtcggcggggtaacggcccaccgaggcgacgatgtctaggggaactgagaggttggtcccccacactggaactgagacacggtccagactcctacgggaggcagcagtgaggaatattggtcaatgggcggaagcctgaaccagccatgccgcgtgcaggactaaggccctatgggtcgtaaactgcttttgacggggagcaataagggtgtcgtgacatccgatgagagtactcgtcgaataagca

SEQ ID NO: 2110 - DNA, 490 bp, Unknown
  Ascusbbf_195474, encodes 16S rRNA
agagtttgatcatggctcaggatgaacgctggcggcgtgcctaacacatgcaagtcgaacgaggtatatcggaatgagattcgtcgaaggaaggtataccgagtggcggatgggtgagtaacgcgtggagaacctgccctatgcagggggataacagctggaaacggctgacaataccgcataagcgcacgatgccgcatggcatagagcgaaaagatttatcggcataggatggctccgcgtcggattagccagttggcggggtaacggcccaccaaagcgacgatccgtagccggcctgagagggcgaccggccacattgggactgagacacggcccagactcctacgggaggcagcagtgggggatattgcacaatgggcgcaagcctgatgcagcgacgccgcgtggaggatgaagtatttcggtatgtaaactcctttcggcagggaagaaaacgacggtacctgcagaagaagccccggctaac

SEQ ID NO: 2111 - DNA, 490 bp, Unknown
  Ascusbbf_1445381, encodes 16S rRNA
agagtttgatcctggctcaggatgaacgctagcggcaggcttaacacatgcaagtcgaggggtaacacggggtagcaatactctggcgacgaccggcgcacgggtgcgtaacgcgtatgcaacctacctgtaacaggggtataacggagagaaatttccactaatcccccatattgttagagattcgcatgtttctctaacgaaagcttcggtggttacggatgggcatgcgtgccgttagctagttggtaaggtaacggctaaccaagaaaacgggggctaggggggctgagaggcttatcccccacactggaactgagaaacggaccagactcctacgggaggaagcagtgaggaatattggtcaatggacggaagtctgaaccagccatgccgcgtggaggaagaaggtcctatgggttgtaaactccttttgttcgagagtaataagaggcttgcgagcctcgatgagagtatcggacgaataagc

SEQ ID NO: 2112 - DNA, 490 bp, Unknown
  Ascusbbf_633691, encodes 16S rRNA
agagtttgatcctggctcaggatgaacgctggcggcgtgcttaacacatgcaagtcgaacgaagatatcctgaatgagagcttcggcaggaattctggatattcttagtggcggacgggtgagtaacgtgtgggcaacctgccctatactggggaataatcactggaaacggtgactaataccgcatgtggttccttgaaggcatctttagggaaagaaaggatttattcggtataggatgggcccgcatctgattagctagttggtgagataaaagcccaccaaggcgacgatcagtagccgacctgagagggtgatcggccacattgggactgagacacggcccaaactcctacgggaggcagcagtggggaatattgcacaatgggcgaaagcctgatgcagcaacgccgcgtgaaggaagaagggtttcggctcgtaaacttctatcaatagggacgaaacaaatgacggtacttaaataagaagc

SEQ ID NO: 2113 - DNA, 490 bp, Unknown
  Ascusbbf_100797, encodes 16S rRNA
agagtttgatcatggctcaggacgaacgctggcggcacgcttaacacatgcaagtcgaacggagtttaaagagcttgctttttaaacttagtggcggacgggtgagtaacacgtgagcaacctgccttcaagcgaggaataatggctggaaacgaccactaatacctcataacatagcgagaccgcatgatcttgctatcaaaggtttaccacttgaagatgggctcgcgtccgattagccagttggtgaggtaacggctcaccaaagcgacgatcggtagccgtactgagaggtagaacggccacattgggactgagacacggcccagactcctacgggaggcagcagtggggaatattgcacaatggaggaaactctgatgcagcgatgccgcgtgagggaagaaggctttcgggttgtaaacctctgttatcagggacgaaaatgacggtacctgaggaggaagctccggctaactacgtgccagca

SEQ ID NO: 2114 - DNA, 490 bp, Unknown
  Ascusbbf_166499, encodes 16S rRNA
agagtttgatcatggctcaggatgaacgctagctacaggcttaacacatgcaagtcgaggggcatcgcggggaggcttcggccaccctggcggcgaccggcgaatgggtgagtaacacgtatccaacctgccccgtaccgggggatagccctccgaaaggagaattaataccccatgtctcggtccgcgacatcccggtccgaggaaaggttcgccggtacgggatggggatgcgcccgattagcttgttggcggggtaacggcccaccaaggcgtcgatcggtaggggttctgagaggaaggtcccccacactggaactgagacacggtccagactcctacgggaggcagcagtgaggaatattggtcaatgggcgggagcctgaaccagccaagtagcgtgaaggatgacggccctacgggttgtaaacttcttttgtgcgggagtaaagtgcgccacgtgtggcgttttgcacgtaccgcaagaaaa

SEQ ID NO: 2115 - DNA, 490 bp, Unknown
  Ascusbbf_96146, encodes 16S rRNA
agagtttgatcctggctcaggatgaacgctggcggcgtgcctaacacatgcaagtcgagcgagaagctcatgatcaatacttcggttgcgtgaatgagtggaaagcggcggacgggtgagtaacgcgtaggcaacctgccccttgcagagggatagcctcgggaaaccgggattaaaacctcataacgcgtccacaagacatcttgaggacgccaaagatttatcggcaagggatgggcctgcgtctgattagttagttggtggggtaacggcctaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaaggaagaaggcccttgggtcgtaaacttctgttctaagggaagataatgacggtaccttaggagcaagtcccggcta

SEQ ID NO: 2116 - DNA, 490 bp, Unknown
  Ascusbbf_175703, encodes 16S rRNA
agagtttgatcctggctcaggatgaacgctggcggcgtgcttaacacatgcaagtcgaacgagaaagcgcccccgggcgcgagtagagtggcgaacgggtgagtaacacgtgaggaacctgcccccctccccgggataacccagggaaacctgcgctaataccggatgccccgggccggccgcatggccggcccgggaaagcccaggcggagggggatggcctcgcggcccattaggcagtcggcggggtaacggcccaccgagccggcgatgggtagccgggttgagagaccgaccggccacattgggactgagacacggcccagactcctacgggaggcagcagtggggaattttgcgcaatgggggaaaccctgacgcagcaacgccgcgtgcgggacgaaggccctcgggttgtaaaccgctttcagcaggggagaaactgacggtacctgcagaagaagctccggctaactacgtgccagcagcc

SEQ ID NO: 2117 - DNA, 490 bp, Unknown
  Ascusbbf_1515, encodes 16S rRNA
agagtttgatcatggctcaggatgaacgctagctacaggcttaacacatgcaagtcgagcggaacttcttcggaagtttagcggcagacgggtgagtaacacgtatccaacctttcccttactcgggtatagcctcgggaaactgagagtaatccccgatgaagtgtacgataagcattttttgcacaccaaagatttatcggtaaggggtggggatgcgttccattaggtagtaggcggggcaacggcccacctagccgatgatggataggggttctgagaggaaggtcccccacattggaactgcgacacggtccaaactcctacgggaggcagcagtgaggaatattggtcaatggtcggaagactgaaccagccaagtagcgtgcaggatgacggccctatgggttgtaaactgcttttgtgcgggaataacggtagccacgtgtggttgcgtgcatgtaccgtacgaataaggatcggctaactc

SEQ ID NO: 2118 - DNA, 490 bp, Unknown
  Ascusbbf_34647, encodes 16S rRNA
agagtttgatcatggctcaggatgaacgctggcggcgtgcttaacacatgcaagtcgaacgaggaattgcgaaagaagttttcggatggattttgcttttccgagtggcggacgggtgagtaacgcgtgggtaacctgccttacactgggggacaacagagagaaatttctgctaataccgcataacccgctagggccgcatggcccggacggaaaagatttatcggtgtaagatggacccgcgtctgattagcttgttggtgaggtaacggcccaccaaggcgacgatcagtagccgaactgagaggttgaccggccacattgggactgagacacggcccagactcctacgggaggcagcagtggggaatattgcacaatggggggaaccctgatgcagcaacgccgcgtgagtgaggaagtatttcggtatgtaaagctctatcagcagggaagagattgacggtacctgcataagaagccccggcta

SEQ ID NO: 2119 - DNA, 490 bp, Unknown
  Ascusbbf_21296, encodes 16S rRNA
agagtttgatcatggctcagaacgaacgctggcggcgcgtcttaagcatgcaagtcgagcggcagcagcaatgcgagagcggcggacgggtgagtaacacgtgggtaatctgccctccagtcggggatagcctgtggaaacacaggataataccggatgcgatggtctgacacaagttggattaggaaaggggccaaggccccgctggaggatgagcccgcgtcccattagctagatggcagggtaaaggcctaccatggcgatgatgggtagccggcctgagagggtgaacggccacattggaactgagacacggtccagactcctacgggaggcagcagctaagaatcttccacaatggacggaagtctgatggagcgacgccgcgtgcgcgatgaaggccgtgaggttgtaaagcgcttttcttgagggggaacaacacatccagggaatgggatgtggatgacgtgaatcgaggaataagccccgg

SEQ ID NO: 2120 - DNA, 490 bp, Unknown
  Ascusbbf_17756, encodes 16S rRNA
agagtttgatcatggctcaggatgaacgctggcggcgtgcctaacacatgcaagtcgagcgagatactgttgaacagagattcgtcaacgggatacagtggaaagcggcggacgggtgagtaacgcgtaggcaacctgccccttacacagggatagccattggaaacgatgattaaaacctgatgacacctgaggatgacatcttcctgaggtcaaagatttatcggtaagggatgggcctgcgtctgattagatagttggtgaggtaacggcccaccaagtcaacgatcagtagccgacctgagagggtgatcggccacattggaactgagacacggtccaaactcctacgggaggcagcagtggggaatattgcacaatgggggaaaccctgatgcagcaacgccgcgtgaaggaagaaggtcttcggatcgtaaacttctgtcctagaggaagataatgacggtactcttggaggaagccccggcta

SEQ ID NO: 2121 - DNA, 490 bp, Unknown
  Ascusbbf_111573, encodes 16S rRNA
agagtttgatcctggctcaggatgaacgctggcggcgtgcctaacacatgcaagtcgaacgaggtcttttatcttggagattcgtcaaagagatttctgaccgagtggcggatgggtgagtaacgcgtggagaacctgcccttatcagggggataacaactggaaacggttgacaataccgcatacgctcttatgatcgcatgatcgtgagaggaaagatttatcggataaggatggctccgcgtcggattagccagttggcggggtaacggcccaccaaagcgacgatccgtagccggcctgagagggcgaccggccacattgggactgagacacggcccagactcctacgggaggcagcagtgggggatattgcacaatggggggaaccctgatgcagcgacgccgcgtggaggaagaagtatttcggtatgtaaactcctatcagcagggaagaaaatgacggtacctgactaagaagccccggcta

SEQ ID NO: 2122 - DNA, 490 bp, Unknown
  Ascusbbf_623596, encodes 16S rRNA
agagtttgatcatggctcaggatgaacgctggcggcgtgcctaacacatgcaagtcgaacggagatttggcgctgacgagtgaaatagcttgctatcgaacgagtcttgccaaagcttagtggcggacgggtgagtaacgcgtggacaacctggcccatacagagggacagcagctggaaacggctgataataccgcataagcgcacagtatcacatggtacagtgtgaaaagatttatcggtatgggatgggtccgcgtccgattagccagttggcggggtaacggcccaccaaagcgacgatcggtagccggcctgagagggcggacggccacattgggactgagacacggcccagactcctacgggaggcagcagtgggggatattgcacaatggggggaaccctgatgcagcgacgccgcgtgggtgaagaagtatttcggtacgtaaagccctatcagcagggaagaagaattgacggtacctga

SEQ ID NO: 2123 - DNA, 490 bp, Unknown
  Ascusbbf_16582, encodes 16S rRNA
agagtttgatcatggctcaggacgaacgctggcggcatgcttaacacatgcaagtcgaacggagttaccctcttcggaggataacttagtggcgaacgggtgagtaacacgtgaataacctgccttgtacacacgaataacaagccgaaaggtttgctaatgcgcgataagatcgtagtttcgcatgaaacagcgaccaaagctccggcggtgcaagatggattcgcggcccattagctagttggtgaggtaacggcccaccaaggcgacgatgggtagccgacctgagagggtgatcggccacactggaactgagacacggtccagactcctacgggaggcagcagtggggaatattgggcaatgggcgcaagccttacccagcaatgccgcgtgagtgaagaaggtctttggattgtaaagctctttgattggggacgaaacaaacgacggtacccaaagaacaagccccggctaactacgtgccagc

SEQ ID NO: 2124 - DNA, 490 bp, Unknown
  Ascusbbf_1393362, encodes 16S rRNA
agagtttgatcctggctcaggatgaacgctagcggcaggcttaacacatgcaagtcgaggggcagcgcgtgtagcaatacatggcggcgaccggcgaaagggtgagtaacgcgtgagcaacgtgcccgtatgtgggggatagtcattggaaacgatgcgtaataccccgtaacacatggaactgcatggttctatgttgaaagattcattgcatacggatcggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggatgacggccctatgggttgtaaaccgcttttgcgagggagcaataaggtccacgtgtgggccgatgagagtacctcgcgaataagcatc

SEQ ID NO: 2125 - DNA, 490 bp, Unknown
  Ascusbbf_199751, encodes 16S rRNA
agagtttgatcctggctcaggatgaacgctagctacaggcctaacacatgcaagtcgaggggtaacgactgggaaagcttgctttctcagggcgacgaccggcgcacgggtgagtaacgcgtatccaacctgcctggaaccaagggataacccgtagaaatgcggcctaataccttatgttgtccgaagaaggcatctgacttggacaaaagatccgtcggttccggatggggatgcgtctgattaggtagtaggcggggcaacggcccacctagccgacgatcagtaggggttctgagaggaaggtcccccacattggaactgagacacggtccaaactcctacgggaggcagcagtgaggaatattggtcaatgggcgcgagcctgaaccagccaagtagcgtgcgggaggaaggccctatgggttgtaaaccgcttttaccgggggataaagtgagcgacgtgtcgctcattgcaggtacccggcga

SEQ ID NO: 2126 - DNA, 490 bp, Unknown
  Ascusbbf_140336, encodes 16S rRNA
agagtttgatcctggctcaggacgaacgctggcggcgtgcttaacacatgcaagtcgagcggtaaggctccttcgggagtacacgagcggcgaacgggtgagtaacacgtgagcaatctgcccatctcatcggaataaccattggaaacgatggctaatgccgaatacgaccaccgaaggcatcttctggtggtggaaagctccggcggagatggatgagctcgcggcctatcagcttgttggtgaggtaacggctcaccaaggcaacgacgggtagccggcctgagagggtgaccggccacactgggactgagacacggcccagactcctacgggaggcagcagtggggaatattggacaatgggcgaaagcctgatccagcaacgccgcgtgagggatgacggccttcgggttgtaaacctctttcagcggggacgaagcgaaagtgacggtacccgcagaagaaggaccggccaactacgtgccagc

SEQ ID NO: 2127 - DNA, 490 bp, Unknown
  Ascusbbf_188059, encodes 16S rRNA
agagtttgatcctggctcaggatgaacgctagcggcaggcctaacacatgcaagtcgaggggtagagggtgcttgcatccttgagaccggcgcacgggtgcgtaacgcgtatgcaacctgccttccacaggggaatagcccagagaaatttggattaatgccccatggcacagcgagacggcatcgtcttgctgttaaagtaacaacggtggaagatgggcatgcgtcccattagctagttggtaaggtaacggcttaccaaggctatgatgggtaggggtcctgagagggagatcccccacactggtactgagacacggaccagactcctacgggaggcagcagtgaggaatattggtcaatggtcgcaagactgaaccagccatgccgcgtgcaggatgacggtcctatggattgtaaactgcttttgtacgggaagaaacactcctacgtgtaggggcttgacggtaccgtaagaataaggatcggc

SEQ ID NO: 2128 - DNA, 490 bp, Unknown
  Ascusbbf_88364, encodes 16S rRNA
agagtttgatcatggctcaggatgaacgctggcggcatgcctaagacatgcaagtcgaacgaagtagcctaatgaagacctagtgcttgcacgaagtcagatttagatttctacttagtggcagacgggtgagtaacacgtgggtaacctacctcagagactgggataacggttagaaatgatcgctaataccggatgattcatagttagataactaattatgctaaaagaagcgtttgcttcactttgagatgggcttgcgttgtattagttagttggtggggtaatggcctaccaagacaacgatgcatatccgagctgagaggctgatcggacacactgggactgagacacggcccagactcctacgggagacagcagttaggaatattcgtcaatgggggaaaccctgaacgagcaatgccgcgtgagtgatgaaggtcttatagattgtaaaactctgttgtagagaaagaaaccttaagatagg

SEQ ID NO: 2129 - DNA, 490 bp, Unknown
  Ascusbbf_275657, encodes 16S rRNA
agagtttgatcctggctcaggatgaacgctggcggcgtgcctaatacatgcaagtcgaacgagttctcgttgatgatcggtgcttgcaccgagattcaacatggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgtt

SEQ ID NO: 2130 - DNA, 490 bp, Unknown
  Ascusbbf_1314962, encodes 16S rRNA
agagtttgatcctggctcaggatgaacgctggcggcgtgcctaatacatgcaagtcgaacgcacagcgaaaggtgcttgcacctttcaagtgagtggcgaacgggtgagtaacacgtggacaacctgcctcaaggctggggataacatttggaaacagatgctaataccgaatgaaacttagtgtcgcatgacacgaagttaaaaggcgctttggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagaatagggaatgattttagtttgacggtacca

SEQ ID NO: 2131 - DNA, 487 bp, Unknown
  Ascusbbf_113369, encodes 16S rRNA
agagtttgatcatggctcaggatgaacgctggcggcgtgcctaatacatgcaagtcgagcggtaacatggacttcggtctgatgacgagcggcggacgggtgagtaacgcgtaagaacataccccaaactgagggataactgctcgaaagagtagctaataccgcatatggccgtctttgacggttaaagcttcggcggtttgggaatggcttgcgtctgattagctagttggtaaggtaactgcttaccaaggcgacgatcggtagctggtttgagaggatgatcagccacactgggactgagacacggcccagactcctacgggaggcagcagtagggaattttccacaatgggggcaaccctgatggagcaacgccgcgtgctggatgaaggccttcgggtcgtaaacagcttttgtctgtgacgaatatgacggtagcagacgaataagggtcggctaactacgtgccagcagccgcggtaat

SEQ ID NO: 2132 - DNA, 490 bp, Unknown
  Ascusbbf_2065, encodes 16S rRNA
agagtttgatcatggctcaggatgaacgctagctacaggcttaacacatgcaagtcgagcggaatgctttcgggcatttagcggcagacgggtgagtaacacgtatccaacctttcccttactcgggtatagcctcgggaaactgagagtaatccccgatgcagtgtacgaacagcattatttgcacactaaagattcatcggtaaggggtggggatgcgttccattaggtagtaggcggggcaacggcccacctagccgatgatggataggggttctgagaggaaggtcccccacattggaactgcgacacggtccaaactcctacgggaggcagcagtgaggaatattggtcaatggtcggaagactgaaccagccaagtagcgtgcaggatgacggccctatgggttgtaaactgcttttgtgcgggaataacgtgctccacgtgtggggcagtgcatgtaccgtacgaataaggatcggctaactc

SEQ ID NO: 2133 - DNA, 490 bp, Unknown
  Ascusbbf_16454, encodes 16S rRNA
agagtttgatcatggctcaggatgaacgctagcggcaggcttaacacatgcaagtcgaggggcagcgggtgtagcaatacatgccggcgaccggcgaaagggtgagtaacgcgtgagcaacatgcccgatactgggggatagtcgatggaaacgtcgcgtaataccccgtaacacattctctcgcatggggggatgttgaaagattgattggtatcggattggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggatgacggccctatgggttgtaaaccgcttttgcgggggagcaataagagcaacgtgttgctcgatgagagtaccctgcgaataagcatc

SEQ ID NO: 2134 - DNA, 490 bp, Unknown
  Ascusbbf_26179, encodes 16S rRNA
agagtttgatcatggctcaggatgaacgctggcggcgtgcttaacacatgcaagtcgaacgaatttccttcgaacggagacttcggtcaaagggagattgaagtgagtggcggacgggtgagtaacgcgtgggtaacctgccttacaccgggggataacagagggaaacttctgctaataccgcataagaccacggagccgcatggttctgaggtaaaagttccggcgatgtaagatggacccgcgtctgattagccagttggcggggtaacggcccaccaaagcgacgatcagtagccgacctgagagggtgatcggccacattgggactgagacacggcccaaactcctacgggaggcagcagtggggaatattgggcaatgggcgcaagcctgacccagcgacgccgcgtgagtgaagaagtatttcggtatgtaaagctctttaagcagggaagataatgacggtacctgcagaataagcaccggc

SEQ ID NO: 2135 - DNA, 490 bp, Unknown
  Ascusbbf_553166, encodes 16S rRNA
agatttgatcatggctcaggacgaacgctggcggtacgcctaacacatgcaagtcgaacgggtgtgtagaaagcttgctctttatttcactagtggcggacgggtgagtaacgcgtgagtaatctgccttgaagtgggggataacatttggaaacaagtgctaataccgcgtaatatacgttcttcgcatgaagtttgtatcatagtttttcgcttcaagatgagctcgcgtccgattagtttgttggcgaggtaaatgctcaccaagactgcgatcggtagccgggttgagagactgaacggccacattgggactgagacacggcccagactcctacgggaggcagcagtggggaatattgcacaatgggggaaactctgatgcagcaataccgcatgagggatgaaggctttagggttgtaaacctctgtccaaagggacgaattttgacggtacctttgaaggaagctccggctaactacgtgccag

SEQ ID NO: 2136 - DNA, 490 bp, Unknown
  Ascusbbf_10565, encodes 16S rRNA
agagtttgatcatggctcaggattaacgctggcggcatgcctaatacatgcaagtcgaatggttagcttgctaaccatggcgaacgggtgagtaacacgtaggtaacctgtcttcaagacgaggataaccattggaaacgatggataatactggataggacaaatccccgcatgaggagatgtttaaaggagcaatccacttgatgaggggcctgcggtgcattagctagttggtgaggtaaaggcccaccaaggcgatgatgcatagccggactgagaggttgaacggccacaatggaactgagaacggtccatactcctacgggaggcagcagtagggaattttcggcaatgggcggaagcctgaccgagcaatgccgcgtgaacgatgaagtatttcggtatgtaaagttcttttatttgggaagaaaaaacaaattgacggtaccaaatgaataagctccggctaactacgtgccagcagccgcgg

SEQ ID NO: 2137 - DNA, 490 bp, Unknown
  Ascusbbf_106464, encodes 16S rRNA
agagtttgatcctggctcaggatgaacgctggcggcatgcctaagacatgcaagtcgaacgagatggccttttgaaaacggagtacttgtacaaagttggaaagagattctccatctagtggcagacgggtgagtaatacataagtaatctacctcagagactgggataacgtttggaaacgaacgctaataccggatgattcttcttacacaagtaagaaagctaaaaggagcgtttgcttcactttgagatgagcttatggcgtattaactagttggtggggtaatggcctaccaaggtgacgatgcgtagccgaactgagaggttgatcggccacattgggactgagacacggcccaaactcctacgggaggcagcagttaggaatattcgtcaatgggggaaaccctgaacgagcaatgccgcgtgagtgatgacggtctttatgattgtaaaactctgttgtaaggaaagaaaccttgtcatagg

SEQ ID NO: 2138 - DNA, 490 bp, Unknown
  Ascusbbf_195215, encodes 16S rRNA
agagtttgatcctggctcaggatgaacgctggcggcgtgcctaacacatgcaagtcgagcgagaagcttttcagtagatacttcggttgacacagagaagtggacagcggcggacgggtgagtaacgcgtgggcaacctgccccggactggaggatagccaagggaaactttgaataatactccatgatgcaaaagcaacacatgttgcaattgccaaagatttatcggtctgggatgggcccgcgtctgattagccagttggtgaggtagcggctcaccaaagcgacgatcggtagccggcctgagagggtgaacggccacattggaactgagacacggtccagactcctacgggaggcagcagtggggagtattgcacaatgggcggaagcctgatgcagcaacgccgcgtgaaggaggaaggttttcggatcgtaaacttctgtccctggggaagaagaaagtgacggtacccaaggaggaagcccc

SEQ ID NO: 2139 - DNA, 490 bp, Unknown
  Ascusbbf_4392, encodes 16S rRNA
agagtttgatcatggctcaggattaacgctggcggcatgcctaatacatgcaagtcgaatgggtagcttgctatccatggcgaacgggtgagtaacacgtaggtaacctgtcttcaagtcgaggataacctttggaaacgaaggataatactggataggtcgttaaaaatcacatgattaaacgattaaagattattatgtcacttgatgaggggcctgcggcgcattagctagttggtgaggtaaaggcccaccaaggcgatgatgcgtagccggactgagaggttgaacggccacaatgggactgagaacggcccatactcctacgggaggcagcagtagggaattttcggcaatgggcgcaagcctgaccgagcaatgccgcgtgaaagaagaagtatttcggtatgtaaatttcttttatttgggacgaaaaaacaaattgacggtaccaaatgaataagctccggctaactacgtgccagcagcc

SEQ ID NO: 2140 - DNA, 490 bp, Unknown
  Ascusbbf_29982, encodes 16S rRNA
agagtttgatcatggctcagaacgaacgctggcggcgcgtcttaagcatgcaagtcgaatggcaagattggtgcttgcaccgatcctagaatggcagactggtgagtaacacgtgggtgacataccctctggatggggacagctgttagaaatagcaggtaataccgaataagcttgtgcaggttagagtggcataaggaaaggtgctccggcaccaccagaggaatggctcgcggcccattagctagttggtgaggtaacggcccaccaaggcgatgatgggtatccggcctaagagggtaaacggacacattgggactgagatacggcccagactcctacgggaggcagcagctaagaatattccgcaatggacgaaagtctgacggagcgacgccgcgtggatgatgaaggccgaaaggttgtaaaatccttttgaactggacgaataagtgtggcagggaatggtcatatggtgacggtacagttt

SEQ ID NO: 2141 - DNA, 490 bp, Unknown
  Ascusbbf_221735, encodes 16S rRNA
agagtttgatcatggctcaggataaacgctggcggcgtgcttaacacatgcaagtcgaacggagtacttctcccgagaccgaggaagcttgcttccaaagaatcatttgaagtacttagtggcggacgggtgagtaacgcgtgggtaacctgcctcacactgggggatagcagttggaaacgactgataataccgcataagcgcacagtatcgcatggtacagtgtgaaaaactccggtggtgtgagatggacccgcgtctgattagccagttggcggggtaacggcccaccaaagctacgatcagtagccggcctgagagggtgtacggccacattgggactgagacacggcccaaactcctacgggaggcagcagtggggaatattgcacaatgggggaaaccctgatgcagcgacgccgcgtgagtgatgaagtatttcggtatgtaaaactctatcagcagggaagataatgacggtacctgacta

SEQ ID NO: 2142 - DNA, 490 bp, Unknown
  Ascusbbf_11094, encodes 16S rRNA
agagtttgatcatggctcaggatgaacgctggcggcgtgcttaacacatgcaagtcgaacgaagcactggttttgaagttttcggacggaaaagcctttgacttagtggcggacgggtgagtaacgcgtgggcaacctgccgtatgcagggggacaacagttggaaacgactgctaataccgcataagcgcacggggacgcatgttcctgtgtgaaaagccttgacggcatacgatgggcccgcgttggattaggtagttggtgaggtaacggcccaccaagccgacgatccatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgcacaagaagccccggct

SEQ ID NO: 2143 - DNA, 490 bp, Unknown
  Ascusbbf_120257, encodes 16S rRNA
agagtttgatcatggctcaggatgaacgctggcggcacgcttaacacatgcaagtcgaacgaggttatgaacttcggttaataacctagtggcggacgggtgcgtaacgcgtgggtaatctgcccttgacagggggataacgtatagaaatgtacgctaataccgcataagcccacgagaccgcatggtcttgagggaaaagggatactggtcaaggatgagcccgcgtctgattaggtagttggtgaggtaaaggcccaccaagcctgcgatcagtagccggtctgagaggatggacggccacattgggactgagacacggcccaaactcctacgggaggcagcagtggggaatattgcacaatgggggaaaccctgatgcagcgatgccgcgtgaaggacgaagtgtttcggcacgtaaacttctatcagcaaggaagaaatcagacagtacttgaataagcagccccggctaactacgtgccagcag

SEQ ID NO: 2144 - DNA, 490 bp, Unknown
  Ascusbbf_239485, encodes 16S rRNA
agagtttgatcatggctcaggatgaacgctggcggcgtgcctaacacatgcaagtcgaacggagctaccgcgctgatgatggagatgcttgcattgacagaatcttgtggtagcttagtggcggacgggtgagtaacgtgtggataacctggtccatccagggggatagcagctggaaacggctggtaataccgcatgagcgcacactaccgcatggtagagtgtgaaaagatctatcgggatggaatggatccgcatctgattagccagttggcggggtagaagcccaccaaagcgacgatcagtagccggcctgagagggcggacggccacattgggactgagacacggcccagactcctacgggaggcagcagtgggggatattgcacaatggggggaaccctgatgcagcgacgccgcgtgggtgaagaagtatttcggtatgtaaagccctatcagcagggaagataatgacggtacctgagtaa

SEQ ID NO: 2145 - DNA, 490 bp, Unknown
  Ascusbbf_28185, encodes 16S rRNA
agagtttgatcatggctcaggatgaacgctagcgacaggcctaacacatgcaagtcgaggggtaacagggagcttgctccgctgacgaccggcgcacgggtgagtaacgcgtatgcaacctgcccgcgggatcgggatagccccccgaaagggggattaacaccggatgcggctgtttgggggcatccccgtacagccaaatgcgaagctcgcggatgggcatgcgtccgattagctggttgggggggtaacggcccaccaaggcgacgatcggtaggggtcctgagagggaggtcccccacactggtactgagacacggaccagactcctacgggaggcagcagtgaggaatattggtcaatgggcgagagcctgaaccagccatgtcgcgtggaggaataaggatctatggttcgtaaactccttttgcgcggggataaagtggcggacttgtccgctattgcaggtaccgcgcgaataagcatcggc

SEQ ID NO: 2146 - DNA, 490 bp, Unknown
  Ascusbbf_77099, encodes 16S rRNA
agagtttgatcatggctcaggatgaacgctagctacaggcttaacacatgcaagtcgaggggcagcgtgtacaggtgcttgcaccagtacgacggcgaccggcgcacgggtgagtaacgcgtatccaacctgccatatactcggggatagcccggtgaaaaccgaattaacacccgatgagattccttgcggacatccaactggaatcaaagtttcacggtatatgatggggatgcgtctgattagcttgttggcggggtaacggcccaccaaggcgacgatcagtaggggttctgagaggaaggtcccccacattggtactgagacacggaccaaactcctacgggaggcagcagtgaggaatattggtcaatgggcgagagcctgaaccagccaagtagcgtgcaggatgacggccctatgggttgtaaactgcttttgtaagggaacaaagtgcgggacgtgtcctgctttgcgtgtaccttacgaa

SEQ ID NO: 2147 - DNA, 490 bp, Unknown
  Ascusbbf_304165, encodes 16S rRNA
agagtttgatcatggctcaggatgaacgctggcggcgtgcctaacacatgcaagtcgaacggggttatgacgctgaggagacttcggtcaaatcttgttgtaacttagtggcggacgggtgagtaacgcgtggataacctgccatacacagggggataacagttagaaatgactgctaataccgcataagcgcacgagagggcatccttttgtgtgaaaagcgcatacggtgtatgatgggtccgcgtccgattagccagttggcggggtaagagcccaccaaagcgacgatcggtagccggcctgagagggtgaacggccacattgggactgagagacggcccaaactcctacgggaggcagcagtgggggatattgcacaatggggggaaccctgatgcagcgacgccgcgtgagtgaagaagttattcgtaatgtaaagctctatcagcagggaagaagcagacggtacctgactaagaagcaccgg

SEQ ID NO: 2148 - DNA, 490 bp, Unknown
  Ascusbbf_5123, encodes 16S rRNA
agagtttgatcatggctcaggacgaacgctggcggcgcgcctaacacatgcaagtcgaacggagagtgtgttttgaattcttcggaaggaaaaatacatttcttagtggcggacgggtgagtaacacgtgagcaacctgccttgcagagagggataacgattggaaacgatcgctaataccacatgatgtatggacatcgcatggtgaccatatcaaagatttatcgctgcaagatgggctcgcgtctgattagatagttggtgaggtaatggctcaccaagtcgacgatcagtagccggactgagaggttgaacggccacattgggactgagacacggcccagactcctacgggaggcagcagtgggggatattgcacaatgggggaaaccctgatgcagcgacgccgcgtgagggaagaaggttttcggattgtaaacctctgtctttggggacgataatgacggtacccaaggaggaagctccggct

SEQ ID NO: 2149 - DNA, 490 bp, Unknown
  Ascusbbf_705984, encodes 16S rRNA
agagtttgatcatggctcaggatgaacgctagcgacaggcttaacacatgcaagtcgaggggcatcagggatgtagcaatacatttgctggcgaccggcgcacgggtgagtaacgcgtatgcaacctgcctatcagaggaggataacccggcgaaagtcggactaatactccataaaacaggggttccgcatgggactatttgttaaagattaatcgctgatagatgggcatgcgttccattagctggttggtgaggtaacggctcaccaaggcaacgatggataggggttctgagaggaaggtcccccacactggtactgagacacggaccagactcctacgggaggcagcagtgaggaatattggtcaatgggcgagagcctgaaccagccaagtcgcgtgaaggatgaaggatctatggtttgtaaacttcttttatacgggaataaagttcaggacgtgtcctgttttgtatgtaccgttatgaat

SEQ ID NO: 2150 - DNA, 490 bp, Unknown
  Ascusbbf_122456, encodes 16S rRNA
agagtttgatcatggctcaggatgaacgctagcggcaggcctaatacatgcaagtcgaggggcagcgcagtgtagcaatacatgggcggcgaccggcaaacgggtgcggaacacgtacacaaccttccttttagtggagcatagcccagggaaacttggattaatactccgtaacataacgagatggcatcttcttgttattatagaagcaattcgctagaagacgggtgtgcggctgattagatagttggcggggtaacggcccaccaagtccacgatcagtaactggtgtgagagcacgaccagtcacacgggcactgagacacgggcccgactcctacgggaggcagcagtaaggaatattggtcaatggacgcaagtctgaaccagccatgccgcgtggaggatgaaggccctctgggttgtaaacttcttttataggggacgaaaaagggactttctagtccaactgacggtaccctaggaataa

SEQ ID NO: 2151 - DNA, 490 bp, Unknown
  Ascusbbf_15121, encodes 16S rRNA
agagtttgatcatggctcaggatgaacgctagcgacaggcctaacacatgcaagtcgaggggtaacaggggagcttgctcccgctgacgaccggcgcacgggtgagtaacgcgtatggaacctgcccgcgacacggggataatccggcgaaagtcggtctaatacccgatgacgtcgtcatttcgcatgttatgacgattaaagattcatcggtcgcggatggtcatgcgtggcattaggtagtaggcggggtaacggcccacctagccgacgatgcctaggggttctgagaggaaggtcccccacactggtactgagacacggaccagactcctacgggaggcagcagtgaggaatattggtcaatggacgcaagtctgaaccagccaagtcgcgtgaaggaagactgccctatgggttgtaaacttcttttataggggaataaagtgggtctcgtgaggccttttgcatgtaccctatgaataagcat

SEQ ID NO: 2152 - DNA, 490 bp, Unknown
  Ascusbbf_2211, encodes 16S rRNA
agagtttgatcatggctcaggatgaacgctagcggcaggcttaacacatgcaagtcgaggggcagcgtaaggatgtagcaatacaaccttgacggcgaccggcgcaagggtgcgtaacgcgtgagcaacttgcccgtatcaggggcataaccggtggaaacgccgactaattccccataacacaagataaggcatcttattttgttgaaatctttggaggatacggatgggctcgcgtgacattaggcagttggcggggtaacggcccaccaaaccgacgatgtctaggggaactgagaggttaatcccccacactggaactgagacacggtccagactcctacgggaggcagcagtgaggaatattggacaatggccggaaggctgatccagccatgccgcgtgcaggataaggtcctatggattgtaaactgcttttgtatgagagcaataaggattacgtgtaatccgatgagagtatcatacgaat

SEQ ID NO: 2153 - DNA, 490 bp, Unknown
  Ascusbbf_12407, encodes 16S rRNA
agagtttgatcatggctcaggataaacgctggcggcgcacataagacatgcaagtcgaacgaacttaattttaatatttatattaaaaagcggttagtggcggactggtgagtaacgcgtaagcaatctacctattagaggggaataacagtgagaaatcattgctaataccgcatatgccataagtatcgcatgatactagtgggaaaggagcaatccgctaatagatgaacttgcgtctgattagctagttggtggggtaacagcctaccaaggcaacgatcagtagccggactgagaggttgaacggccacattgggactgagatacggcccagactcctacgggaggcagcagtcgggaatattgcgcaatggaggaaactctgacgcagtgacgccgcgtataggatgaaggttttcggattgtaaactattgtcgttagggaagataaaagacagtacctaaggaggaagctccggctaactac

SEQ ID NO: 2154 - DNA, 490 bp, Unknown
  Ascusbbf_8879, encodes 16S rRNA
agagtttgatcatggctcaggatgaacgctagcggcaggcctaacacatgcaagtcgaggggcagcggggtgtagcaatacactgccggcgaccggcgcacgggtgcgtaacgcgtatgcaacctacccatgggagggggataacccggagaaatccggactaataccccgtaacacacacattcgcatggaagtgtgttgaaagatacgtcgtccatggacgggcatgcgtggcattaggtagttggcggggcaacggcccaccaagccatcgatgcctaggggagctgagaggctaatcccccacactggtactgagacacggaccagactcctacgggaggcagcagtgaggaatattggtcaatggagggaactctgaaccagccatgccgcgtgagggaggaaggccctatgggttgtaaacctcttttgcctgggggcaataagggcggtgcgccgtccgatgagagtaccaggcgaataagca

SEQ ID NO: 2155 - DNA, 490 bp, Unknown
  Ascusbbf_57918, encodes 16S rRNA
agagtttgatcatggctcaggacgaacgctggcggcgtgcttaacacatgcaagtcgaacgatgatgctgaagtttactttggtggattagtggcgaacgggtgagtaacacgtgagcaacgtgcccagaactctggaataactctcggaaacgggggctaatactggataggtgccacggccgcatggtctgtggttggaaagatttatcggttctggatcggctcacggcctatcagcttgttggtggggtaatggcctaccaaggcgacgacgggtagccggcctgagagggtgaccggccacactgggactgagatacggcccagactcctacgggaggcagcagtggggaatattgcacaatgggcgcaagcctgatgcagcaacgccgcgtgagggatgacggccttcgggttgtaaacctcttttagtagggaagaagcgcaagtgacggtacctgcagaaaaagcaccggctaactacgtgc

SEQ ID NO: 2156 - DNA, 490 bp, Unknown
  Ascusbbf_44748, encodes 16S rRNA
agagtttgatcatggctcagaacgaacgctggcggcgcgtcttaagcatgcaagtcgaacggcaagataagagcttgctcttatcctagagtggcggactggtgagtaacgcgtaggtgacgtacccttcagatggggatagccgctagaaatagcggataataccgaatacggtcccgtgtgtcagaggcacgggaggaaaggagcttcggctccgctgaaggaacggcctgcgtcctatcagctggttggcggggtaacggcccaccaaggcaatgacaggtatccggcctaagagggtgaacggacacattgggactgagatacggcccagactcctacgggaggcagcagctaagaatattccgcaatggacgaaagtctgacggagcgacgccgcgtggacgatgaaggccggaaggttgtaaagtccttttatatatgaggaataagccggggaggtaatgcctcggtggtgactgtagtatat

SEQ ID NO: 2157 - DNA, 490 bp, Unknown
  Ascusbbf_54250, encodes 16S rRNA
agagtttgatcctggctcagattgaacgctggcggcatgcttaacacatgcaagtcgaacggtaacaggtcgagtgatcccttcggggtgatcttggcgctgacgagtggcgcacgggtgagtaatacatgggaatctgcctagtagtgggggataacccggggaaactcgggctaataccgcatacgctctacggaggaaagcgggggatcttcggacctcgtgctattagatgagcccatgtcggattagcttgttggtggggtaatggcctaccaaggcgacgatccgtagctggtctgagaggacgatcagccacactgggactgagacacggcccagactcctacgggaggcagcagtggggaatattggacaatgggcgcaagcctgatccagcaatgccgcgtgtgtgaagaaggcctgcgggttgtaaagcactttcagtggggaagaaaagcttggggctaataccctcgggttttgacgt

SEQ ID NO: 2158 - DNA, 490 bp, Unknown
  Ascusbbf_37910, encodes 16S rRNA
agagtttgatcatggctcaggacgaacgctggcggcgtgcctaacacatgcaagtcgagcggagacttgggaaatgagagcttcggcaggaatagaacaagttttagcggcggacgggtgagtaacgcgtgagcaatctgtctcagacagggggataacgcagcgaaagttgcactaataccgcatgagaccacagtaccgcatggtacaggggtcaaaggagcaatccggtctgaggtgagctcgcgtcctattaggtagttggtgaggtaacggctcaccaagcctgcgataggtagccgacctgagagggtgatcggccacactggaactgagacacggtccagactcctacgggaggcagcagtgggaatattgggcaatgggcgaaagcctgacccagcaacgccgcgtgagtgaagaaggtcttcggattgtaaatctctgtcctaagagaagaggggaagacggtatcttaggaggaagcccc

SEQ ID NO: 2159 - DNA, 490 bp, Unknown
  Ascusbbf_38550, encodes 16S rRNA
agagtttgatcatggctcagagttaacgctggcatcgtgcataacacatgcaagtcgaacgggacttacttgagtagcaatacttgagtaagtttagtggcagacgggtgagtaatacataaggaattcacctccgagtggggaataacagtccgaaaggattgctaataccccataacataattaagtggcatcacttgattatcaaagatttatcgcttggagagaatcttatggtctatcagctagttggtagtgtaacggactaccaaggcgacgacggatagccggcctgaaagggcgaccggccacaagggcactgagacacgggccctactcctacgggaggcagcagtggggaattttggacaatgggcgaaagcctgatccagcaacgatgcgtggaggatgaaggttctcggattgtaaactccttttaagggggacgaaaaaaatgacggtaccccttgaataagccacggctaactac

SEQ ID NO: 2160 - DNA, 490 bp, Unknown
  Ascusbbf_1497994, encodes 16S rRNA
agagtttgatcatggctcagaacgaacgctggcggcgcgtcttaagcatgcaagtcgagcgtgattacctagcttgctaggtatgaaagcggcggactggtgagtaacgcgtgggtaacgtaccctgaggatggggatagctcctagaaataggagataataccgaatacgcttgatgttgtcagaggacatcaaggaaaggttcttttgaaccgcctgaggaacggcccgcgtactattagctggttggtgaggtaacggcccaccaaggcgacgatagttacccggcctgagagggtgaacgggcacattgggactgagatacggcccagactcctacggaggcagcagctaagaatattccgcaatgcacgaaagtgtgacggagcgacgccgcgtggacgatgaaggccggaaggttgtaaagtccttttagatatgaggaataagcagtgtgagagaaacgcactgtggtgactgtagtatcaga

SEQ ID NO: 2161 - DNA, 490 bp, Unknown
  Ascusbbf_124760, encodes 16S rRNA
agagtttgatcctggctcaggacgaacgctggcggcgtgcttaacacatgcaagtcgaacggagcgaagcccttcggggcggagcttagtggcggacgggtgagtaacacgtgagcaacctgcccattacagggggatagcagctggaaacggctggtaataccgcataagaccacagaaccgcatggttgaggggtaaaaggagagatccggtaatggatgggctcgcgtcccattaggtagttggtgagataacagcccaccaagccaacgatgggtaaccgacttgagagagtgatcggtcacattggaactgagaaacggtccaaactcctacgggaggcagcagtggggaatattgggcaatgggggaaaccctgacccagcaacgccgcgtgagggaagaaggccttcgggttgtaaacctctgtcctcggggacgaagaaatgacggtacccggggaggaagccccggctaactacgtgccag

SEQ ID NO: 2162 - DNA, 490 bp, Unknown
  Ascusbbf_80361, encodes 16S rRNA
agagtttgatcatggctcaggacgaacgctggcggcatgcttaatacatgcaagtcgaacgggatatcagagcttgctttgatatctagtggcgaacgggtgagtaacacgtgagcaacctgcccactacacagggataccagtccgaaaggattgctaataccggatgagatcacaggaccgcatggtctagtggtaaaagctcaggcggtagtggatgggctcgcggtacattagttagttggtgaggtaacggcccaccaagacgatgatgtatagccgacctgagagggtgatcggccacattgggactgagatacggcccagactcctacgggaggcagcagtaaggaatattgggcaatgggggcaaccctgacccagcaatgccgcgtgaaggaagaaggttttcggattgtaaacttcttttatataggacgaatgaatgacggtactatatgaataagccccggctaactacgtgccagca

SEQ ID NO: 2163 - DNA, 490 bp, Unknown
  Ascusbbf_325331, encodes 16S rRNA
agagtttgatcatggctcaggatgaacgctagctacaggcttaacacatgcaagtcgagcggaatgccttcgggcatttagcggcagacgggtgagtaacacgtatccaacctttcccttactcgggtatagcctcgggaaactgagagtaatccccgatgcagtgtacgcaatgcatattatgcacactaaagatttatcggtaaggggtggggatgcgttccattaggtagtaggcggggtaacggcccacctagccgatgatggataggggttctgagaggaaggtcccccacattggaactgcgacacggtccaaactcctacgggaggcagcagtgaggaatattggtcaatggtcgaaggactgaaccagccaagtagcgtgcaggatgacggccctatgggttgtaaactgcttttgtgcgggaataacggtctccacgagtggagatgtgcatgtaccgtacgaataaggatcggctaactc

SEQ ID NO: 2164 - DNA, 490 bp, Unknown
  Ascusbbf_87070, encodes 16S rRNA
agagtttgatcatggctcaggacgaacgctggcggcgtgcctaacacatgcaagtcgaacggagtacccttgattgaagcttcggcagattgataggaatacttagtggcggacgggtgagtaacacgtgagtaacctgcccttcagagggggataacataccgaaaggtatgctaataccgcataacgcatatcagtcgcatggcagatatgccaaagatttatcgctgaaggatggactcgcggccgattaggtagttggcggggtaacggcccaccaagccgacgatcggtagccggactgagaggttgaacggccacattgggactgagacacggcccagactcctacgggaggcagcagtgggggatattgcgcaatgggggaaaccctgacgcagcgacgccgcgtggaggaagaaggttttcggattgtaaactcctgtcaacagggacgagaaaggacggtacctgtggaggaagccacggc

SEQ ID NO: 2165 - DNA, 490 bp, Unknown
  Ascusbbf_80339, encodes 16S rRNA
agagtttgatcatggctcaggatgaacgctggcggcatgcctaacacatgcaagtcgaacggagatagaaatatcttagtggcgaacgggtgagtaacacgtgagcaacctgccttgtacacagggataacagatggaaacatctgctaataccggataagaccacagaccggcatcggtcaggggtaaaagtgatttagcggtacaagatgggctcgcgtccaattagctagttggtgaggtaacggcccaccaaggcgacgattggtagccgacttgagagagtgatcggccacattggaactgagacacggtccaaactcctacgggaggcagcagtggggaatattgggcaatggaggaaactcttacccagcaatgccgcgtgagcgatgaaggtcaattgattgtaaagctctatgattagggacgaataaatgacggtacctaaagaaaagccccggctaactatgtgccagcagccgcggta

SEQ ID NO: 2166 - DNA, 490 bp, Unknown
  Ascusbbf_101931, encodes 16S rRNA
agagtttgatcatggctcaggatgaacgctagcggcaggcttaacacatgcaagtcgaggggcagcgcgaggtagcaatactttggcggcgaccggcggaagggtgcgtaacgcgtgagcaacatgcccgtatgagggggatagtcattggaaacgatgcgtaataccccgtaacattggaggccgcatgaccaccaattgaaagatttatcgcatacggattggctcgcgtgacattagctagttggcggggtaacggcccaccaaggcgacgatgtctaggggaactgagaggttggtcccccacactggaactgagacacggtccagactcctacgggaggcagcagtgaggaatattggtcaatgggcggaagcctgaaccagccatgccgcgtgaaggaataaggccctatgggtcgtaaacttcttttgacggggagcaataagggcgtcgagcacgctcgatgagagtactcgtcgaataagc

SEQ ID NO: 2167 - DNA, 490 bp, Unknown
  Ascusbbf_406752, encodes 16S rRNA
agagtttgatcctggctcaggatgaacgctggcggcgtgcttaatacatgcaagtcgaacgaagatatttcgctgatgcgattcgtcaaatcttgaaatatcttagtggcggacgggtgagtaacgcgtgggtaacctgccttacacagggggataacagttagaaatgactgctaataccgcataagcgcacggtatcgcatgatacagtgtgaaaagatttatcggtgtaagatggacccgcgtctgattagctagttggtgaggtaacggcccaccaaggcgacgatcagtagccggcctgagagggtgaacggccacattgggactgagacacggcccaaactcctacgggaggcagcagtagggaatattggacaatgggggcaaccctgatccagcgacgccgcgtgagtgaagaagtatttcggtacgtaaagctctatcagcagggaagaaaatgacggtacctgactaagaagcaccggct

SEQ ID NO: 2168 - DNA, 490 bp, Unknown
  Ascusbbf_77397, encodes 16S rRNA
agagtttgatcatggctcaggatgaacgctagcgacaggcctaacacatgcaagtcgaggggtaacaggggagcttgctcccgctgacgaccggcgcacgggtgagtaacgcgtatgcaacctgcccacgggatcgggatagccccccgaaagggggattaacaccggatgaggcggacgaggggcatccctttgtccgtcaaatgcgaagctcgtggatgggcatgcgtccgattagctagttggcggggtaacggcccaccaaggcgacgatcggtaggggttctgagaggaaggtcccccacactggtactgagacacggaccagactcctacgggaggcagcagtgaggaatattggtcaatgggcgagagcctgaaccagccatgtcgcgtgcaggaatacggccctatgggttttaaactgcttttgccgggggataaagtggcggactagtccgctattgcaggtacccggcgaataaggatc

SEQ ID NO: 2169 - DNA, 490 bp, Unknown
  Ascusbbf_105832, encodes 16S rRNA
agagtttgatcatggctcaggacgaacgctggcggcacgcttaacacatgcaagtcgaacggagataaaggagcttgcttctttatcttagtggcggacgggtgagtaacacgtgagcaacctaccttcaagcggggaataatggagggaaacttccactaataccccataagatagtatttccgcatggagaagctatcaaagatttattgtttgaagatgggctcgcgtccgattagccagttggtgaggtaacggcccaccaaagcgacgatcggtagccgtactgagaggtagaacggccacattgggactgagacacggcccagactcctacgggaggcagcagtggggaatattgcacaatggaggaaactctgatgcagcgatgccgcgtgagggaagaaggttttcggattgtaaacctctgtagtacgggacgaaaaaaatgacggtaccgtacaagaaagctccggctaactacgtgcca

SEQ ID NO: 2170 - DNA, 490 bp, Unknown
  Ascusbbf_224149, encodes 16S rRNA
agagtttgatcatggctcaggatgaacgctggcggcgtgcctaacacatgcaagtcgaacggaacttttaaggaacaagacttcggtcaagtgaaatttaagtttagtggcggacgggtgagtaacgcgtgagcaacctgcctctcagagggggataacgtccggaaacggacgctaataccgcataacatggagagatcgcatgatcattccatcaaagattttatcgctgagagatgggctcgcgtccgattaggctgttggtgaggtaacggctcaccaaaccgacgatcggtagccggactgagaggttgaacggccacattgggactgagacacggcccagactcctacgggaggcagcagtggggaatattgcacaatgggcgcaagcctgatgcagcaacgccgcgtgagggaagacggttttcggattgtaaacctctgtcattggtgacgaagaagtgacggtagccaatgaggaagccac

SEQ ID NO: 2171 - DNA, 490 bp, Unknown
  Ascusbbf_1880860, encodes 16S rRNA
agagtttgatcatggctcaggatggacgctagcggcaggcttaacacatgcaagtcgaggggcatcgcggagtagcaatactctggcggcgaccggcgaaagggtgcgtaacgcgtgagcaacattcccgtatttgggggataagcagtggaaacgctgtctaataccccataacaacagagtccgcatggactttgcttgaaagattcgtcgaatacggattggctcgcgtggcattagctagtcggcggggtaacggcccaccgaggcaacgatgcctaggggttctgagaggaagaccccccacattgggactgagacacggcccaaactcctacgggaggcagcagtgaggaatattggtcaatggacggaagtctgaaccagccatgccgcgtgaaggatcacggccctatgggttgtaaacttcttttgtgacagagcaataaggcgtacgtgtacgccgatgagagtatgccacgaataagca

SEQ ID NO: 2172 - DNA, 490 bp, Unknown
  Ascusbbf_1809385, encodes 16S rRNA
agagtttgatcatggctcaggacgaacgctggcggcgtgcctaacacatgcaagtcgaacggacttagctggatgcttgcatccggcgacagttagtggcggacgggtgagtaacgcgtgaataacctgcccaatagagggggataacgtttggaaacgaacgctaataccgcataacattatgatatcgcatggtattgtaatcaaaggagcaatccgctgatggatggattcgcgtccgattagctagttggtgagataacagctcaccaaggcgacgatcggtagccggactgagaggctgaacggccacattgggactgagacacggcccagactcctacgggaggcagcagtgggggatattgcacaatgggggaaaccctgatgcagcaacgccgcgtgagggaagaaggttttcggattgtaaacctctgtcctaggtgaagataatgacggtagcctaggaggaagctccggctaactacgt

SEQ ID NO: 2173 - DNA, 490 bp, Unknown
  Ascusbbf_1748008, encodes 16S rRNA
agagtttgatcatggctcaggatgaacgctggcggcgtgcctaacacatgcaagtcgagcgaagcactttggctgatccttcgggtgttgccccagtgactgagtggcggacgggtgagtaacgcgtgggtaacctgccctgtacagggggataacagtcagaaatgactgctaataccgcataagcgcacgagaggacatccttttgtgtgaaaaactccggtggtacaggatgggcccgcgtctgattagcttgttggcggggtaatagcccaccaaggcgacgatcagtagccggtctgagaggatgaacggccacattggaactgagacacggtccaaactcctacgggaggcagcagtggggaatattgcgcaatggggggaaccctgatgcagcaacgccgcgtgagtgaagaagtatttcggtatgtaaagctctatcagcagggaagataatgacggtacctgactaagaagctccggctaa

SEQ ID NO: 2174 - DNA, 490 bp, Unknown
  Ascusbbf_361815, encodes 16S rRNA
agagtttgatcatggctcaggatgaacgctagcggcaggcttaacacatgcaagtcgaggggcagcgcgggctgagtagcaatacaacgcctggcggcgaccggcggaagggtgcgtaacgcgtgagcaacttgcccgtatcagggggataaccggtggaaacgccgcctaataccccataacaacggaggtcacatgacctttgtttgaaagctacggcggatacggatgggctcgcgtgacattagctagttggagaggtaacggctcaccaaggcgacgatgtctaggggttctgagaggaaggtcccccacactggaactgagacacggtccagactcctacgggaggcagcagtgaggaatattggtcaatgggcggaagcctgaaccagccatgccgcgtgaaggaataaggtcctatggattgtaaacttcttttgagcgggagcaataagggctacgcgtagtccgatgagagtaccgttcg

SEQ ID NO: 2175 - DNA, 490 bp, Unknown
  Ascusbbf_382545, encodes 16S rRNA
agagtttgatcatggctcaggacgaacgctggcggcgtgctttaaacatgcaagtcgaacgggaattgcgagggagcttgctcctttgcaattctagtggcggacgggtgagtaacgcgtgagcaatctgcctatcacagggggacaacagttggaaacgactgctaataccgcatgagaccacaaccatacatgtggaaggggtcaaaggagcaatccggtgatagaggagcttgcgtctcattagctagttggtgaggtaacggcccaccaaggcgacgatgagtagccgatctgagaggatgaccggccacactggaactgagaaacggtccagactcctacgggaggcagcagttaggaatattgggcaatggagggaactctgacccagcaacgccgcgtgaaggaagaaggttttcggattgtaaacttctgatctaggggaaaaagaaagtgatggtaccctaggagaaagccacggctaact

SEQ ID NO: 2176 - DNA, 490 bp, Unknown
  Ascusbbf_232082, encodes 16S rRNA
agagtttgatcatggctcagaataaacgctggcggcgtgcctaacacatgcaagtcgagcgagaaagctccttcgggagtaagtaaagcggcgaacgggtgagttacgcgtgagaatctaccttttagtgaagaatacccttgagaaatcgaggctaatactgcataagtcccttcggggagaaagatggcctctttgctgtcgctaaaagatgagcttgcgtgctattagctagttggtagggtaaaggcctaccaaggcaatgatggctagccggcctgagagggtgtacggccacactggaacttagacacggtccagactcctacgggaggcagcagtgaggaatattgcgcaatgggcgaaagcctgacgcagcgacgccgcgtggaggatgaaggtctttggattgtaaactcctgttaagtgggaagaaaagcctgtttttaatagaaacaggtaatgacggtaccattagagaaagcaccgg

SEQ ID NO: 2177 - DNA, 490 bp, Unknown
  Ascusbbf_23812, encodes 16S rRNA
agagtttgatcatggctcaggattaacgctggcggcatgcctaatacatgcaagtcgaatggtagcaataccatggcgaacgggtgagtaacacgtaggtaacctgtctttaagacgaggataaccgatggaaacgtcggataatactcgataggtaatctgagggcatcctaagattattaaagatttatcacttagagaggggcctgcggcgcattagctagatggcggggtaagagcccaccatggcgatgatgcgtagccggactgagaggttgaacggccacaatgggactgagaacggcccatactcctacgggaggcagcagtagggaattttcggcaatgggcgaaagcctgaccgagcaatgccgcgtgaacgaagaagtatttcggtatgtaaagttcttttattggggaagaaaaataaccaaattgacggtacccaatgaataagctccggctaactacgtgccagcagccgcggtaa

SEQ ID NO: 2178 - DNA, 490 bp, Unknown
  Ascusbbf_133772, encodes 16S rRNA
agagtttgatcatggctcaggacgaacgctggcggcgtgcctaatacatgcaagtcgagcgaatctttgggagcttgctcttttaagattagcggcggacgggtgagtaacacgtgggcaacctgcctgtaagacggggataactccgggaaaccggggctaataccggatgattcttctctgcacatgcagggaagctaaaagatggtttacgctatcgcttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtaccggagtaactgccggtaccttgacggtacct

SEQ ID NO: 2179 - DNA, 490 bp, Unknown
  Ascusbbf_1822299, encodes 16S rRNA
agagtttgatcctggctcagattgaacgctggcggcaggcctaatacatgcaagtcgaggggcagcgcgggtagcaatacctggcggcgaccggcgaaagggtgagtaacgcgtgagcaacgtgcccgtatgtgggggatagtcgatggaaacgtcgcgtaataccccgtaatacattctcccgcatgagaggatgttgaaagatttattgcatacggatcggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggaggacggccctatgggttgtaaaccgcttttgcgagggagcaataagggtaacgtgttgcccgatgagagtacctcgcgaataagcatc

SEQ ID NO: 2180 - DNA, 490 bp, Unknown
  Ascusbbf_1609513, encodes 16S rRNA
agagtttgatcctggctcaggacgaacgctggcggcgtgcctaacacatgcaagtcgaacgaggtccatccttcgggagaagacctagtggcgaacgggtgagtaacacgtgaggaacctgccccggagaccgggataaccattcgaaaggatggctaataccggatacccccatcttgtcgcatggcgagatgaggaaatggattccgctccgggagggcctcgcggcctatcagctagttggtgaggtaacggctcaccaaggcatcgacgggtagctggtctgagaggacgatcagccacactgggactgagacacggcccagactcctacgggaggcagcagtggggaatcttgcgcaatgggcgaaagcctgacgcagcaacgccgcgtgggggatgaaggctctcgggttgtaaacccctttcagcaggaacgaaaatgacggtacctgcagaagaagccccggctaactacgtgccagcagcc

SEQ ID NO: 2181 - DNA, 490 bp, Unknown
  Ascusbbf_62537, encodes 16S rRNA
agagtttgatcctggctcaggatgaacgctggcggcgtgcctaatacatgcaagtcgaacgagagaccccagcttgctgggcgatcgagtggcgaacgggtgagtaacacataaacaatctaccctgaagactgggataacgtagggaaacccacgctaataccggataggcagagggagggcatccttccactgttaaagttgggctacaacactgcaggatgagtttatgtcgcattagttagttggtgaggtaacggcccaccaagacgatgatgcgtagccggtctgagaggatgaacggccacattgggactgagacacggcccagactcctacgggaggcagcagtagggaattttcggcaatgggggaaaccctgaccgagcaacgccgcgtgaacgatgaaggtttttggatcgcagagttctgttgtaagggaagaaagctagagatagggaatgatctttagttgacggtaccttgccag

SEQ ID NO: 2182 - DNA, 470 bp, Unknown
  Ascusbbf_1410423, encodes 16S rRNA
agagtttgatcatggctcagaacgaacgctggcggcaggcttaacacatgcaagtcgagcgcactcttcggagtgagcggcagacgggtgagtaacacgtggaaatctacctatctctagggaataactcagggaaacttgtgctaataccctatacgtccgtaaggagaaagatttatcggagatagatgagcccgcgttggattagctagttggtgaggtaatggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaccgccctagggttgtaaagctctttcagtggggaagataatgacggtacccacagaagaagccccggctaacttcgtgccagcagccgcggtaat

SEQ ID NO: 2183 - DNA, 490 bp, Unknown
  Ascusbbf_314281, encodes 16S rRNA
agagtttgatcatggctcaggatgaacgctggcggcgtgcttaacacatgcaagtcgaacggggaacatttcattgaggcttcggcggatttggtctgtttctagtggcggacgggtgagtaacgcgtgggtaacctgccttatactgggggataacagccagaatggctgctaataccgcataagcgcacagaaccgcatggttccgtgtgaaaaactccggtggtataagatggacccgcgttggattagctagttggcagggcagcggcctaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagataatgacggtacctgactaagaagccccggctaa

SEQ ID NO: 2184 - DNA, 490 bp, Unknown
  Ascusbbf_1343808, encodes 16S rRNA
agagtttgatcatggctcaggataaacgctggcggcgcacataggacatgcaagtcgaacggaagccgtaataaaaatggattgaagatttatcagattgaagtttttattacaatgactttagtggcggactggtgagtaatgtataagtaacctgcctattagaggggaacaacagttggaaacgactgctaataccgcatatgccataggaatcgcatggttccagtgggaaaggagcaatccgctaatagatggacttatatctgattagtcagttggtggggtaacggcctaccaagacgacgatcagtagccggactgagaggttaaacggccacattgggactgagatacggcccagactcctacgggaggcagcagtcggggatattgcgcaatggaggaaactctgacgcagtgacgccgcgtacaggaagaaggttttcggattgtaaactgctttagacagggaagaaaatagacagta

SEQ ID NO: 2185 - DNA, 490 bp, Unknown
  Ascusbbf_52271, encodes 16S rRNA
agagtttgatcatggctcaggatgaacgctggcggcgtgcttaacacatgcaagtcgaacgaagcactgggaatgagatcttcggatggattttcctttgacttagtggcggacgggtgagtaacgcgtgggtaacctgccgtatgcagggggacaacagttggaaacggctgctaataccgcgtaagcgcacgacaccgcatggtgacgtgtgaaaagatttatcggcatacgatggacccgcgtctgattaggtagttggtgaggtaacggcccaccaagccgacgatcagtagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaagatgacggtacctgcacaagaagccccggct

SEQ ID NO: 2186 - DNA, 490 bp, Unknown
  Ascusbbf_53877, encodes 16S rRNA
agagtttgatcctggctcaggatgaacgctagcggcaggcctaacacatgcaagtcgaggggtatagagtagcttgctattctagagaccggcgcacgggtgagtaacgcgtatgcaacctaccttttacaaagggatagcccggagaaattcggattaataccttatagtattacgatatagcattgtattgtaattaaagttttaacggtaaaagatgggcatgcgtcctattagttagatggtgtggtaacggcacaccatgactgcgataggtaggggtcctgagagggagatcccccacactggaactgagacacggaccagactcctacgggaggcagcagtgaggaatattggacaatggtcgcaagactgatccagccatgccgcgtgcaggaagactgccctatgggttgtaaactgcttttatatgggaagaataagggctacgtgtagcctgatgacggtaccatatgaataagcatcg

SEQ ID NO: 2187 - DNA, 490 bp, Unknown
  Ascusbbf_1371494, encodes 16S rRNA
agagtttgatcatggctcaggataaacgctggcggcgcacataagacatgcaagtcgaacggaagtcgttataattgatatggattgaagatttctcggattgaagttgattttataacaatggctttagtggcggactggtgagtaacgcgtgagcaacctgcctatcagaggggaataacagtgagaaatcattgctaataccgcatatgccataatcaccacatggtgatagtgggataggagcaatccgctgatagatgggctcgcgtctgattagatagttggtggggtaacggctaaccaggtggacgaccattagccgtactgggaggttgaacggcaacattgggactgagatacggcccagactcctacgggaggcagcagtcgggaatattgcgcaatggaggaaactctgacgcagtgacgccgcgtataggacgaaggtcttcggattgtaaactattgtcgttagggaagaaaaagg

SEQ ID NO: 2188 - DNA, 490 bp, Unknown
  Ascusbbf_390584, encodes 16S rRNA
agagtttgatcctggctcaggatgaacgctggctacaggcttaacacatgcaagtcgaggggaaacgacgggggagcttgctttcccgggcgtcgaccggcgaatgggtgagtaacgcgtatccaacctgccgccaagcagcggataacccgtggaaatgcggactaatacgctatgcggtccttggagggcatctgacgaggacgaaaggcattccgcttggcgatggggatgcgtccgattaggcagtaggcggggcaacggcccacctagccttcgatcggtaggggttctgagaggaaggtcccccacactggtactgagacacggaccagactcctacgggaggcagcagtgaggaatattggtcaatgggcggtagcctgaaccagccaagtagcgtgcgggacgaaggccctacgggtcgtaaaccgcttttgcgcggggataaagtggcccacgtgtgggtctttgcaggtaccgcgcgaat

SEQ ID NO: 2189 - DNA, 490 bp, Unknown
  Ascusbbf_253141, encodes 16S rRNA
agagtttgatcctggctcaggatgaacgctggcggcgtgcctaacacatgcaagtcgaacgattaaagcccctccgggggtgcatagagtggcgaacgggtgagtaacacgtgaccaacccgccccggacaccgggacaacgggcggaaacgcctgctaataccggatactccgcgacggacgcatgtccgacgcgggaaagcccaggcggtccgggatggggtcgcggcccatcagctagacggcggggtgacggcccaccgtggcgactacgggtagccgggttgagagaccgaccggccacattgggactgagacacggcccagactcctacgggaggcagcagtggggaatattgcgcaatgggggcaaccctgacgcagcaacgccgcgtgcgggacgaaggccttcgggtcgtaaaccgctttcaccggggaagaccaagcgactgtacccggggaagaagccccggctaaatacgtgccagca

SEQ ID NO: 2190 - DNA, 490 bp, Unknown
  Ascusbbf_374087, encodes 16S rRNA
agagtttgatcctggctcaggacgaacgctggcggcgtgcctaacacatgcaagtcgaacgggggcgcgacaaaaccgaggcttcggccaaggcgttgcgccttagtggcggacgggtgagtaacgcgtggacaacctgccgcctgctgggggataacagggggaagcccctgctaataccgcataagccctttctgggacatcccagggaggggaaaggtttatccggcaggcgatgggtccgcgtccgattagccagttggcggggtaacggcccaccaaagcgacgatcggtagccggcctgagagggcggacggccacattgggactgagatacggcccagactcctacgggaggcagcagtgggggatattgcacaatggggggaaccctgatgcagcgacgccgcgtgggcgaagtagcgcttcggcgcgtgaagccctttcggcaggagggaaacagacggtacctgcagaagaagcaccggc

SEQ ID NO: 2191 - DNA, 490 bp, Unknown
  Ascusbbf_189127, encodes 16S rRNA
agagtttgatcctggctcaggatgaacgctagctacaggcttaacacatgcaagtcgaggggaaacgacatagagtgcttgcactttatgggcgtcgaccggcgaatgggtgagtaacgcgtatccaacctgcccttgactgagggatagcccagtgaaaactgaattaatacctcatgtcctcctcagacggcatcagacgaggagtaaagattaatcggtcaaggatggggatgcgtctgattagctagttggtggggcaacggcctaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagaaggccttcgggtcgtaaagctctgttgtcggggacgaatgtacgagctatcaacaacagcttgtaatgacggtacc

SEQ ID NO: 2192 - DNA, 490 bp, Unknown
  Ascusbbf_35774, encodes 16S rRNA
agagtttgatcatggctcaggacgaacgctggcggcgtgcctaacacatgcaagtcgagcggagataatgaacttcggtttattatttcagcggcggacgggtgagtaacgcgtgaaggacctgcccccgacagagggataacatcgagaaatcggtgctaataccgcataagaccacggtgctgcatggcactgaggtaaaaggagcaatccggtcggggatggcttcgcgtcccattagatcgtaggcggggtaacggcccacctagtcaacgatgggtagccgacctgagagggtgatcggccacactggaactgagacacggtccagactcctacgggaggcagcagtgggaatattgggcaatgggcgaaagccttacccagcaacgccgcgtgagagaagaaggttttcggattgtaaatctctgtcctgggggacgaaggaagtgacggtaccccgggaggaagccccggctaactacgtgcc

SEQ ID NO: 2193 - DNA, 490 bp, Unknown
  Ascusbbf_122097, encodes 16S rRNA
agagtttgatcatggctcaggatgaacgctggcggcgtgcctaacacatgcaagtcgaacggggttataaggaatgagattcgtcgaatgaattataacttagtggcggacgggtgagtaacgcgtgggtaacctgcctcatcgaggggaataacagttggaaacggctgataataccgcataagcgcacagcagcgcatgctggagtgtgaaaagatttatcgcgatgagatggacccgcgtctgattaactagttggcagggtaacggcctaccaaggtgacgatcagtagccggactgagaggttgaacggccacattgggactgagacacggcccaaactcctacgggaggcagcagtgggggatattgcacaatggggggaaccctgatgcagcgacgccgcgtgggtgaagaagtctttcgggatgtaaagccctatcagcagggaagataatgacggtacctgcagaagaagccccggctaac

SEQ ID NO: 2194 - DNA, 470 bp, Unknown
  Ascusbbf_23290, encodes 16S rRNA
agagtttgatcctggctcagaacgaacgctggcggcaggcctaacacatgcaagtcgaacgccctagcaatagggagtggcagacgggtgagtaacgcgtgggaaccttcccaatggtacggaatagcccagggaaacttggagtaataccgtataagcccgcaaggggaaagatttatcgccattggatgggcccgcgtaggattagctagttggtgaggtaatggctcaccaaggcgacgatccttagctggtctgagaggacgaccagccacactgggactgagacacggcccagactcctacgggaggcagcagtggggaatattggacaatgggcgcaagcctgatccagccatgccgcgtgagtgatgaaggccttagggttgtaatgctcttttagcggggaagataatgacggtacccgcagaataagccccggctaacttcgtgccagcagccgcggtaat

SEQ ID NO: 2195 - DNA, 490 bp, Unknown
  Ascusbbf_116299, encodes 16S rRNA
agagtttgatcatggctcaggattaacgctggcggcgtgcctaacacatgcaagtcgagcgagaattagaggaatgattcttcggatgaatttctttaaggacagcggcggacgggtgagtaacgcgtgggcaacctgcccctttccggaggatagccaagggaaactttgaataatactccataaagcatttctgccgcatgacagagatgccaaagatttatcggagagggatgggcccgcgtctgattagccagttggtgaggtagcggctcaccaaagcgacgatcggtagccggcctgagagggtgaacggccacattggaactgagacacggtccagactcctacgggaggcagcagtggggaatattgcacaatgggcggaagcctgatgcagcaacgccgcgtgaaggaagaaggttttcggatcgtaaacttctgtccctggggaagaagaaagtgacggtacccaaggaggaagccccgg

SEQ ID NO: 2196 - DNA, 490 bp, Unknown
  Ascusbbf_1586, encodes 16S rRNA
agagtttgatcatggctcaggatgaacgctagcgacaggcctaacacatgcaagtcgaggggcagcgagaggaaagcttgcttttcttgtcggcgaccggcgcacgggtgagtaacgcgtatgcaacctggctactgctacgggatagccttgcgaaagtaagattaataccgtatgtgctgagtttagacatctttattcagtgaaagatttatcggcagtagatgggcatgcgtctgattagttagttggcggggtaacggcccaccaaggcgacgatcagtaggggttctgagaggaaggtcccccacattggaactgagacacggtccaaactcctacgggaggcagcagtgaggaatattggtcaatggacggaagtctgaaccagccaagtcgcgtgaaggaagacggttctatggattgtaaacttcttttgctcgagggtaaagtgtggtacgtgtaccatattgcaagtatcgagtgaata

SEQ ID NO: 2197 - DNA, 490 bp, Unknown
  Ascusbbf_845, encodes 16S rRNA
agagtttgatcatggctcaggatgaacgctagctacaggcttaacacatgcaagtcgagcggaacactttcgggtgtttagcggcagacgggtgagtaacacgtatccaacctttcccttactcgggtatagcctttagaaatgaagagtaatccccgatgtggtgcacagtccgcatgttttgcgcactaaagattaatcggtaaggggtggggatgcgttccattaggtagtaggcggggtaacggcccacctagccgatgatggataggggttctgagaggaaggtcccccacattggaactgcgacacggtccaaactcctacgggaggcagcagtgaggaatattggtcaatgggcgagagcctgaaccagccaagtagcgtgcaggatgacggccctatgggttgtaaactgcttttatacgggaataacggtaggctcgtgagcctatgtgcatgtaccgtatgaataaggatcggctaactc

SEQ ID NO: 2198 - DNA, 490 bp, Unknown
  Ascusbbf_3228, encodes 16S rRNA
agagtttgatcatggctcaggacgaacgctggcggcgtgcctaacacatgcaagtcgaacgaacttactagcaatagtaagttagtggcggacgggtgagtaatacatgagtaacctgccttatacagggggataacacctagaaatgggtgctaataccgcataataactcagtatggcatcatattgagaggaaaggagcaatccggtaaaagatggactcatgttcgattagctagttggtgaggtaatggctcaccaaggcaacgatcgatagccgaactgagaggttgatcggccacattggaactgagaaacggtccagactcctacgggaggcagcagtggggaatattgcgcaatgggggaaaccctgacgcagcaacgccgtgtgaaggaagaaggctctagggttgtaaacttctttgattagggacgaaacaaatgacggtacctaaagaacaagccacggctaactacgtgccagcag

SEQ ID NO: 2199 - DNA, 490 bp, Unknown
  Ascusbbf_43325, encodes 16S rRNA
agagtttgatcatggctcaggatgaacgctggcggcgtgcctaatacatgcaagtcgaacgagggtgcttgcaccctagtggcgaacgggtgagtaacacgtaggtaacctgccttttagcttgggatacccagaggaaactttggctaataccggataacaacagatgaggcatctcaactgtttgaaaggcccttatggggtcactaaaagatggacctgcggcgcattagctagttggtgagataacagcccaccaaggcgaggatgcgtagccgacctgagagggtgatcggccacattggaactgagacacggtccaaactcctacgggaggcagcagtaaggagttttcggcaatgggggaaaccctgaccgagcaacgccgcgtgagcgatgacggccctatgggttgtaaagctctgttgtgagggacgaactgtaagcttaggaaatgaagcttacctgacggtaccttaccagaaagcca

SEQ ID NO: 2200 - DNA, 490 bp, Unknown
  Ascusbbf_149885, encodes 16S rRNA
agagtttgatcatggctcaggacgaacgctggcggcgtgcctaatacatgcaagtcgagcggacttgatggagtgcttgcactcctgaaggttagcggcggacgggtgagtaacacgtaggcaacctgccctcaagactgggataactaccggaaacggtagctaataccggataatttattttgcagcattgtgaaataatgaaaggcggagcaatctgtcacttgaggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgtcttctagagtaactgctaggagagtgacggta

SEQ ID NO: 2201 - DNA, 490 bp, Unknown
  Ascusbbf_72286, encodes 16S rRNA
agagtttgatcatggctcaggatgaacgctggcggcgtgcctaacacatgcaagtcgaacgaagcacttttcccgaggaagaagcgtgcttgcacaaatcggactcatttaaagtgacttagtggcggacgggtgagtaacgcgtgggtaacctgccttatacagggggataacagttagaaatgactgctaataccgcataagcgcacggtatcgcatgatacagtgtgaaaagcgtaacggtataagatggacccgcgtctgattagccagttggtgaggtaacggctcaccaaagcgacgatcagtagccggcctgagagggtgaacggccacattgggactgagacacggcccaaactcctacgggaggcagcagtgggggatattgcacaatgggggaaaccctgatgcagcgacgccgcgtgagtgatgaagtatttcggtatgtaaagctctatcagcagggaagaaaatgacggtacctgac

SEQ ID NO: 2202 - DNA, 490 bp, Unknown
  Ascusbbf_221227, encodes 16S rRNA
agagtttgatcatggctcaggatgaacgctggcggcgtgcctaacacatgcaagtcgaacgaggctctgcggtatgaagattcgtctgaataccaaggatgtccgagtggcggatgggtgagtaacgcgtggagaacctgcccttatcagggggataacaactggaaacggttgacaataccgcatacgctctgtttaccgcatggtatacagaggaaagattatatcggataaggatggctccgcgtcggattagccagttggcggggtaacggcccaccaaagcgacgatccgtagccggcctgagagggcgaccggccacattgggactgagacacggcccagactcctacgggaggcagcagtgggggatattgcacaatggggggaaccctgatgcagcgacgccgcgtggaggaggaagtatttcggtatgtaaactcctatcagcagggaagaaaatgacggtacctgactaagaagccccgg

SEQ ID NO: 2203 - DNA, 490 bp, Unknown
  Ascusbbf_191712, encodes 16S rRNA
agagtttgatcctggctcaggatgaacgctggcggcgtgcctaatacatgcaagtcgaacgaggattcaagggagcttgctcctgagaaacctagtggcgaacgggtgagtaacacgtaggtaacctgccttttagcttgggatacccagaggaaactttggctaataccggataacaacaaccgaggcatctcggatgcttgaaaggccctgcaaggggtcactaaaagatggacctgcggcgcattagctagttggtgagataacagcccaccaaggcgaggatgcgtagccgaactgagaggttgatcggccacattggaactgagacacggtccaaactcctacgggaggcagcagtaaggagttttcggcaatgggggaaaccctgaccgagcaacgccgcgtgtgtgatgacggccctatgggttgtaaagcacttttataagagacgaatggtgagtttaggaaatgaagctcacttgactgt

SEQ ID NO: 2204 - DNA, 490 bp, Unknown
  Ascusbbf_323733, encodes 16S rRNA
agagtttgatcctggctcaggacgaacgctggcggcatgcttaacacatgcaagtcgaacggacgaccggattcagaatcttcggaagacgaatttggaagttagtggcggacgggtgagtaacgcgtgggtaacctgccctttaaattgggacaacagttggaaacgactgctaataccgaatgagtcgatgataaggcatcttgttatcgggaaaggcggcctctcaaagaagctgtcgttaaaggatggacccgcgtctgattagcttgttggtaaggtaggggcttaccaaggcgacgatcagtagccgacctgagagggtgaccggccacattgggactgagacacggcccagactcctacgggaggcagcagtggggaattttccgcaatgggcgcaagcctgacggagcaatgccgcgtgaatgaagaaggtcttcggatcgtaaagttctgtcatcggggaagaacggacaatagtttaaga

SEQ ID NO: 2205 - DNA, 490 bp, Unknown
  Ascusbbf_931646, encodes 16S rRNA
agagtttgatcctggctcaggattaacgctggcggcgcacataagacatgcaagtcgaacggaagtcgttaccaaaggaagtgaagatttatcggaacggaatttagtaacaatggctttagtggcggactggtgagtaacacgtaagtaacctgcctatcagaggggaataacagtgagaaatcattgctaataccgcataagctgacagtatcgcatgatacagttagaaaaggagcaatccgctgatagatggacttgcggccgattagccagttggtggggtaaaggcctaccaaagcaacgatcggtagccgagctgagaggctcaacggccacattgggactgagatacggcccagactcctacgggaggcagcagtcgggaatattgcgcaatggaggaaactctgacgcagtgacgccgcgtataggaagaaggttttcggattgtaaactattttagacagggaagaagatgacagtacct

SEQ ID NO: 2206 - DNA, 490 bp, Unknown
  Ascusbbf_143510, encodes 16S rRNA
agagtttgatcctggctcaggatgaacgctggcggcgtgcataacacattcaagtcgaacggtgaagcaccttcgggtgtggagcagtggcggacgggtgagtaacgcgtgagcaacctgccgtatagtgggggataacacagggaaacttgtgctaataccgcataacgcatagggaccgcatgatctttatgccaaagatttattgctgtacgatgggctcgcgtatgattagacagttggcagggtaacggcctaccaaatcaacgatcattagccgaactgagaggttgaacggccacattggaactgagaaacggtccagactcctacgggaggcagcagtggggaatattgggcaatgggcgaaagcctgacccagcgacgccgcgtgagggaagaaggtcttcggattgtaaacctctttcagcagggaagaaggaagtgacggtacctgcagaagaagtcacggctaactacgtgccagcag

SEQ ID NO: 2207 - DNA, 490 bp, Unknown
  Ascusbbf_91467, encodes 16S rRNA
agagtttgatcatggctcaggatgaacgctggcggcgtgcctaatacatgcaagtcgaacgggtacagctatgtactagtggcgaacgggtgagtaacacgttggtgacctgccccaaagatgggaatatcggctggaaacggccggcaaaaccgaataagcttatccggatcagaagaggataagtaaaagcgcaagctactttgggaggggcctgcggcccatcagttagttggtgagggtaacggcccaccaagacgaagacgggtaggggacctgagagggtggtcccccacaatggaactgaaacacggtccatacacctgcgggtggcagcagtagggaatattgctaaatgggcgaaagcctgaagcagcaacgccgcgtggacgaaggaggccttcgggtcgtaaagtccttttataggggaaaaggaaggatggtaccctatgaataagtctcggctaactacgtgccagcagccgcggta

SEQ ID NO: 2208 - DNA, 490 bp, Unknown
  Ascusbbf_4394, encodes 16S rRNA
agagtttgatcatggctcaggacgaacgctggcggcgtgcctaacacatgcaagtcgaacggagatattccggattgagatttcggttgattgaaaggatatcttagtggcggacgggtgagtaacgcgtgagtaacctgcccataagagggggataacgttctgaaaagaacgctaataccgcataacatatgtaattcgcatggaagacatatcaaaggagcaatccgcttatggatggactcgcgtccgattagctagttggcgggataacagcccaccaaggcgacgatcggtagccggactgagaggttgaacggccacattgggactgagacacggcccagactcctacgggaggcagcagtgggggatattgcgcaatgggggaaaccctgacgcagcaacgccgcgtgaatgaagaaggtcttcggattgtaaaattcttttgttgaggacgaaagaaatgacggtactcaacgaataagct

SEQ ID NO: 2209 - DNA, 490 bp, Unknown
  Ascusbbf_32025, encodes 16S rRNA
agagtttgatcctggctcaggacgaacgctggcggtgtgcctcatacatgcaagtcgaacgagaagctgaagcttgcttcagtggaaagtggcggacgggtgagtaatgtgtagaaaatctgccctagagagggggacaacagagggaaactcctgctaataccccatatgagctaagttgaaatacttatcttgaaaactccggtgctctaggatgagtctgcatctgattagctagttggtggtgtaatggactaccaaggcgacgatcagtagctggtttgagaggatgatcagccacaatgggactgagacacggcccatactcctacgggaggcagcagtagggaattttgcgcaatgggcgaaagcctgacgcagcaacaccgcgtgaacgttaagcccttcggggtataaagttctgtcactggggaagaataaatgactgtacccagagaggaagcaccggctaactccgtgccagcagccg

SEQ ID NO: 2210 - DNA, 490 bp, Unknown
  Ascusbbf_154908, encodes 16S rRNA
agagtttgatcatggctcagattgaacgctggcggcatgctttacacatgcaagtcgaacggcagcacgggtgcttgcacctggtggcgagtggcgaacgggtgagtaatgcgtcggaacgtaccgagtaatgggggataactaatcgaaagattggctaataccgcatacgcccttagggggaaagcaggggatcttcggaccttgcgttattcgagcggccgacgtctgattagctagttggtggggtaaaagcctaccaaggcgacgatcagtagcgggtctgagaggatgatccgccacactgggactgagacacggcccagactcctacgggaggcagcagtggggaattttggacaatgggcgaaagcctgatccagccatgccgcgtgtatgaagaaggccttcgggttgtaaagtacttttgttagggaagaaaagcttgaggttaatacccttgagtcatgacggtacctaaagaataagc

SEQ ID NO: 2211 - DNA, 490 bp, Unknown
  Ascusbbf_725418, encodes 16S rRNA
agagtttgatcctggctcaggatgaacgctggcggcatgcctaagacatgcaagtcgaacgaagtggcccaacaaaaactgagtgcttgcacaaagttggcgatggaatttccacttagtggcagacgggtgagtaacacgtaagtaatctgccctagagactgggataatgtctggaaacggacactaataccggataattcatatttagataactagatatgctaaaaggagcgtttgctccactctaggatgagcttgcggcgtattaactagttggtggggtaatggcctaccaaggtgacgatgcgtagccgaactgagaggttgatcggccacattgggactgagacacggcccaaactcctacgggaggcagcagttaggaatattcgtcaatgggggaaaccctgaacgagcaatgccgcgtgagtgatgacggtctttatgattgtaaaactctgttgtaaggaacgaacccttaggatag

SEQ ID NO: 2212 - DNA, 490 bp, Unknown
  Ascusbbf_1510725, encodes 16S rRNA
agagtttgatcatggctcaggatgaacgctagcggcaggcctaacacatgcaagtcgaggggtatagagagcttgctttctagagaccggcggatgggtgagtaacgcgtatgcaacctaccttttacaggggaatagcccggagaaattcggattaatgctccatggtttaattgaatggcatcgtttgattaataaagatttatcggtaaaagatgggcatgcgtatcattagctagttggtgtggtaacggcataccaaggctacgatgattaggggtcctgagagggagatcccccacactggtactgagacacggaccagactcctacgggaggcagcagtgaggaatattggtcaatggaggcaactctgaaccagccatgccgcgtgcaggatgacggtcctatggattgtaaactgcttttgtacgggaagaaatgtaattacgtgtaattatttgacggtaccgtaagaataaggatcggc

SEQ ID NO: 2213 - DNA, 490 bp, Unknown
  Ascusbbf_39677, encodes 16S rRNA
agagtttgatcctggctcaggatgaacgctagcgacaggcttaacacatgcaagtcgaggggtaacatgggggtggcaacactcctgatgacgaccggcgcactggtgagtaacacgtatgcaacctgccccctgcaggggaataacccagggaaacttggcctaatgccgcataacacggctcgccgcatggcgtgccgttgaaagctccggcggcaggggatgggcatgcgcagcattagcttgttggcggggtgacggcccaccaaggcgacgatgcttaggggttctgagaggaaggtcccccacactggtactgagacacggaccagactcctacgggaggcagcagtgaggaatattggtcaatggccgcagggctgaaccagccaagtcgcgtgagggaagacggccctacgggttgtaaacctcttttgccggggagtaacgtggcgcacgcgtgcgtcagtgagagtacccggagaaaaag

SEQ ID NO: 2214 - DNA, 490 bp, Unknown
  Ascusbbf_339751, encodes 16S rRNA
agagtttgatcctggctcagaacgaacgctggcggcatggattaggcatgcaagtcgaacgggagcagcaatgctccagtggcgcaagggtgaggaacacgtgaacaacctaccttcgagttggggatagcttctggaaacgggagataataccgaataacatcttttttccgcatggagaattgatcaaagcagcaatgcgcttgaagaggggttcgcgtcccattagctagttggtgaggtaacggcccaccaaggcgatgatgggtagctggtctgagaggacgatcagccacattgggactgagatactgcccagacccctacgggaggctgcagtcgagaattttgggcaatggacgaaagtctgacccagcaatgccgcgtgcgggatgaaggtcttcggattgtaaaccgctgtcaagagggacgaaatttgacggtacctctggaggaggccacggctaactacgtgccagcagccgcggta

SEQ ID NO: 2215 - DNA, 471 bp, Unknown
  Ascusbbf_126017, encodes 16S rRNA
agagtttgatcctggctcagaacgaacgctggcggcaggcctaaaacatgcaagttgaacggccatagcaatatggcagtagcgcaagggtgagtaatgtatgggaacgtatcttttggtggggaatattctttggaaacgaagagcaataccgcataagccctacgggggaaagatttatcgccgattgagcggcccatattggattagctagttggttaggtaatggctgaccaaggctgtgatccatagctggtctgagaggacgatcagccacactgggactgagacacggcccagactcctacgggaggcagcagttaggaatattggacaatgggggcaaccctgatccagccatgccgcgtgagtgttaaggccttcgggttgtaaagctcttttgtatgggaaaatgatgatggtaccataagaataagcaccggctaacttcgtgccagcagccgcggtaat

SEQ ID NO: 2216 - DNA, 490 bp, Unknown
  Ascusbbf_327753, encodes 16S rRNA
agagtttgatcatggctcaggacgaacgctggcggcgcgcctaacacatgcaagtcgaacgggactagtgaccggagcttagaaactttctaggttgcgttcactagttcagtggcggacgggtgagtaaagcatgagtaactttcccataagtggggaatagcttttggaaacagaagataataccgcatgaatcgttgaggacacatgttcacatcggaaaagaagcaattcgcttatggataggctcatgtctgattagcttgttggtgaggtaatggctcaccaaggcgatgatcagtagccgtaccgagaggttcaacggccacattgggactgagacacggcccagactcctacgggaggcagcagtgaggaatattgcgcaatggaggaaactctgacgcagcgacgccgcgtgaaggaagaaggtcttcggattgtaaacttctgtcttcagggaagaaacaaatgacggtacctggggagg

SEQ ID NO: 2217 - DNA, 490 bp, Unknown
  Ascusbbf_91000, encodes 16S rRNA
agagtttgatcatggctcaggacgaacgctggcggcgtgcttaacacatgcaagtcgaacgaggttgccctttgtgaatccttcgggaggaactgtgggtataccgagtggcggacgggtgagtaacgcgtgagcaacctgccctgcaacgggggacaacagttggaaacgactgctaataccgcatgagaccacgaaaccgcatggttttgaggtaaaaggatttattcgatgcaggatgggctcgcgtcccattagatagttggtgaggtaacggcccaccaagtcaacgatgggtagccgacctgagagggtgatcggccacactggaactgagacacggtccagactcctacgggaggcagcagtggggaatattgggcaatgggggaaaccctgacccagcaacgccgcgtgagggaagaaggtcttcggattgtaaacctttgtcctatgggacgaaagaaatgacggtaccataggaggaagc

SEQ ID NO: 2218 - DNA, 490 bp, Unknown
  Ascusbbf_16587, encodes 16S rRNA
agagtttgatcatggctcaggatgaacgctggcggcgtgcctaatacatgcaagtcgaacgctaatcttcggattagagtggcgaacgggtgagtaacacgtaggtaacctgcccataagacgaggataactactggaaacggtagctaatactggatagtatatgaagtcgcatggctttatatttaaaggtgctctcaagcatcacttatggatggacctgcggcgcattagctagttggtgaggtaacggcccaccaaggcgacgatgcgtagccggactgagaggttgaacggccacattgggactgagacacggcccagactcctacgggaggcagcagtagggaattttcggcaatggacgcaagtctgaccgagcaacgccgcgtgagtgatgaagttcttcggaacgtaaaattcttttatttggaaaaaacgtatagtgtaggaaatgacattatagtgatggtaccaaatgaataagccc

SEQ ID NO: 2219 - DNA, 490 bp, Unknown
  Ascusbbf_694925, encodes 16S rRNA
agagtttgatcatggctcaggatgaacgctggcggcgtgcctaacacatgcaagtcgaacgaagcactcttgttgatccttcgggagaagcgaaagtgactgagtggcggacgggtgagtaacgcgtgggtaacctgccctgtacagggggataacagtcagaaatgactgctaataccgcataagcgcacggagggacatccttctgtgtgaaaaactccggtggtacaggatgggcccgcgtctgattagctagttggcggggtaagggcccaccaaggcgatgatcagtagccggtctgagaggatgaacggccacatcggaactgagacacggtccaaactcctacgggaggcagcagtggggaatattgcacaatggggggaaccctgatgcagcaacgccgcgtgagtgaagaagtatttcggtaggtaaagctctatcagcagggaagataatgacggtacctgactaagaagctccggctaa

SEQ ID NO: 2220 - DNA, 490 bp, Unknown
  Ascusbbf_262566, encodes 16S rRNA
agagtttgatcctggctcaggatgaacgctggcggcatgcctaagacatgcaagtcgtacgaagtgaccctttgaagtggagtgcttgcacaaaacggattaggattttcacttagtggcgcaagggtgagtaacacgtgggtaatctgccttcgagactgggataacaattggaaacgattgctaataccggatgatatatataacacaatgttgtatagtaaaaggagcctttaaagcttcacttgaagatgagcctgcggcgcattagctagttggtaaggtaatggcttaccaaggcaacgatgcgtagccgaactgagaggttgatcggccacattgggactgagacacggcccaaactcctacgggagacagcagttaggaatattcgtcaatgggggaaaccctgaacgagcaatgccgcgtgaatgatgacggtcctttggattgtaaaattctgttgttgaggaagaacggttagtatagg

SEQ ID NO: 2221 - DNA, 490 bp, Unknown
  Ascusbbf_168198, encodes 16S rRNA
agagtttgatcatggctcagattgaacgctagcgggatgccttacacatgcaagtcgaacggcagcgggaagaaagcttgctttctttgccggcgagtggcgaacgggtgagtaatgtatcggaacgtgcccagtagcgggggataactggccgaaaggtcagctaataccgcatacgccctacgggggaaagggggggactcttcggagcctctcactattggagcggccgatatcggattagctagttggtggggtaatggcctaccaaggcgacgatccgtagctggtttgagaggacgaccagccacactgggactgagacacggcccagactcctacgggaggcagcagtggggaattttggacaatggggggaaccctgatccagccatcccgcgtgtgcgatgaaggccttcgggttgtaaagcacttttgtcagggaagaaaagactatcgataataccggtggtcgatgacggtacctgaa

SEQ ID NO: 2222 - DNA, 490 bp, Unknown
  Ascusbbf_32714, encodes 16S rRNA
agagtttgatcctggctcaggatgaacgctagcggcaggcttaacacatgcaagtcgaggggcagcatgggagcgtagcaatacattcccgatggcgaccggcgcaagggtgcgtaacgcgtgagcaacttgcccgcatcaggggcataatcggtggaaacgccgtctaactccccataacatagagagtggcatcactttttattgaaatcccaggaggatgcggatgggctcgcgtgacattaggcagttggcggggtaacggcccaccaaaccgacgatgtctaggggaactgagaggttaatcccccacactggaactgagacacggtccagactcctacgggaggcagcagtgaggaatattggacaatggagggaactctgatccagccatgccgcgtgcaggataaggtcctatggattgtaaactgcttttgtatgagagcaataaggatcacgtgtggtccgatgagagtatcatacgaat

SEQ ID NO: 2223 - DNA, 490 bp, Unknown
  Ascusbbf_13568, encodes 16S rRNA
agagtttgatcatggctcaggatgaacgctagcggcaggcttaacacatgcaagtcgaggggcagcgagtgtagcaatacatgtcggcgaccggcggaagggtgcgtaacgcgtgagcaacatgcccgtgatcgggggatagtcattggaaacgatgcgtaataccccataacaacgaggaccgcatggtccacgtttgaaagcttcggtgatcacggattggctcgcgtggcattagccagtaggcggggtaacggcccacctaagcgacgatgcctaggggttctgagaggaagatcccccacattgggactgagacacggcccaaactcctacgggaggcagcagtgaggaatattggtcaatggacggaagtctgaaccagccatgccgcgtgaaggaaggcggccctatgggttgtaaacttcttttgtagtggagcaataaggtgtacgtgtacaccgatgagagtacattacgaataagcatc

SEQ ID NO: 2224 - DNA, 490 bp, Unknown
  Ascusbbf_89508, encodes 16S rRNA
agagtttgatcatggctcaggacgaacgctggcggcgtgcctaacacatgcaagtcgagcggggatacagggaacggaggcttcggcggaagggagctgtattccagcggcggacgggtgagtaacgcgtgaatgatctgtcccagacagggggataacacttggaaacaggtgctaataccgcataagaccacgaagctgcatggctaaggggtaaaaggagcgatccggtttggggtgagttcgcgtctgattagctagttggtgaggtaagggcccaccaaggcgacgatcagtagccgacctgagagggtgatcggccacattggaactgagacacggtccaaactcctacgggaggcagcagtgggaatattgggcaatgggcgaaagcctgacccagcaacgccgcgtgagggaagaaggttttcggattgtaaacctctgttgtggatgacgaaggaagtgacggtaatccacaaggaagccc

SEQ ID NO: 2225 - DNA, 490 bp, Unknown
  Ascusbbf_438640, encodes 16S rRNA
agagtttgatcctggctcaggacgaacgctggcggcgtgcttaacacatgcaagtcgaacgagaggacatgaaaagcttgctttttatggaatcgagtggcaaacgggtgagtaacgcgtaagcaacctgccctgcagatggggacaacagctggaaacggctgctaataccgaatacgaagcagctcccgcatgggggcagcttgaaaggatggcctctgaatatgctatcgctgcaggaggggcttgcgtctgattagctggttggaggggtaacggcccaccaaggcgacgatcagtagccggtctgagaggatgaacggccacattgggactgagacacggcccagactcctacgggaggcagcagtggggaatcttccgcaatggacgaaagtctgacggagcaacgccgcgtgagtgaagacggccttcgggttgtaaagcactttcggaggggaggaacaaatgacgttaccctcagaagaag

SEQ ID NO: 2226 - DNA, 490 bp, Unknown
  Ascusbbf_1233946, encodes 16S rRNA
agagtttgatcctggctcaggatgaacgctggcggcatgcctaagacatgcaagtcgaacggagtggcctttagaagatggagtgcttgcacaaaatcggacaaagattaccacttagtggcagacgggtgagtaacacgtgggtaatctacctcagggactgggacaacagttggaaacgactgctaataccggatgattcatatttacaaaagtaaatatgctaaaaggggcttcggcctcaccttgtgatgagcttgcggtgtattagctagttggtggggtaatggcctaccaaggcaacgatgcatatccgagctgagaggctgatcggacacattgggactgagacacggcccagactcctacgggagacagcagttaggaatattcgtcaatgggggaaaccctgaacgagcaatgccgcgtgagtgatgacggtcttattgattgtaaaactctgttgtgaaggaagaaaccttatcatagg

SEQ ID NO: 2227 - DNA, 490 bp, Unknown
  Ascusbbf_143770, encodes 16S rRNA
agagtttgatcctggctcagattgaacgctggcggcatgcctaacacatgcaagtcgaacgggagtagcaatactctagtggcggacgggtgaggaatacgtaggaatttgcccttaagtgggggataacccggggaaacccggattaataccgcatgacctcgaaagagcaaagtgggggatcgcaagacctcacgcttttggagaagcctacgtcggattagctagttggtgaggtaatggctcaccaaggcgacgatccgtaactggtctgagaggatgatcagtcacaccggaactgagacacggtccggactcctacgggaggcagcagtggggaatattggacaatgggcgcaagcctgatccagcaatgccgcgtgtgtgaagaaggccttcgggttgtaaagcactttaagttgggaagaaaaaactcgctctaacacagtgagtcttgacggtaccgacagaataagcaccggctaactct

SEQ ID NO: 2228 - DNA, 490 bp, Unknown
  Ascusbbf_46979, encodes 16S rRNA
agagtttgatcctggctcaggacgaacgctggcggcgtgcttcatacatgcaagtcgaacgagaagtcaccttcgggtgatggaaagtggcggacgggtgagtaacacgtaggaaatctgccctttagcggggggcaacagttggaaacgactgctaataccccatatgaggtaagctgaaatgcttatcttgaaaactccggtgctaaaggatgagcctgcggctgattagatagttggcggggtaaaggcccaccaagtcgacgatcagtagctggtttgagaggatgatcagccacaatgggactgagacacggcccatactcctacgggaggcagcagtagggaattttgcgcaatgggcgaaagcctgacgcagcaacgccgcgtgaatgttaagcccttcggggtgtaaagttctgtcagtggggacgaaacttgacggtacccacagaggaagcaccggctaactccgtgccagcagccgcgg

SEQ ID NO: 2229 - DNA, 490 bp, Unknown
  Ascusbbf_160957, encodes 16S rRNA
agagtttgatcatggctcaggatgaacgctggcggcgtgcttaacacatgcaagtcgaacgaagcataacttgtgaatttcttcggattgaagcagttatgactgagtggcggacgggtgagtaacgcgtgggtaacctgccttacacagggggacaacagagggaaacctctgctaataccgcataacccgctagggccgcatggcccggacggaaaagatttatcggtgtaagatggacccgcgtctgattagccagttggcggggtaacggcccaccaaagcgacgatcagtagccgaactgagaggttgaccggccacattgggactgagacacggcccagactcctacgggaggcagcagtggggaatattgcacaatggggggaaccctgatgcagcaacgccgcgtgagtgaagaagtatttcggtatgtaaagctctatcagcagggaagaaaatgacggtacctgactaagaagccccggc

SEQ ID NO: 2230 - DNA, 490 bp, Unknown
  Ascusbbf_178608, encodes 16S rRNA
agagtttgatcctggctcaggatgaacgctggcggcgtgcttaacacatgcaagtcgaacggaactcctatgaacgaggtttcggccaagtgaataggatgtttagtggcggacgggtgagtaacgcgtgagtaacctgccttggagtggggaataacacagtgaaaattgtgctaataccgcataatgcatttggatcgcatgattctgaatgccaaagatttatcgctctgagatggactcgcgtctgattagctagttggcggggcaatggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttgtcagggacgaagcaagtgacggtacctgacgaataagccac

SEQ ID NO: 2231 - DNA, 490 bp, Unknown
  Ascusbbf_1585314, encodes 16S rRNA
agagtttgatcctggctcagaacgaacgctggcagcgtggattaggcatgcaagtcgaacgggatccgcgaggtagcaatacttagcggtgagagtggcggattggggaggaacacgtgagcaacctgcctttgggttcgggaaaaccgttggaaacgacggctaataccggatgtggcgcccggcggcatcgccggagcgctaaagggggccgcaaggctcccgccctgagaggggctcgcgcaccatcagctagttggcggggtaacggcccaccaaggcacacggttagctggtctgagaggatgaccagccccactgggactgagatactgcccagactcctacgggaggctgcagtcgaggatcattcgcaatgggcgaaagcctgacgatgcgacgctgcgtggaggatgaaggccttcgggttgtaaactcctgtcatgagggaaaaggcggaggggcccaacacgcccccgagttgatggta

SEQ ID NO: 2232 - DNA, 490 bp, Unknown
  Ascusbbf_8539, encodes 16S rRNA
agagtttgatcatggctcaggacgaacgctggcggcgtgcctaatacatgcaagtagaacgctgaaagagggagcttgcttcttctggatgagttgcgaacgggtgagtaacgcgtaggtaacctgcctggtagcgggggataactattggaaacgatagctaataccgcataacagttgatttcgcatgaagtcaacttgaaaggaacaattgtttcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaataggtgtgggagtggaaagtccacactatgacggtagct

SEQ ID NO: 2233 - DNA, 490 bp, Unknown
  Ascusbbf_32738, encodes 16S rRNA
agagtttgatcctggctcagaacgaacgctggtggcgtgtcttatacatgcaagtcgagcgaggcagcaatgccgagcggcgaacgggtgagtaacgcgtaagcaatctgccccgtatcaggaaatacccgtgccaacgcgcggttaatgtccaggagagtggctagctgcatggctagttgactagagatttatcggtacgggatgagcttgcgtccgattagctagttggcggggcaacggcccaccaaggcgacgatcggtagccggcctgagagggtgatcggccacattgggactgagatacggcccagactcctacgggaggcagcagtagggaatattgcacaatggggggaaccctgatgcagcaacgccacgtgtgggaagaagcatttcggtgtgtaaaccactgtcgtgagggaataaggcctgttttaggacaggattgaatgtacctcgaaaggaagcaccggcaaacttcgtgcca

SEQ ID NO: 2234 - DNA, 490 bp, Unknown
  Ascusbbf_25664, encodes 16S rRNA
agagtttgatcatggctcaggattaacgctggcggcgtgcctaacacatgcaagtcgagcgggaaatttgagagtgaggcttcggcggatctcttaaatggagagcggcggacgggtgagtaacgcgtaggtaacctgccctgcacagagggatagccactggaaacggtgattaatacctcataaaactgttttgccgcatgacagaacagccaaagatttatcggtgcgggatggatctgcgtctgattagctggttggtgaggtaacggctcaccaaggcgacgatcagtagccgacctgagagggtgatcggccacattggaactgagacacggtccaaactcctacgggaggcagcagtggggaatattgcacaatgggcgcaagcctgatgcagcaacgccgcgtgaatgatgaaggcttttgggtcgtaaaattctgttctcagggaagaaaaaaatgactgtacctgaggagaaagccccgg

SEQ ID NO: 2235 - DNA, 490 bp, Unknown
  Ascusbbf_740210, encodes 16S rRNA
agagtttgatcatggctcaggatgaacgctggcggcgtgcttaacacatgcaagtcgaacgaagcactgaagaatgtcaaagttcttctttgactgagtggcgaacgggtgagtaatgcgtgagcaacctgcccttcagagggggacaacagttggaaacgactgctaataccgcatgacgtgttcggatggcatcatctgaataccaaaggagaaatccgctgagggatgggctcacgtctgattagctagatggcagggtaacggcctaccatggcgacgatcagtagccggactgagaggttgaacggccacattgggactgagatacggcccagactcctacgggaggcagcagtggggaatattgggcaatgggcgaaagcctgacccagcaacgccgcgtgaaggaagaaggccttcgggttgtaaacttcttttaacagggacgaagaagtgacggtacctgttgaataagccacggctaact

SEQ ID NO: 2236 - DNA, 490 bp, Unknown
  Ascusbbf_130542, encodes 16S rRNA
agagtttgatcctggctcaggatgaacgctggcggcgtgcctaacacatgcaagtcgaacgaagcacaccccttcgggggtgtgactgagtggcggacgggtgagtaacgcgtgggtaacctgccctgtacagggggataacagccagaaatggctgctaataccgcataagcgcacgaagggacatccctttgtgtgaaaaactccggtggtacaggatgggcccgcgtctgattagctggttggcggggtaatggcccaccaaggcgacgatcagtagccggtctgagaggatgaacggccacattggaactgagacacggtccaaactcctacgggaggcagcagtgagggatattgcacaatggggggaaccctgatgcagcaacgccgcgtgagtgaagaagtaattcgttatgtaaagctctatcagcagggaagataatgacggtacctgactaagaagctccggctaaatacgtgccagcag

SEQ ID NO: 2237 - DNA, 490 bp, Unknown
  Ascusbbf_27760, encodes 16S rRNA
agagtttgatcatggctcaggataaacgctggcggcgtgcctaatacatgcaagtcgatcgctggagttctagcttgctagaatgaaggagaggcgaacgggtgagtaatacataagcaacctgcccacgaagactgggataattcctggaaacggggactaataccggataggcagcttgatcgcatgatcgagctgttaaagattcaaagcactggtggatgggcttatggcgcattagctagttggtgaggtaacggctcaccaaggcgatgatgcgtagccggcctgagagggtgaacggccacattgggactgagacacggcccagactcctacgggaggcagcagtagggaattttcggcaatgggcgaaagcctgaccgagcaacgccgcgtgagtgaagacggccttcgggttgtaaagctctgttgtaagggaagaacactgttgagagaatcggcagctgacggtaccttaccagaaagc

SEQ ID NO: 2238 - DNA, 490 bp, Unknown
  Ascusbbf_28523, encodes 16S rRNA
agagtttgatcatggctcaggatgaacgctggcggcgtgcctaacacatgcaagtcgaacgaagcaagagagcttgctctcttgacttagtggcggacgggtgagtaacgcgtgagtaacctgcccttcagagggggacaacagttggaaacgactgctaataccgcataagaccacgctaccgcatggtagaggggtcaaaggagcaatccgctgaaggatggactcgcgtccgattagatagttggtgaggtaacggcccaccaagtcgacgatcggtagccggactgagaggttgaacggccacattgggactgagacacggcccagactcctacgggaggcagcagtgagggatattgcacaatgggcgaaagcctgatgcagcaacgccgcgtgaaggatgaaggttttcggattgtaaacttcttttctcattgacgaattcttgacggtagatgaggaataagccacggctaactacgtgcca

SEQ ID NO: 2239 - DNA, 490 bp, Unknown
  Ascusbbf_81232, encodes 16S rRNA
agagtttgatcatggctcaggatgaacgctagctacaggcttaacacatgcaagtcgaggggcagcgcgcggaggcttcggccactgtggcggcgaccggcgaatgggtgagtaacacgtatccaacctgcccgtcactgggggatagccctccgaaaggagaattaacaccccatgattgcatttgaggcatcttttatgcattaaaggttacggtgacggatggggatgcgtccgattagctagtcggcggggtaacggcccaccgaggcgacgatcggtagggggtctgagaggatggtcccccacactggaactgagacacggtccagactcctacgggaggcagcagtgaggaatattggtcaatgggcgagagcctgaaccagccaagtagcgtgaaggatgacggccctacgggttgtaaacttcttttatgcgggaataaagttcgccacgtgtggcgttttgcatgtaccgcaagaaaaag

SEQ ID NO: 2240 - DNA, 490 bp, Unknown
  Ascusbbf_361538, encodes 16S rRNA
agagtttgatcctggctcaggatgaacgctagctacaggcttaacacatgcaagtcgaggggtaacgacagcgaaagcttgcttttgctgggcgacgaccggcgaatgggtgagtaacgcgtatccaacctgccgcaaagtagggcacagccttgcgaaagtaagattaatgccctatgtgctgtgatgatgacatcagaattgcagtaaaggttcaccgctttgcgatggggatgcgtctgattaggcagttggtgaggtaacggcccaccaaacctacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaagctctgtgatcggggacgaacggtccgtaagctaataccttatggaagtgacggtacc

SEQ ID NO: 2241 - DNA, 490 bp, Unknown
  Ascusbbf_321255, encodes 16S rRNA
agagtttgatcatggctcaggatgaacgctggcggcatgcctaagacatgcaagtcgaacgaggtggcccagaaatatttattgaagtatgaagtgcttgcactgattatggatttatttggctctggattctccacctagtggcaaacgggtgagtaacacgtgggttacctacctccaagttggggataacagttggaaacgactgataataccgaatgtgctctacggagtaaagaagcccttaaagcttcgcttagagatgggcctgcggcgtattagctagttggtgggataacggcctaccaaggcaacgatgcgtagccgaactgagaggttgatcggccacactgggactgagacacggcccagactcctacgggagacagcagttaggaatattcgtcaatgggggaaaccctgaacgagcaatgccgcgtgaacgatgacggccctatgggttgtaaagttctgttgtttggaaagaact

SEQ ID NO: 2242 - DNA, 490 bp, Unknown
  Ascusbbf_216181, encodes 16S rRNA
agagtttgatcctggctcaggatgaacgctggcggcgtgcctaacacatgcaagtcgaacggagtacagacgctgtgagaggaagtgcttgcacagacttgaacttgtttgtacttagtggcggacgggtgagtaacgcgtggaaaacctgcctcatacagggggataacagggagaaattcctgctaataccgcataagcgcacggaaccgcatggttcagtgtgaaaagatttatcggtatgagatggttccgcgtctgattagccggttggcggggtaacggcccaccaaagcagcgatcagtagccggcctgagagggcggacggccacattgggactgagacacggcccagactcctacgggaggcagcagtgggggatattgcacaatgggggaaaccctgatgcagcgacgccgcgtgggtgaagaagtatttcggtatgtaaagccctatcagcagggaagatgatgacggtacctgactaa

SEQ ID NO: 2243 - DNA, 490 bp, Unknown
  Ascusbbf_343776, encodes 16S rRNA
agagtttgatcctggctcaggacgaacgctggcggcgtgcctaacacatgcaagtcgaacggggctactacgacggaaggcttcggctggaagatgttttagcttagtggcggacgggtgagtaacgcgtgagcaacctgccttacagagggggacaacagttggaaacgactgctaataccgcataaagtattgagagggcatccttttgataccaaagatttatcgctgtaagatgggctcgcgtatgattagatagttggtgaggtaacggctcaccaagtcgacgatcattagccggactgagaggttgaacggccacattgggactgagatacggcccagactcctacgggaggcagcagtggggaatattgcgcaatgggggcaaccctgacgcagcaacgccgcgtgaaggatgaaggttttcggattgtaaacttcttttgtcaaggacgaagaaagtgacggtacttgacgaataagctcc

SEQ ID NO: 2244 - DNA, 490 bp, Unknown
  Ascusbbf_478085, encodes 16S rRNA
agagtttgatcatggctcagaacgaacgctggcggcgtggattaggcatgcaagtcgaacgggactttgctttgtagcaatactttgcaaagtctagtggcgtaagggtgagtaacacgtgggtaatgtacccgatagtttgggataacgttccgaaagggacgctaataccggatgtgatgttaaaccgccgggtttaacaagaaaggtggggaccgcaaggcctgccgctaacggaacggcccgcgacctattagctagttggtggggtaaaggcctaccaaggcgaggatgggtagccgaactgagaggttgaccggccacactgggactgagacactgcccagacttctacggaaggctgcagtcgagaatcattcacaatggacgaaagtctgatgatgcgacgccgcgtgcgcgatgaaggtcttcggattgtaaagcgctttgaacagggaagaatgccgcgtatttaatagataacgcggag

SEQ ID NO: 2245 - DNA, 488 bp, Unknown
  Ascusbbf_13188, encodes 16S rRNA
agagtttgatcatggctcaggattaacgctggcggcgtgcctaatacatgcaagtcgaatggtagcaataccatggcgaacgggtgagtaacacgtaggtaacctgtctttaagccgaggataaccattggaaacgatggataatactggataggacatttgaaggcatctttagatgtttaaagatttatcacttagagaggggcctgcggcgcattagctagttggtgaggtgaaggcttaccaaggcgatgatgcgtagccggactgagaggttgaacggccacaatggaactgagaacggtccatactcctacgggaggcagcagtagggaattttcggcaatgggcggaagcctgaccgagcaacgccgcgtgaacgaagaagtatttcggtatgtaaagttcttttattagggacgaaaagacagattgacggtacctaatgaataagctccggctaactacgtgccagcagccgcggtaat

SEQ ID NO: 2246 - DNA, 490 bp, Unknown
  Ascusbbf_35755, encodes 16S rRNA
agagtttgatcatggctcaggatgaacgctagcggcaggcctaacacatgcaagtcgaggggtaacagggcgtagcaatacgccgctgacgaccggcgcacgggtgcgtaacgcgtatgcaacctgcccgtaacaggggaataacggggagaaatctccactaatgccccatattcttgctggttcgcatgttccggcaaggaaagctttctgtggttacggatgggcatgcgtgacattagctagttggtaaggtaacggcttaccaaggcgtcgatgtctaggggagctgagaggctaatcccccacactggtactgagacacggaccagactcctacgggaggcagcagtgaggaatattggtcaatggagggaactctgaaccagccatgccgcgtgagggaggaaggccctacgggtcgtaaacctcttttgccccggggcaataagggccgtgcgcggtccgatgagagtacggggcgaataag

SEQ ID NO: 2247 - DNA, 490 bp, Unknown
  Ascusbbf_32659, encodes 16S rRNA
agagtttgatcctggctcaggataaacgctggcggcgtgcctaatacatgcaagtcgagcgaggtattcagcaatggataccgagcggcgaacgggtgagtaacacgttgggaacctaccctcctgatcggaatacccaagggaaactttggttaatgccgaatacgtggttccgggataacctggagtcataaaaggcggccttaaagccgcgcagaaggatggacctgcggcgcattagctagtaggtgagataatagcccacctaggcgaggatgcgtagccgacctgagagggtgaacggccacactggaactgagacacggtccagactcctacgggaggcagcagtagggagtattcggcaatgggggaaaccctgaccgagcaacgccgcgtgaatgatgacggccttcgggttgtaaaattctgtggcgaggaacgaatggcaaggagaggaaatgctctttgtttgacggtacctcgctag

SEQ ID NO: 2248 - DNA, 490 bp, Unknown
  Ascusbbf_163586, encodes 16S rRNA
agagtttgatcctggctcaggatgaacgctagcggcaggcttaacacatgcaagtcgaggggcagcgcgggagtagcaatacttctggcggcgaccggcgcaagggtgcgtaacgcgtgagcaacatacccgtcacagggggataagcgatggaaacgtcgtctaataccgcataacaccaggagcgacatcgtttctggttgaaacttacgagggtgacggattggctcgcgagacattagctagtcggcggggtaacggcccaccgaggcgacgatgtctaggggttctgagaggaaggtcccccacactggaactgagacacggtccagactcctacgggaggcagcagtgaggaatattggacaatggtcggaagactgatccagccatgccgcgtgcaggaagacggtcctatggattgtaaactgcttttgtacgggagcaataagtgccacgtgtgacacgatgagagtaccgtacgaataag

SEQ ID NO: 2249 - DNA, 490 bp, Unknown
  Ascusbbf_1792748, encodes 16S rRNA
agagtttgatcatggctcaggatgaacgctagcgacaggcttaacacatgcaagtcgaggggcagcatgagggtagcaataccttcgatggcgaccggcacactggtgagtaacacgtatgcaacctgcccttgtcagggggataatccggggaaacccggtctaataccgcataacacctttgggggcctcccctttggttgaaagatacgtcggacagggatgggcatgcgcagcattagcttgttggtggggcgacggcccaccaaggcgacgatgcttaggggttctgagaggaaggtcccccacactggtactgagacacggaccagactcctacgggaggcagcagtgaggaatattggtcaatggccgcagggctgaaccagccaagtcgcgtgagggaagacggccctacgggttgtaaacctcttttgccggggagtaaagtgcgggatgcgtcccgtattgcgagtacccggagaaaaag

SEQ ID NO: 2250 - DNA, 490 bp, Unknown
  Ascusbbf_7657, encodes 16S rRNA
agagtttgatcatggctcaggatgaacgctagcgacaggcctaacacatgcaagtcgaggggcagcgcggagtagcaatactttggcggcgaccggcgcacgggtgcgtaacaggtgtgcaatctgtccatagtcgggggatagcccggcgaaagccgaattaatactccatgtgtcatttagccgcatgactggatgatgaaacgtaaggactatgggtgagcacgcttctgattaggtagttggtgaggtaacggcccaccaagccgacgatcagtaggggttctgagaggaaggtcccccacattggaactgagacacggtccaaactcctacgggaggcagcagtgaggaatattggtcaatggacgagagtctgaaccagccaagtcgcgtgaaggatgaaggttctatggattgtaaacttcttttgtccgagggtaaagtgtgggacgtgtcccatttggcaagtatcggacgaataagcatc

SEQ ID NO: 2251 - DNA, 490 bp, Unknown
  Ascusbbf_11503, encodes 16S rRNA
agagtttgatcatggctcagaacgaacgctggcggcgcgtcttaagcatgcaagtcgagcgggattacggtgcttgcaccgtatgagagcggcggactggtgagtaacgcgtgggtgacgtaccctccggactgggatagctcctagaaataggaggtaataccggatacggtgcctgctgtcagagggcaggcaggaaaggttcttttgaaccgccgggggagcggcccgcgtgccattagctagttggtggggtaacggcctaccaaggcagtgatggctacccggcctaagagggtggacgggcacattgggactgagatacggcccagactcctacgggaggcagcagctaagaatattccgcaatgggggaaaccctgacggagcgacgccgcgtggacgatgaaggccggaaggttgtaaagtccttttatgactgatgaataagggatgtgagagaaacgcattctggtgacggtaggtcatg

SEQ ID NO: 2252 - DNA, 490 bp, Unknown
  Ascusbbf_11183, encodes 16S rRNA
agagtttgatcatggctcaggacgaacgctggcggcgtgcctaacacatgcaagtcgagcgagagagtcccttcggggacaatctagcggcggacgggtgagtaacacgtgggtaacctgcctcaaagagggggatagcctcccgaaagggagattaataccgcataagacctggattcacatggatccgggatgaaaggagaaatccgctttgagatggacccgcggcgcattagctagttggtggggtaaaggcctaccaaggcagcgatgcgtagccgacctgagagggtgatcggccacattggaactgagagacggtccagactcctacgggaggcagcagtggggaatattgcacaatgggcgaaagcctgatgcagcaacgccgcgtgagtgatgaaggttttcggatcgtaaagctctgtcttctgggaagataatgacggtaccagaggaggaagccacggctaactacgtgccagcagcc

SEQ ID NO: 2253 - DNA, 490 bp, Unknown
  Ascusbbf_479669, encodes 16S rRNA
agagtttgatcatggctcaggatgaacgctagctacaggcctaacacatgcaagtcgaggggcagcatgtcggtagcttgctaccgatgatggcgaccggcgaatgggtgagtcacgcgtgtccaacctgccccccgcccggggatagcccttggaaatgaggattaagacccgatacgtggcgtttccgcatggcggcgccatgaaacgaggcgggggatggggacgcgtcggattagcttgacggcggggcaacggcccaccgtggcgacgatccgcaggggttctgagaggaaggtcccccacactggcactgagacacgggccagactcctacgggaggcagcagtgaggaatattggtcaatggccgagaggctgaaccagccaagtagcgtgcaggatgacggccctacgggttgtaaactgcttttgcgggaggataaagtgcgctacgtgtagcgctttgcaggtatcccgtgaataaggac

SEQ ID NO: 2254 - DNA, 490 bp, Unknown
  Ascusbbf_1751033, encodes 16S rRNA
agagtttgatcatggctcaggatgaacgctggcggcacgcttaacacatgcaagtcgagcggagttatgacttcggtcataacttagcggcggacgggtgagtaacacgtgggtaacctaccccatacagggggataacgtatagaaatgtacgctaataccgcataagccaacagggaggcatcttctggttggaaaagcgctagtggtatgggatgggcccgcgactgattagctagttggtgaggtaagagcccaccaaggcaacgatcagtagccggtctgagaggatggacggccacattgggactgagacacggcccagactcctacgggaggcagcagtggggaatattgcacaatggggggaaccctgatgcagcgatgccgcgtgaaggaagaagtatttcggtatgtaaacttctatcagcagggaagaaaaaggacagtacctgaataagcagccccggctaactacgtgccagcagcc

SEQ ID NO: 2255 - DNA, 484 bp, Unknown
  Ascusbbf_3105, encodes 16S rRNA
agagtttgatcctggctcagaacgaacgctggcggcaggtcttaggcatgcaagtcgaacgagtgaagcagggcttgccctgtggagcgagtggcgcacgagtgagtaacgcgtgggaaactgcccaccactggggaataacgtttggaaacgaacgctaataccgcatacgccggaaacgggaaagatttatcggtggtggatgtgcccgcgttggattagcttgttggtggggtaatggcctaccaaggcgatgatccatagctggtctgagaggacgatcagccacgttggaactgagacacggtccaaactcctacgggaggcagcagctaagaatattgggcaatggaggaaactctgacccagccatgccgcgtgaatgaagaaggccttcgggttgtaaagttcttttaatcgtgaagatgatgacagtagcgatagaaaaagcaccggctaacttcgtgccagcagccgcggtaat

SEQ ID NO: 2256 - DNA, 353 bp, Unknown
  Ascusbbf_143765, encodes 16S rRNA
agagtttgatcatggctcagaacgaacgctggcggcgcgttttaagcatgcaagtcgagcggtagtagcaatacgagagcggcggacgggtgagtaacacgtgggtaatctgcccttcggtcgggaatagcctgtggaaacacaggataataccggatgcgatggtcttcacacaagtggaggtcaggaaaggagccaaggctccgccggaggatgagcccgcgtcccattagctagatggtgaggtaaaggcccaccatggcgatgatgggtagccggcctgagagggtgaacggccacattggaactgagacacggtccagactcctacgggagccagcagccgcggtaat

SEQ ID NO: 2257 - DNA, 490 bp, Unknown
  Ascusbbf_42691, encodes 16S rRNA
agagtttgatcatggctcaggatgaacgctggcggcgtgcttaacacatgcaagtcgaacgaagcattttggttgaagttttcggacagataccgatctgactgagtggcggacgggtgagtaacgcgtgggcaacctgccgtatgcagggggataacagttggaaacgactgctaataccgcataagcgcacagtaccgcatggtacagtgtgaaaagccgagacggcatacgatgggcccgcgttggattaggcagttggtgaggtaacggcccaccaagccgacgatccatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaagatgacggtacctgcacaagaagccccggct

SEQ ID NO: 2258 - DNA, 490 bp, Unknown
  Ascusbbf_1506469, encodes 16S rRNA
agagtttgatcatggctcaggatgaacgctggcggcgtgcttaacacatgcaagtcgaacgaggattgtcggttgaagttttcggacggaaactggcaataccgagtggcggacgggtgagtaacgcgtggggaacctgccccattccgggggataccagttggaaacgactgttaataccgcataagcgcacggcatcgcatgatgcagtgtgaaaaactgaggtggaatgggatggccccgcgtctgattagccagttggcagggtaacggcctaccaaagcgacgatcagtagccggcctgagagggcgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaaaaatgacggtacctgactaagaagccccg

SEQ ID NO: 2259 - DNA, 485 bp, Unknown
  Ascusbbf_718627, encodes 16S rRNA
agagtttgatcatggctcagaacgaacgctggcggcacgcttaacacatgcaagtcggacgggtggaaggtggtttaccattggaagctagtggcggactggtgagtataatacaggaatatgcccttaggtatgggatagctttgggaaactggaggtaataccgtataaggtcgagagaggaaagcaggaatgcgcctgaggattagcctgtatctgattaggaagttggcggggtaaaggcccaccaatccagagatcagtagctgttctgagaggaagatcagccacattgggactgagatacggcccagactcctacgggaggcagcagtggggaatattggacaatggggggaaccctgatccagcgatgccgcgtgaatgaagaaggttttcggattgtaaagttcttttcttagggaagatgatgacggtacctgaggaataagcaccggcaaactctgtgccgcagccacggtaat

SEQ ID NO: 2260 - DNA, 490 bp, Unknown
  Ascusbbf_66006, encodes 16S rRNA
agagtttgatcctggctcaggatgaacgctggcggcgtgcctaacacatgcaagtcgaacgaggctcttttctcagatgtttcgactgaagagaaaagatcaccgagtggcggatgggtgagtaacgcgtggagaacctgcccttatcagggggataacaactggaaacggttgacaataccgcatatagtgcttgatcgcatgttcttgcacggaaagatttatcggataaggatggctccgcgttggattagctggttggtggggtaacggcctaccaaggcgacgatccatagccggcctgagagggcgaccggccacattgggactgagacacggcccagactcctacgggaggcagcagtggggaatattgcacaatgggcgcaagcctgatgcagcgacgccgcgtggaggaagaagtatttcggtatgtaaactcctatcagcagggaagaaaatgacggtacctgactaagaagccccggct

SEQ ID NO: 2261 - DNA, 490 bp, Unknown
  Ascusbbf_233413, encodes 16S rRNA
agagtttgatcctggctcaggatgaacgctagcgacaggcttaacacatgcaagtcgaggggcagcatgatttgtagcaatacagattgatggcgaccggcgcacgggtgagtaacgcgtatgcaacttacctatcagagggggatagcccggcgaaagtcggattaataccccataaaacaggggtcccgcatgggaatatttgttaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgagaggctgaaccagccaagtcgcgtgaaggaagaaggatctatggtttgtaaacttcttttataggggaataaagtggaggacgtgtccttttttgtatgtaccctatgaa

SEQ ID NO: 2262 - DNA, 490 bp, Unknown
  Ascusbbf_35691, encodes 16S rRNA
agagtttgatcatggctcaggacgaacgctggcggcatgcctaacacatgcaagtcgaacggagcagttccttcggggactacttagtggcgaacgggtgagtaacgcgtgagcaacctgcctcggcgagggggataacacttggaaacaggtgctaataccgcataagaccacactgtcgcatgacagaggggtcaaaggagcaatccgcgctgagaggggctcgcgtcccattaggtagatggcgggataacagcccaccatgccgacgatgggtagccgagctgagaggctgatcggccacactggaactgagacacggtccagactcctacgggaggcagcagtggggaatattgggcaatgggcgaaagcctgacccagcaatgccgcgtgagggaagaaggtcttcggattgtaaacctctgtccttggtgacgaaggaagtgacggtagccaaggaggaagccccggctaactacgtgccagc

SEQ ID NO: 2263 - DNA, 490 bp, Unknown
  Ascusbbf_83884, encodes 16S rRNA
agagtttgatcctggctcaggatgaacgctggcggcgtgcctaacacatgcaagtcgaacgaggtcatttgttcttgcgattcgtcaagagaactcctgaccgagtggcggatgggtgagtaacgcgtggagaacctgccctcatctgggggataacaactggaaacggttgacaataccgcatagactctgatgctcgcatgagcgtaagagaaaagatttatcggatgaggatggctccgcgtcggattagccagttggcggggtaacggcccaccaaagcgacgatccgtagccggcctgagagggcgaccggccacattgggactgagacacggcccagactcctacgggaggcagcagtggggaatattgcacaatgggcgcaagcctgatgcagcgacgccgcgtgagtgatgaagtgcttcggcatgtaaagctctatcaacagggaagaaaatgacggtacctgaataagaagccccggcta

SEQ ID NO: 2264 - DNA, 490 bp, Unknown
  Ascusbbf_1878589, encodes 16S rRNA
agagtttgatcatggctcaggatgaacgctggcggcatgcctaagacatgcaagtcgaacggagtgaccctttgaagttggagtgcttgcacaaagatggatttggattttcactcagtggcagacgggtgagtaacgcgtgggtaatctaccttaaagactgggataacttctggaaacggatgctaataccggataaaccataattagataattagttatgttgaaaggagcttcggcttcactttgagatgagcttgcgttgtattagctagttggtggggtaatggcctaccaaggcaacgatgcatatccgagctgagaggctgatcggacacattgggactgagacacggcccagactcctacgggagacagcagttaggaatattcgtcaatgggggaaaccctgaacgagcaatgccgcgtgaatgatgacaatcctctggattgtaaaattctgttgtaaaggacgaacccttatcatagg

SEQ ID NO: 2265 - DNA, 490 bp, Unknown
  Ascusbbf_1547221, encodes 16S rRNA
agagtttgatcatggctcagaatcaacgctggcggcgtgcctaatacatgcaagtcgtacgcgaagaccccgcaaggggttggtagcgtggcaaacgggtgagtaacgcgtgggcgacctgccttcgagtgggggataaccttccgaaaggggggctaataccgcatgacataccgtgtttagatacacggatatcaaagccggggatcgcaagacctggcgcttgaagaggggcctacgtccgattagctagttggtggggtaacggctcaccaaggcgacgatcggtatccggcctgagagggcggacggacaaactgggactgagacacggcccagactcctacgggaggcagcagtagggaattgttcgcaatgggcgcaagcctgacgacgcaacgccgcgtggaggatgaagggcttcggctcgtaaactcctttcgaccgagatgaatatccatggggctaatatccctgtggactgacagta

SEQ ID NO: 2266 - DNA, 490 bp, Unknown
  Ascusbbf_102359, encodes 16S rRNA
agagtttgatcatggctcaggacgaacgctggcggcgtgcctaatacatgcaagtcgagcggggtccaaccagtggcaacactggggacgacctagcggcgaacgggtgagtaacacgtgaggaacctgccccgaagtctgggataactcgaggaaactcgtgctaataccggatgcctccaccagatcgcatggtcaggtggagaaagttttttcgcttcgggagggcctcgcggcctatcagcttgttggtggggtaacggcctaccaaggcatcgacgggtagctggtctgagaggacgatcagccacactgggactgagacacggcccagactcctacgggaggcagcagtagggaatcttgcgcaatgggcgaaagcctgacgcagcaacgccgcgtgggggatgaaggctctcgggttgtaaacccctttcagcagggacgaaattgacggtacctgcagaagaagccccggccaactacgtgc

SEQ ID NO: 2267 - DNA, 490 bp, Unknown
  Ascusbbf_473024, encodes 16S rRNA
agagtttgatcctggctcagattgaacgctggcggaatgctttacacatgcaagtcgagcggcagcgcggggcaacctggcggcgagcggcgaacgggtgagtaatacatcggaacgtgcccagatgtgggggataactacttgaaagagtggctaataccgcatgtgatctgaggatgaaagcgggggacctttgggcctcgcgcatttggagcggccgatggcagattaggttgttggtggggtaaaggcttaccaagcctgtgatctgtagctggtctgagaggacgaccagccacactgggactgagacacggcccagactcctacgggaggcagcagtggggaattttggacaatgggcgaaagcctgatccagccattccgcgtgcaggatgaaggccctcgggttgtaaactgcttttgtacggaacgaaaaggctttctctaatacaggaagttgatgacggtaccgtaagaataagcaccg

SEQ ID NO: 2268 - DNA, 490 bp, Unknown
  Ascusbbf_851, encodes 16S rRNA
agagtttgatcatggctcaggatgaacgctggcggcgtgcctaacacatgcaagtcgaacggaactgcttttgaagattccttcgggatgattcagttgtagtttagtggcggacgggtgagtaacgcgtgagtaacctgcccttcagagggggataacgatctgaaaagaccgctaataccgcataacattacgaagtcgcatggctttgtaatcaaaactcaggtgctgaaggatggactcgcgtccgattagttagttggtgaggtaacggcccaccaagaccgcgatcggtagccggactgagaggttgaacggccacattgggactgagacacggcccagactcctacgggaggcagcagtgggggatattgcgcaatgggggaaaccctgacgcagcaacgccgcgtggatgatgacggttttcggattgtaaagtccttttgttggggacgaagattgacggtacccaacgaataagctccgg

SEQ ID NO: 2269 - DNA, 490 bp, Unknown
  Ascusbbf_230048, encodes 16S rRNA
agagtttgatcctggctcaggacgaacgctggcggcgtgcttaacacatgcaagtcgaacgaagttgctctttgggaagccctcgggtggaactgtgagtatacttagtggcggacgggtgagtaacgcgtgagcaatctgccctgcaatgggggacaacagttggaaacgactgctaataccgcataagaccacgaaaccgcatggtttagaggtaaaaggattcattcgatgcaggatgagctcgcgtcccattagatagttggtgaggtaacggcccaccaagtcaacgatgggtagccgacctgagagggtgatcggccacattggaactgagaaacggtccaaactcctacgggaggcagcagtggggaatattgggcaatgggggaaaccctgacccagcaacgccgcgtgaaggaagaaggccttcgggttgtaaacttttgtcctatgggacgaaaaaaatgacggtaccataggaggaagc

SEQ ID NO: 2270 - DNA, 490 bp, Unknown
  Ascusbbf_1525997, encodes 16S rRNA
agagtttgatcatggctcaggacgaacgctggcggcgcgcctaacacatgcaagtcgaacggagtttatccgactgaagttttcggatggaagatggataaacttagtggcggacgggtgagtaacacgtgagcaacctgcctttcagagggggataacgattggaaacgatcgctaataccgcataacattatgaggagacatcttcttataatcaaaggagcaatccgctgaaagatgggctcgcggccgattagctagatggtggggtaacggcccaccatggcgacgatcggtagccggactgagaggttgaacggccacattgggactgagacacggcccagactcctacgggaggcagcagtgggggatattgcacaatggaggaaactctgatgcagcgacgccgcgtgagggaagacggtcttcggattgtaaacctctgtcttaggggaagaaaatgacggtaccctaagaggaagctccg

SEQ ID NO: 2271 - DNA, 490 bp, Unknown
  Ascusbbf_74709, encodes 16S rRNA
agagtttgatcatggctcaggatgaacgctggcggcgtgcttaacacatgcaagtcgaacgaggaataattgatgagatcttcggatggatttagttattccgagtggcggacgggtgagtaacgcgtgggtaacctgccccatacagggggacaacagagggaaacttctgctaataccgcataagcgctttttatggcatcgtaagaagcggaaagctccggcggtatgggatgggcccgcgttggattaggcagttggcggggtaacggcccaccaaaccgacgatccatagccgacctgagagggtgaccggccacattgggactgagacacggcccagactcctacgggaggcagcagtggggaatattgcacaatgggcgaaagcctgatgcagcgacgccgcgtgagtgaagaagtatttcggtatgtaaagctctatcagcagggaagaagatgacggtacctgcacaagaagctccggcta

SEQ ID NO: 2272 - DNA, 490 bp, Unknown
  Ascusbbf_41747, encodes 16S rRNA
agagtttgatcctggctcaggattaacgctggcggcgcacataagacatgcaagtcgaacggacttaatcgattcttttagattcgaagcggttagtggcggactggtgagtaacacgtaagtaacctgcctatcagaggggaataacagtgagaaatcattgctaataccgcataagctgacagtatcgcatgataccgttagaaaaggagcaatccgctgatagatggacttgcggccgattagccagttggtggggtaacggcctaccaaagcaacgatcggtagccgagctgagaggctcaacggccacattgggactgagatacggcccagactcctacgggaggcagcagtcgggaatattgcgcaatggaggaaactctgacgcagtgacgccgcgtataggaagaaggttttcggattgtaaactattttagacagggaagaaattgacagtacctgtagaataagctccggctaactacgt

SEQ ID NO: 2273 - DNA, 490 bp, Unknown
  Ascusbbf_34875, encodes 16S rRNA
agagtttgatcatggctcaggatgaacgctggcggcgtgcctaacacatgcaagtcgaacgggaactccgagatgaagtttcgatggattcttggaaattctagtggcggacgggtgagtaacgcgtgggtaacctgcccttaagaggtgaataacaatgagaaatcagtgctaatacaccatatgcttacaagtatcgcatgatatagtgaggaaagaatttcgcttaaggatggacccgcgtttgattagccagttggcagggtaacggcctaccaaagcaacgatcaatagccggcctgagagggtgaacggccacattggaactgagacacggtccaaactcctacgggaggcagcagtggggagtattgcacaatgggcgcaagcctgatgcagcaacgccgcgtgagtgaagaagtatttcggtatgtaaagctctatcgatggggaataagatgaaggtacccaagtaagaagccccggctaa

SEQ ID NO: 2274 - DNA, 490 bp, Unknown
  Ascusbbf_1870312, encodes 16S rRNA
agagtttgatcatggctcaggatgaacgctggcggcgtgcttaacacatgcaagtcgaacggacttatttgagagcttgctcccaaataagttagtggcggacgggtgagtaacgcgtgggtaacctgccgtatgccgggggacaacagttggaaacgactgctaataccgcataagcgcacagagtggcatcactcagtgtgaaaaactccggtggcatacgatggacccgcgtctgattaggcagttggcgaggtaacggctcaccaaacctacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcaggaaagaaaatgacggtacctgactaagaagccccggctaactacgtgcc

SEQ ID NO: 2275 - DNA, 490 bp, Unknown
  Ascusbbf_270837, encodes 16S rRNA
agagtttgatcatggctcaggatgaacgctagcgggaggcctaacacatgcaagccgagcggtatttattcttcggaatagagagagcggcgtacgggtgcgtaacacgtgtgcaacctgcctttatctgggagatagccctccgaaagggggattaatattccataatatctcgttgggcatccaacgagattgaaagctccggcggatagagatgggcacgcgcaagattagatagttggtgaggtaacggctcaccaagtctgcgatctttagggggcctgagagggtgatcccccacactggtactgagacacggaccagactcctacgggaggcagcagtgaggaatattggacaatgggtgcaagcctgatccagccatcccgcgtgaaggattaaggtcctatggattgtaaacttcttttatacagggataaacctctcctcgtgaggagagctgaaggtactgtatgaataagcaccggct

SEQ ID NO: 2276 - DNA, 490 bp, Unknown
  Ascusbbf_10348, encodes 16S rRNA
agagtttgatcctggctcaggatgaacgctggcggcgtgcttaacacatgcaagtcgaacgaagaaggttagaatgagagcttcggcaggatttctatctatcttagtggcggacgggtgagtaacgtgtgggcaacctgccctgtactggggaataatcattggaaacgatgactaataccgcatgtggtcctcggaaggcatcttctgaggaagaaaggatttattcggtacaggatgggcccgcatctgattagctagttggtgagataacagcccaccaaggcgacgatcagtagccgacctgagagggtgatcggccacattgggactgagacacggcccaaactcctacgggaggcagcagtggggaatattgcacaatgggcgaaagcctgatgcagcaacgccgcgtgaaggatgaagggtttcggctcgtaaacttctatcaatagggaagaaacaaatgacggtacctaaataagaagcc

SEQ ID NO: 2277 - DNA, 490 bp, Unknown
  Ascusbbf_1452427, encodes 16S rRNA
agagtttgatcatggctcagaacgaacgctggcagcgtggattaggcatgcaagtcgaacgggatccgagtggtagcaatatcgcttggtgagagtggcggaagggcgaggaacacgtgggcaacctgtctctgaggtggggaaaaccgctggaaacggcggctaataccgaatgtagcgcccgctcgcatgagcggagcgccaaagggggcgaaagctccccctctccgaggggcccgcgcaccatcagcttgttggcggggtaacggcccaccaaggctcacggttagctggtctgagaggatggccagccgaactgggactgagatactgcccagactcctacgggaggctgcagtcgaggatcatttgcaatgggcgaaagcctgacaatgcgacgctgcgtggaggatgaaggccctcgggttgtaaactcctgtcatgggggaaaaggaaaagggacccaacacgtccccgatttgatggtacc

SEQ ID NO: 2278 - DNA, 490 bp, Unknown
  Ascusbbf_724730, encodes 16S rRNA
agagtttgatcatggctcaggatgaacgctagcggcaggcttaacacatgcaagtcgcggggcagcgcggatagcaatatctggcggcgaccggcggaagggtgcgtaacgcgtgagcaacatgcccgtatcagggggataaccgatggaaacgtcgcctaataccccataacaacagaggctgcatggtctttgtttgaaagttacggcggatacggattggctcgcgtgacattagctggttggcggggtaacggcccaccaaggctacgatgtctaggggttctgagaggaaggtcccccacactggaactgagacacggtccagactcctacgggaggcagcagtgaggaatattggtcaatggacgcaagtctgaaccagccatgccgcgtgcaggaatgaggccctatgggtcgtaaactgcttttgctgtggagcaataagtgctacgtgtagtacgatgagagcacacagcgaataagcatc

SEQ ID NO: 2279 - DNA, 490 bp, Unknown
  Ascusbbf_595302, encodes 16S rRNA
agagtttgtcatggctcaggataaacgctggcggcgcacataagacatgcaagtcgaacggaagtcgttatatctgaaatggatatagactgcgaacttgttcaaagaaagttgaagtagattatataacaatggctttagtggcggactggtgagtaacgcgtaagaaatctacctattagaggggaataacaatgagaaatcattgctaataccgcatatgccatagatatcgcatgataatagtgggaaaggagaaatccgctaatagatgatcttgcgtctgattagctagttggtggggtaacggcctaccaaggcgacgatcagtagccggactgagaggttgaacggccacattgggactgagatacggcccagactcctacgggaggcagcagtcgggaatattgcgcaatggaggaaactctgacgcagtgacgccgcgtgcaggaagaaggttttcggattgtaaactgctttagacagg

SEQ ID NO: 2280 - DNA, 490 bp, Unknown
  Ascusbbf_130330, encodes 16S rRNA
agagtttgatcatggctcagaacgaacgccggcggcgcgtcttaagcatgcaagtcgggcgggatcagggtgcttgcaccctgtgagagcggcggactggtgagtaacgcgtgggcgacgcaccccctgcaccgggacagccggcagaaatgccgggtgatacgggatgagctcatgtcctgtggtggggcatgaggaaagcggccacggccgcggcaggggagcggcccgcgtcccatcagctagtaggcggggcaaaggcccacctaggcgacgacgggtacccggactgagaggttggacgggcacattgggactgagatacggcccagactcctacgggaggcagcagctaagaatattccgcaatgggggaaaccctgacggagcgacgccgcgtggacgatggaggccggaaggttgtaaagtcctctggcgcctgaggaagtgcccgggcagggaatggcccgggagtgactgtagggcgaga

SEQ ID NO: 2281 - DNA, 490 bp, Unknown
  Ascusbbf_69420, encodes 16S rRNA
agagtttgatcatggctcaggatgaacgctggcggcgtgcctaacacatgcaagtcgaacggagctgtttggatgaagttttcggatggattccttgcagcttagtggcggacgggtgagtaacgcgtggataacctgccttgatccgggggatagcagttggaaacgactggtaataccgcataagcgcacggcatggcatcatgcagtgtgaaaagatttatcgggtcaagatggatccgcgtctgattagccagttggcggggcaacggcccaccaaagcaacgatcagtagccggcctgagagggcggacggccacattgggactgagacacggcccagactcctacgggaggcagcagtgggggatattgcacaatgggcgcaagcctgatgcagcgacgccgcgtgagtgaagaagtatttcggtatgtaaagctctatcggcagggaagaaagcctcgcaagagggatgacggtacctgacta

SEQ ID NO: 2282 - DNA, 490 bp, Unknown
  Ascusbbf_29963, encodes 16S rRNA
agagtttgatcctggctcaggatgaacgctggcggcgtgcttaacacatgcaagtcgaacggggaaatatataggaagatttcggttggaatatatattttctagtggcggacgggtgagtaacgcgtaaacaatctgccttagagagggggataacagatagaaatatctgctaataccgcataagaccacggtagggcatcctacaggggtaaaaggagaaatccgctttaagatgagtttgcgtactattagctagttggtggggtaacggcctaccaaggcgacgatggttagccggcctgagagggtgaacggccacattggaactgagaaacggtccagactcctacgggaggcagcagtgaggaatattgggcaatgggcgaaagcctgacccagcaacgccgcgtggaggaagaaggtcttcggattgtaaacttctgttatgggggaaaaagaaagtgatggtaccccatgagaaagctac

SEQ ID NO: 2283 - DNA, 490 bp, Unknown
  Ascusbbf_1557685, encodes 16S rRNA
agagtttgatcctggctcaggatgaacgctggcggcgtgcttaacacatgcaagtcgaacgaagccaaaaggaagcttgctttctttgaagcttagtggcggacgggtgagtaacgcgtgaggaacctgcccttcagtggggaataacagccggaaacgactgctaataccgcataacgtcggagtgccgcatgacacatcgaccaaaggatttattcgctgaaggatggcctcgcgtccgattaggcagttggtgaggtaacggcccaccaaacctacgatcggtagccgaactgagaggttgatcgaccacattgggactgagacacggcccagactcctacgggaggcagcagtggggaatattgggcaatgggcgaaagcctgacccagcaacgccgcgtgaaggaagacggtcttcggattgtaaacttctttgattggggaagaacacaatgacctacccaaagaacaagtcacggctaactac

SEQ ID NO: 2284 - DNA, 490 bp, Unknown
  Ascusbbf_207489, encodes 16S rRNA
agagtttgatcatggctcaggacgaacgctggcggcgtgcttaacacatgcaagtcgaacgaagcttgatttcggaatctttcgggatgaagaatgatatgacttagtggcggacgggtgagtaacgcgtgagtaacctgcctttcagagtggaataacgtttggaaacgaacgctaataccgcataacatcaaattatcgcatggtagaatgatcaaagatttatcgctgagagatggactcgcgtccgattaggtagttggtgaggtaacggctcaccaagccgacgatcggtagccggactgagaggttgaacggccacattgggactgagacacggcccagactcctacgggaggcagcagtggggaatattgcacaatgggcgcaagcctgatgcagcaacgccgcgtgagggaagacggtcttcggattgtaaacctttgtctttggtgaagaaggaagtgacggtagccaaggaggaagccac

SEQ ID NO: 2285 - DNA, 490 bp, Unknown
  Ascusbbf_1235484, encodes 16S rRNA
agagtttgatcctggctcagattgaacgctggcggcaggcctaatacatgcaagtcggacgggattgggaccagagcttgctctgatcccatgagagtggcgcacgggtgcgtaacgcgtgagcaacctacctccatcagggggatagcctctcgaaagagagattaacaccgcataatatcaacagttcgcatgttcagttgattaaatatttataggatggagatgggctcgcgtgacattagctagttggtagggtaacggcttaccaaggcgacgatgtctaggggctctgagaggagaatcccccacactggtactgagacacggaccagactcctacgggaggcagcagtaaggaatattggtcaatgggcggaagcctgaaccagccatgtcgcgtgcatgatgactgccctatgggttgtaaactgcttttgtccgggaataaacctccttacgtgtagggagctgaatgtaccggaagaat

SEQ ID NO: 2286 - DNA, 490 bp, Unknown
  Ascusbbf_186326, encodes 16S rRNA
agagtttgatcctggctcaggatgaacgctggcggcgtgcctaatacatgcaagtcgagcgagaatcaacggatctgcgattcgtcaaggagaagttgaggaaagcggcggacgggtgagtaacgcgtaggcaacctgcccccggcagagggatagccattggaaacgatgattaaaacctcataacgccgcgggagcacatgctcctgcggccaaagatttatcggctggggatgggcctgcgtctgattaactagttggtggggtaacggcctaccaaggtgacgatcagtagccgacctgagagggtgatcggccacattggaactgagacacggtccaaacttctacggaaggcagcagtaaggaatcttgcacaatgggggaaaccctgatgcagcaacgccgcgtgaacgatgaaggccttagggttgtaaagttctgatctgggggaagaaggaagtgacggtaccccaggagaaagccccgg

SEQ ID NO: 2287 - DNA, 490 bp, Unknown
  Ascusbbf_704192, encodes 16S rRNA
agagtttgatcatggctcaggacgaacgctggcggcgtgcttaacacatgcaagtcgaacgggaagaaaagaaagagcttgctcttttttggattctagtggcaaacgggtgagtaacacgtaaacaacctgccttcaggatggggacaacagacggaaacgactgctaataccgaataccttccaatttccgcatggagatgggaagaaagggtggcctctacttgtaagctatcgcctgaagagggggttgcgtctgattagctagttggtgaggtaacggcccaccaaggcgacgatcagtagccggtctgagaggatgaacggccacactggaactgagacacggtccagactcctacgggaggcagcagtggggaatcttccgcaatggacgaaagtctgacggagcaacgccgcgtgaacgatgaaggtcttcggattgtaaagttctgtgatccgggacgaaggcattgattgagaacattga

SEQ ID NO: 2288 - DNA, 490 bp, Unknown
  Ascusbbf_285658, encodes 16S rRNA
agagtttgatcctggctcaggatgaacgctggcggcgtgcttaacacatgcaagtcgaacggaggacccttgaaggagttttcggacaacggataggaatccttagtggcggacgggtgagtaacgcgtgaggaacctgccttggagaggggaataacacagagaaatttgtgctaataccgcataacgcagtcatatcgcatggtaagactgccaaagatttatcgctctgagatggcctcgcgtctgattagcttgttggcggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttatgtaggacgaagcaagtgacggtactacatgaataagctccg

SEQ ID NO: 2289 - DNA, 391 bp, Unknown
  Ascusbbf_1325840, encodes 16S rRNA
agagtttgatcatggctcagattgaacgctggcggcaggcctaatacatgcaagtcgaacggtaacataagaaaagcttgcttttcttgatgacgagtggcggacgggtgagtaacatttgggaaactacctgatagagggggacaacagttggaaacgactgctaataccgcatacagcctaagggtgaaagaagcaattcgctatcagatgtgcccaaaacgggattagctagtaggtgaggtaaaggctcacctaggcgatgatctctagctggtctgagaggatgatcagccacattgggactgagacacggcccagactcctacgggaggcagcagtagggaatattgcacaatggaggtaactccgtgccagcagccgcggtaat

SEQ ID NO: 2290 - DNA, 490 bp, Unknown
  Ascusbbf_1789073, encodes 16S rRNA
agagtttgatcctggctcagattgaacgctggcggcaggcctaacacatgcaagtcgagcggtaacaggagaagcttgcttcttgctgacgagcggcggacgggtgagtaatacttgggtatctgcccgatagtgggggacaacacggggaaactcgtgctaataccgcatacgtcctacgggagaaagcaggcttaggcttgcgctatcggatgagcccaagtcggattagctagttggtgaggtaaaggctcaccaaggcgacgatccgtaactggtctgagaggatgatcagtcacaccgggactgagacacggcccggactcctacgggaggcagcagtggggaatattggacaatgggggcaaccctgatccagccatgccgcgtgtgtgaagaaggccttagggttgtaaagcactttcagtgaggaggaaaagttagtggttaatacccactagccgtgacgttactcacagaagaagcaccg

SEQ ID NO: 2291 - DNA, 490 bp, Unknown
  Ascusbbf_1593361, encodes 16S rRNA
agagtttgatcatggctcaggacgaacgctggcggcgtgcctaacacatgcaagtcgagcggaggaacacagaggaagttttcggacggaatctatgttctttagcggcggacgggtgagtaacgcgtgagcaacctgcctatcacagggggataacgcaccgaaaggtgcactaataccgcatgagaccacaacctcgcatgaggaagaggtcaaaggagcaatccggtgagagatgggctcgcgtccgattagatagttggtggggtaaaggcctaccaagtcaacgatcggtagccgacctgagagggtgatcggccacactggaactgagagacggtccagactcctacgggaggcagcagtggggaatattgggcaatgggggaaaccctgacccagcaacgccgcgtgagggaagaaggccttcgggttgtaaacctttgtccttagtgaagagcagaagacggtagctaaggaggaagccccg

SEQ ID NO: 2292 - DNA, 490 bp, Unknown
  Ascusbbf_46536, encodes 16S rRNA
agagtttgatcatggctcaggatgaacgctggcggcgtgcttaacacatgcaagtcgagcgagaagctcgtgaacgattcttcggatgagtgatcgagtggaaagcggcggacgggtgagtaacgcgtaggcaacctgccccatacaaagggatagctactggaaacggtaattaatacctcataacacggagagaccgcatgatctttccgtcaaagatttatcggtatgggatgggcctgcgtctgattagctggttggtggggtaacggcccaccaaggcgacgatcagtagccgacctgagagggtaaacggccacattggaactgagacacggtccaaactcctacgggaggcagcagtggggaatattgcacaatggggggaaccctgatgcagcaacgccgcgtgagcgaagaaggcctttgggtcgtaaagctctgtcctgaaggaagaaggaagtgacggtacttcaggaggaagccccgg

SEQ ID NO: 2293 - DNA, 490 bp, Unknown
  Ascusbbf_130320, encodes 16S rRNA
agagtttgatcctggctcaggacgaacgctggcggcgcgcctaacacatgcaagtcgaacgagagatgaggagcttgctcttcaaatcgagtggcgaacgggtgagtaacgcgtgaggaacctgcctcaaagagggggacaacagttggaaacgactgctaataccgcataagcccacagctcggcatcgagcagagggaaaaggagtgatccgctttgagatggcctcgcgtccgattagctagttggtgaggtaacggcccaccaaggcgacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgttgttgaggaagataatgacggtactcaacaaggaagtgacggctaactacgtgccag

SEQ ID NO: 2294 - DNA, 490 bp, Unknown
  Ascusbbf_63925, encodes 16S rRNA
agagtttgatcatggctcagaatgaacgttggcggcgtggattaggcatgcaagtcgaacggtaaggttacttagcttgctttgtaaccctagagtggcgaaagggatagtacaatgtagatcatataccctcaggttggggatagcgtctggaaacgggcggtaatacccgataacatctccggatcaaaggtgagattccgcctgaggattagtttacacactattagcttgttggcggggtaatggcccaccaaggcgacgatggttaccgggcgtgagagcgtgacccggatcactgggactgagacactgcccagacacctacgggtggctgcagtcgagaatcttcggcaatggacgaaagtctgaccgagcgacgccgcgtgtatgatgaaggccttcgggttgtaaaatactgtcgattaggcggaagtgtataggggttctcccttatacttgacctatcattggaggaaggacgggctaa

SEQ ID NO: 2295 - DNA, 490 bp, Unknown
  Ascusbbf_721770, encodes 16S rRNA
agagtttgatcatggctcaggacgaacgctggcggcatgcctaatacatgcaagtcgagcggagttgataggaagcttgcttccttgatacttagcggcggacgggtgagtaacacgtaggcaacctgccctcaagcttgggacaactaccggaaacggtagctaataccgaatacttgttttcttcgcctgaagggaactggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggta

SEQ ID NO: 2296 - DNA, 490 bp, Unknown
  Ascusbbf_77712, encodes 16S rRNA
agagtttgatcatggctcaggacgaacgctggcggcgtgcctaacacatgcaagtcgaacggagtgatttggattcgtctggatcacttagtggcggacgggtgagtaacgcgtgagcaacctgcccttcagagggggacaacagttggaaacgactgctaataccgcataacatatatttggggcatctcagatatatcaaagattttatcgctgagggatgggctcgcgtctgattagatagttggtggggtaacggcctaccaagtcgacgatcagtagccggactgagaggttgaacggccacattgggactgagatacggcccagactcctacgggaggcagcagtggggaatattgggcaatgggggcaaccctgacccagcaacgccgcgtgaaggaagaaggctttcgggttgtaaacttcttttatgtgggacgatagtgacggtaccacatgaataagccacggctaactacgtgccagc

SEQ ID NO: 2297 - DNA, 490 bp, Unknown
  Ascusbbf_65518, encodes 16S rRNA
agagtttgatcatggctcaggataaacgctggcggcgcacataagacatgcaagtcgaacggacttaaccgttagtttactaatggagcggttagtggcggactggtgagtaacgcgtaagcaatctgcctgttagagggggataacagtgagaaatcactgctaataccgcatatgctgtgaacatcacatgatgtaaacaggaaaggagcaatccgctaatagatgagcttgcgtctgattagttagttggtgaggtaacggcccaccaagacgatgatcagtagccggactgagaggttaaacggccacattgggactgagatacggcccagactcctacgggaggcagcagtcgggaatattgcgcaatggaggaaactctgacgcagtgacgccgcgtgcaggaagaaggttttcggattgtaaactgctttagacagggacgaaaaaaatgacggtacctgtagaataagctccggctaactac

SEQ ID NO: 2298 - DNA, 490 bp, Unknown
  Ascusbbf_109932, encodes 16S rRNA
agagtttgatcctggctcaggacgaacgctggcggcgtgcctaacacatgcaagtcgagcggggacactgggggagcttgcttcactggtgttctagcggcggacgggtgagtaacgcgtgaacaatctgtcccggacagggggataacacttggaaacaggtgctaataccgcataagcccacggcatcacatgatgcagggggaaaaggagcgatccggtttggggtgagttcgcgtccgattagatagttggtgaggtaacggcccaccaagtcaacgatcggtagccgacctgagagggtgatcggccacattggaactgagacacggtccaaactcctacgggaggcagcagtgggaatattgggcaatgggcgaaagcctgacccagcaacgccgcgtgagggaagaaggttttcggattgtaaacctctgtcctcagggacgaaggaagtgacggtacctgaggaggaagccccggctaacta

SEQ ID NO: 2299 - DNA, 490 bp, Unknown
  Ascusbbf_205713, encodes 16S rRNA
agagtttgatcatggctcaggataaacgctggcggcgtgcttaacacatgcaagtcgaacggagtggttctcccgaagacctgacgagcttgctctgatggaattcatttgaatcacttagtggcggacgggtgagtaacgcgtgggtaacctgcctcacactgggggatagcagttggaaacgactgataataccgcataagcgcacagtaccgcatggtacagtgtgaaaaactccggtggtgtgagatggacccgcgtctgattagctagttggtgaggtaacggcccaccaaggcgacgatcagtagccggcctgagagggtgtacggccacattgggactgagacacggcccaaactcctacgggaggcagcagtggggaatattggacaatgggggcaaccctgatccagcgacgccgcgtgagcgaagaagtatttcggtatgtaaagctctatcagcagggaagataatgacggtacctgac

SEQ ID NO: 2300 - DNA, 490 bp, Unknown
  Ascusbbf_161868, encodes 16S rRNA
agagtttgatcctggctcaggacgaacgctggcggcgtgcttaacacatgcaagtggagcgacgaaccagggcttgccctggggcaaagccgcgaacgggtgagtaacacgtgagtaacctgccccgatgactgggataacccgaggaaactcgggctaataccggatgtggtgaacgcgcataagcgcattcatcaaaggtagcttcggcttccgcattgggaggggctcgcggcccattagctagttggtggggtaaaggcctaccaaggcaacgatgggtagctggtctgagaggacgatcagccacactgggactgagacacggcccagactcctacgggaggcagcagtggggaatcttgcgcaatgcgcgaaagcgtgacgcagcaacgccgcgtgagggaagacggccttcgggttgtaaacctctttcagatgggacgaaggcgcaccggttaacagccgtgtgggctgacggtaccttcag

SEQ ID NO: 2301 - DNA, 490 bp, Unknown
  Ascusbbf_908010, encodes 16S rRNA
agagtttgatcctggctcaggacgaacgctggcggcgtgcttaacacatgcaagtcgaacgctgaagccctttcgggggtggatgagtggcgaacgggtgagtaacacgtgggtaatctgccctgtacttcgggataagccttggaaacggggtctaataccggataggacacactgtcgcatggtggtgtgtggaaagttccggcggtatgggacgagcccgcggcctatcagcttgatggtggggtgatggcctaccatggcgacgacgggtagccggcctgagagggtgaccggccacactgggactgagacacggcccagactcctacgggaggcagcagtggggaatcttgcgcaatgggcgaaagcctgacgcagcaacgccgcgtgagggaggacggccttcgggttgtaaacctctttcgacaccgacgaaggccctgtgggtttgacggtaggtgtggaagaagcaccggctaactacgtg

SEQ ID NO: 2302 - DNA, 490 bp, Unknown
  Ascusbbf_62955, encodes 16S rRNA
agagtttgatcctggctcaggacgaacgctggcggcgtgcttcatacatgcaagtcgaacgagaagctgacttcggtcagtggaaagtggcggacgggtgagtaatatgtaggaaatctgccctagagagggggacaacagagggaaacttctgctaataccccatatgagcttagttgaaatactaatcttgaaaactccggtgctctgggatgagcctgcatctgattagctagttggcggtgtaatggaccaccaaggcgacgatcagtagctggtttgagaggatgatcagccacaatgggactgggacacggcccatactcctacgggaggcagcagtagggaattttgcgcaatgggcgaaagcctgacgcagcaacgccgcgtgaacgattaagcccttcggggtgtaaagttctgtcagtggggacgaaacttgacggtacccacagaggaagcaccggctaactccgtgccagcagccgcg

SEQ ID NO: 2303 - DNA, 490 bp, Unknown
  Ascusbbf_682592, encodes 16S rRNA
agagtttgatcctggctcaggatgaacgctagctacaggcttaacacatgcaagtcgaggggcagcacatgaagtagcaatacggatggtggcgaccggcgcacgggtgagtaacgcgtatgcaacctgcctacaacaggggaataacccgttgaaagacggactaataccccataacacagggatcccgcatgggaatatttgttaaagatttatcggttgtagatgggcatgcgttccattagcttgttggtgaggtaacggctcaccaaggcaacgatggataggggaactgagaggtttatcccccacactggtactgagacacggaccagactcctacgggaggcagcagtgaggaatattggtcaatggacgcaagtctgaaccagccacgtcgcgtgaaggaagacggccctacgggttgtaaacttcttttgtaagggaataaagtgtagtacgtgtactattttgcatgtaccttacgaat

SEQ ID NO: 2304 - DNA, 490 bp, Unknown
  Ascusbbf_10875, encodes 16S rRNA
agagtttgatcctggctcagagtgaacgctggcggcgtggctcagacatgcaagtcgagcgagaatatgccttcgggtataggaaagcggcaaacgggtgagtaatacgtaagtaatctgcctctaaaacgggaatagcttggtgaaaactgaggtaatgcccgataccaacttgtttcgcatgaaacaagtttgaaaggtttgtaatgacgtttagagaggagcttgcggcctatcagcttgttggcggtgtaatagaccaccaaggctaagacgggtagccggtctaagaggatgtacggccacattgaaactgagatacggttcaaacatctatggatggcagcagtttcgaattattcacaatgggcgaaagcctgatggtgcgacgccgcgtggaggatgaaggtcttcggattgtaaactcctgtcgttggggagtaaaaagctggtgaagaatcagccttgagttaacccaaagaggaagcag

SEQ ID NO: 2305 - DNA, 490 bp, Unknown
  Ascusbbf_90673, encodes 16S rRNA
agagtttgatcctggctcaggatgaacgctagcgacaggcttaacacatgcaagtcgaggggcagcgagtggcgttgttcgcaacgccatgtcggcgaccggcgcactggtgagtaacacgtatgcaacctgccctttaccggggcataacccttggaaacgaggcctaattccccatatacagcattcgggcatccgtgagctgtgaaaggtttattccggtgaaggatgggcatgcgtcgcattagcttgttggcggggtgacggcccaccaaggcgacgatgcgtaggggttctgagaggaaggtcccccacactggtactgagacacggaccagactcctacgggaggcagcagtgaggaatattggtcaatggacggaagtctgaaccagccaagtcgcgtgagggaaggcggtcctatggattgtaaacctcttttgtcggggagcaacggccggaacgtgttccggtgtgcgcgtacccgtcg

SEQ ID NO: 2306 - DNA, 490 bp, Unknown
  Ascusbbf_34047, encodes 16S rRNA
agagtttgatcatggctcaggacgaacgctggcggcatgcctaacacatgcaagtcgaacggagccaactaaaagatcccttcggggtgaatttggggaagcttagtggcggacgggtgagtaacgcgtgagtaacctgcctttgagagtggaataacgttccgaaaggaacgctaataccgcataacgtgtcaatatcgcatggtaatgacaccaaagatttatcgctcagagatggactcgcgtctgattagcttgttggtgaggtaacggctcaccaaggcgacgatcagtagccgagctgagaggctgatcggccacattgggactgagacacggcccagactcctacgggaggcagcagtgggggatattgcgcaatggggggaaccctgacgcagcaatgccgcgtgaaggaagaaggtcttcggatcgtaaacttttgtcttcggggacgataatgacggtacccgaggaggaagccacggct

SEQ ID NO: 2307 - DNA, 490 bp, Unknown
  Ascusbbf_34865, encodes 16S rRNA
agagtttgatcctggctcaggatgaacgctggcggcgtgcttaacacatgcaagtcgaacgggaactctagactgaaagttcgctggatgtttagaaattctagtggcggacgggtgagtaacgcgtgggtaacctgcctataagacgtgaacaacagttagaaatgactgctaatacacgataagcacaccagtatcgcatgatacagtgtgaaaagaatttcgcttatagatggacccgcgtttgattagccagttggtggggtaacggcctaccaaagcgacgatcaatagccggcctgagagggcgaccggccacattgggactgagacacggcccaaactcctacgggaggcagcagtggggaatattggacaatgggggcaaccctgatccagcaacgccgcgtgagtgatgaagtatcttggtatgtaaagctctatcagtaggaacgaaaatgacggtacctaactaagaagccccggctaa

SEQ ID NO: 2308 - DNA, 490 bp, Unknown
  Ascusbbf_260827, encodes 16S rRNA
agagtttgatcatggctcagaacgaacgctggcggcgtgcttaacacatgcaagtcgaacgcgaaagcggcttcggtcgtgagtagagtggcgcacgggtgagtaacgcgtagataacctgtcttcatatctgggataacacgccgaaaggggtactaataccggatatactcgcatttcaataggtgaggcgagaaaaggtggcctctgattcaagctactgtatgaagaggggtctgcgtaccattagctagtaggtggggtaatggcctacctaggcgacgatggttagcgggtctgagaggatgatccgccacactggcactggaatacgggccagactcctacgggaggcagcagtgaggaatattgcgcaatgggggcaaccctgacgcagcgacgccgcgtgagtgaggaaggtcttcggatcgtaaagctctgtcaagagggaagaagtgctgggtggctaatatccgcccagtttgacggt

SEQ ID NO: 2309 - DNA, 490 bp, Unknown
  Ascusbbf_38206, encodes 16S rRNA
agagtttgatcctggctcaggatcaacgctggcggcgtgcctaatgcatgcaagtcgaacggggtctccttcgggaggctcacgtggcggacgggtgaggaacacgtggccaatctgcccactggcagggggtagccggcggaaacgccgggtaattccgtatgcgcttgccgctcgagtgggagtggtaaggaaaggggtaacccgccggtggaggaggctgcggccgattagctagttggtggggtaacggctcaccaaggcgatgatcggtagctggtctgagaggatgatcagccacacggggactgagacacggccccgactcctacgggaggcagcagcaaggaattttccgcaatgggcgaaagcctgacggagcaacgccgcgtgcgggatgacgcgtttcggcgtgtaaaccgctgttcgtggggacgaagcactgacggtacccacggaggaaggcccggctaactacgtgccagcagcc

SEQ ID NO: 2310 - DNA, 490 bp, Unknown
  Ascusbbf_53428, encodes 16S rRNA
agagtttgatcatggctcagaatgaacgctggcggcatggattaggcatgcaagtcgaacgagaaagcggcctcggccgcgagtaaagtggcgaaagggtgagtagcacgtggggaacctgccccggggaccggaacaagcccgtgaaaacgggtctgaaaccggatgccgccccggcccgcatgggccggaggcgaaaaattcattgccccgggatggccccgcgccccattagctagttggcggggtgaaggcccaccaaggctgcgacgggtaggtggtctgagaggatggtcacccacactgggactgagacactgcccagactcctacgggaggctgcagtcgagaatcttccgcaatgggcgcaagcctgacggagcgatgccgcgtgagggaaggaggccttcgggtcgtaaacctctgtcggccggaacgaagaaagcgacggtaccggccaaggaagccacggctaaccacgtgccagcag

SEQ ID NO: 2311 - DNA, 490 bp, Unknown
  Ascusbbf_14812, encodes 16S rRNA
agagtttgatcatggctcaggacgaacgctggcggcgtgcttaacacatgcaagtcgaacggagttataggagagcttgctcgaatataacttagtggcggacgggtgagtaacgcgtgaataatctgtctcacacaggggaataacgcatcgaaagatgtgctaataccgcgtaggaccacggaagggcatccttcagaggtgaaaggcttcggccggtgtgaggtgagttcgcgtctgattagatagttggtggggtaacggcctaccaagtcaacgatcagtagccgacctgagagggtgatcggccacattgggactgagacacggcccagactcctacgggaggcagcagtggggaatattgggcaatgggcgaaagcctgacccagcaacgccgcgtgaaggaagaaggttttcggatcgtaaacttctgtccttggtgaagataatgacggtagccaaggaggaagccccggctaactacgtg

SEQ ID NO: 2312 - DNA, 490 bp, Unknown
  Ascusbbf_18554, encodes 16S rRNA
agagtttgatcatggctcaggatgaacgctggcggcgcgcttaacacatgcaagtcgaacggggtgagtaacttcggttatgaattcagtggcggacgggtgagtaacgcgtggataatttgcctttcagtgggggatagctgagagaaatctcaattaataccgcataatataatttatttgcatgattaagttattaaagatgcgaatcgctgaaagagaagtctgcgtctgattagctagttggggtggtaatggcacaccaaggcaacgatcagtaaccggtttgagagaatggacggtcacattgggactgagatacggcccagactcctacgggaggcagcagtggggaatattgcgcaatggaggaaactctgacgcagcgacgccgtgtgaaggatgaaggccttcgggttgtaaacttttatcgattgtgaaaagaaaggatggtagcaaagtaagaagctccggctaactacgtgccagc

SEQ ID NO: 2313 - DNA, 490 bp, Unknown
  Ascusbbf_183116, encodes 16S rRNA
agagtttgatcctggctcaggataaacgctggcggcgcacataagacatgcaagtcgaacggaagtcgttatattgattttgaagaaaacggagaacttgttcaaagggacatgatgaagatatataacaatggctttagtggcggactggtgagtaatacgtaagcaacctgcctatcagaggggaacaacagttagaaatgactgctaataccgcatatgccatagtaaccacatggttacagtgggaaaggagtaatctgctgatagatgggcttacggctgattagctagttggtggggtaatggcctaccaaggcgacgatcagtagccggactgagaggttcaacggccacattgggactgagatacggcccagactcctacgggaggcagcagtcgggaattttgcgcaatggaggaaactctgacgcagtgacgccgcgtgcaggaagaaggttttcggattgtaaactgctttagacaggg

SEQ ID NO: 2314 - DNA, 490 bp, Unknown
  Ascusbbf_95122, encodes 16S rRNA
agagtttgatcatggctcaggatgaacgctggcggcgtgcgtaacacatgcaagttgagcgacgacgtttccgaagtggcgacatggaggggacgagcggagcagcggacgggtgagtacaacatgagaagctgtcctttggtgggggacaacgtctggaaacggacgctaataccccataggccgagaggttaaagccgtaaggcgccaaggggggtgctcgtgtcctatcagctagttggtgaggtaatggctcaccaaggcgacgacgggtagccggcctgagagggtgtccggccacactgggactgagatacggcccagactcctacgggaggcagcagtggggaatattgggcaatgggagagatcctgacccagcgacgccgcgtgaacgaagaaggccttcgggtcgtaaagttcttttatgggggaagaaggaagtgacggtaccccatgaataagccccggctaactacgtgccagcagc

SEQ ID NO: 2315 - DNA, 490 bp, Unknown
  Ascusbbf_85882, encodes 16S rRNA
agagtttgatcatggctcaggacgaacgctggcggcgtgcctaacacatgcaagtcgaacggagtgaaacgctgatccgagagcagcttgctgcaggacgatcttgtttcacttagtggcggacgggtgagtaacgcgtgagcaacctgcccttcagagggggacaacagttggaaacgactgctaataccgcataacgtatcgggaggacatcctcctgataccaaaggagcaatccgctgaaggatgggctcgcgtccgattagatagttggcggggcaacggcccaccaagtcgacgatcggtagccggactgagaggttgatcggccacattgggactgagatacggcccagactcctacgggaggcagcagtgggggatattgcacaatggaggaaactctgatgcagcaacgccgcgtgagggaagaaggtcttcggattgtaaacctttgtctttggtgacgaaacatgacggtagccaagga

SEQ ID NO: 2316 - DNA, 490 bp, Unknown
  Ascusbbf_69559, encodes 16S rRNA
agagtttgatcctggctcagaatgaacgctggcggcatggattaggcatgcaagtcgaacgagaaagttagcaatagcgagtaaagtggcgaaagggtgagtaacacgtgaggaacctgccccctggcccggaacaagcctgtgaaaacgggtctgacaccggatgaggacccctcccgcatgggaggcagtccaaatattgatagccaagggatggcctcgcgtcccattagctagttggcggggtaacggcccaccaaggctgcgacgggtaggtggtctgagaggatggtcacccacactgggactgagacactgcccagactcctacgggaggctgcagtcgagaatcttccgcaatgggcgcaagcctgacggagcgatgccgcgtgagggacgaaggccttcgggttgtaaacctctgtcgacgggaacgaacacaatgacggtacccgtcaagaaagccacggctaaccacgtgccagcagcc

SEQ ID NO: 2317 - DNA, 490 bp, Unknown
  Ascusbbf_40860, encodes 16S rRNA
agagtttgatcatggctcaggatgaacgctagcggcaggcttaacacatgcaagtcgaggggcagcgcggggtagcaatactctggcggcgaccggcggaagggtgagtaacgcgtgagcaacatgcccgtgacagggggataagcgctggaaacggcgtctaatatcccgtaacacagcggatggcatcatctgctgttgaaagctacggtggtcacggattggctcgcgtcccattaggcagttggcggggtaacggcccaccaaaccgacgatgggtaggggttctgagaggaaggtcccccacaatggaactgagacacggtccatactcctacgggaggcagcagtgaggaatattggtcaatgggcggaagcctgaaccagccatgccgcgtgaaggaataaggccctatgggtcgtaaacttcttttgacgcagagcaataaggattacgtgtaatccgatgagagtatgtgtcgaataagca

SEQ ID NO: 2318 - DNA, 490 bp, Unknown
  Ascusbbf_105424, encodes 16S rRNA
agagtttgatcatggctcagaacgaacgctggcggcgcgtcttaagcatgcaagtcgagcggtaagattggtgcttgcaccgatcctagagcggcggactggtgagtaacgcgtgggtgacctaccccgtggatgggaatagccggtagaaataccgggtaatgccgaatacggtccctgacgtcagaggtcagggaggaaaggagctccggctccgccacgggaagggcccgcgtactattagctagttggtgaggtaacggcccaccaaggcgacgatagttatccggcctaagagggtgaacggacacattgggactgagatacggcccagactcctacgggaggcagcagctaagaatattccgcaatgggcgaaagcctgacggagcgacgccgcgtggatgatgaaggccggaaggttgtaaaatccttttgtacatgaggaataagcgcaggagggaatgcctgcgtggtgactgtagtgtaa

SEQ ID NO: 2319 - DNA, 490 bp, Unknown
  Ascusbbf_199459, encodes 16S rRNA
agagtttgatcatggctcaggatgaacgctggcggcgcatttaagacatgcaagtcgaacgaaaaaactcaattgaaatggaatcgaagatttatctgagaagaagtttcgcccgagttttttagtggcggacgggtgagtaatacatagataatctgcctttcagagagaaataacaagaagaaattcttgctaatgtcacataagaccacactaccgcatgatagagaggtcaaaggagaaatccgctgaaagatgagtctatggctgattagctagttggcaaggtaagagcttaccaaggcgatgatcagtagccgagctgagaggctggccggccacattgggactgagacacggcccagactcctacgggaggcagcagttgggaatattggacaatggaggaaactctgatccagtgacgccgcgtgaaggaagaaggtcttcggattgtaaacttattttatcagggaagaaaaaaatgact

SEQ ID NO: 2320 - DNA, 490 bp, Unknown
  Ascusbbf_110106, encodes 16S rRNA
agagtttgatcatggctcaggatgaacgctggcggcgtgcttaacacatgcaagtcgaacgggattatttggaagcttgcttttgaataatctagtggcggacgggtgagtaacgcgtgggtaacctgccgtatgctgggggacaacagttggaaacgactgctaataccgcataagcgcacagggccgcatggcccggtgtgaaaaactccggtggcatacgatggacccgcgtctgattaggcagttggcgaggtaacggctcaccaaaccgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcaggaaagaaaatgacggtacctgactaagaagccccggctaactacgtgcc

SEQ ID NO: 2321 - DNA, 490 bp, Unknown
  Ascusbbf_68277, encodes 16S rRNA
agagtttgatcatggctcaggatgaacgctggcggcgtgcctaacacatgcaagtcgagcgagaatcttagaagtgaagtttcgatggatcttttaagaggagagcggcggacgggtgagtaacgcgtaggcaacctgcctcacactgagggatacttccgggaaactggaactaatacctcataacgcgagagtttcacatgttactctcgccaaagatttatcggtgtgagatgggcctgcgtctgattagatagttggtgaggtaacggcccaccaagtcaacgatcagtagccgacctgagagggtaatcggccacattggaactgagacacggtccaaactcctacgggaggcagcagtggggaatattgcacaatggaggaaactctgatgcagcaacgccgcgtgaaggatgaaggtcttcggatcgtaaacttctgtccttggggacgaaacaaatgacggtacccttggaggaagccccgg

SEQ ID NO: 2322 - DNA, 490 bp, Unknown
  Ascusbbf_56857, encodes 16S rRNA
agagtttgatcatggctcagattgaacgctggcggcatgccttacacatgcaagtcgaacggtaacaggtcttcggatgctgacgagtggcgaacgggtgagtaatacatcggaacgtgcccgatcgtgggggataacgaggcgaaagctttgctaataccgcatacgatctacggatgaaagcgggggatcttcggacctcgcgcggacggagcggccgatggcagattaggtagttggtgggataaaagcttaccaagccgacgatctgtagctggtctgagaggatgatcagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaaagcctctttctaataaagaggggtcatgacggtaccgtaagaataagcaccg

SEQ ID NO: 2323 - DNA, 490 bp, Unknown
  Ascusbbf_202817, encodes 16S rRNA
agagtttgatcctggctcaggacgaacgctggcggcgcgcctaacacatgcaagtcgaacggagttaaaggagcttgctcttttaacttagtggcggacgggtgagtaacacgtgagcaacctgccttttagtgggggacaacagttggaaacgactgctaataccgcataaagttgcgaggaggcatctccatgcaaccaaagatttatcgctgaaagatgggctcgcgtctgattagatagttggtgaggtaacggcccaccaagtcgacgatcagtagccggactgagaggttgaacggccacattgggactgagacacggcccagactcctacgggaggcagcagtgggggatattggacaatgggggaaaccctgatccagcgacgccgcgtgagggaagaaggttttcggattgtaaacctctgttgacagggaagaaaacgacggtacctgtttagaaagccacggctaactacgtgccagca

SEQ ID NO: 2324 - DNA, 490 bp, Unknown
  Ascusbbf_65936, encodes 16S rRNA
agagtttgatcatggctcagattgaacgctggcggaatgctttacacatgcaagtcgaacggcagcacgggagcttgctcctggtggcgagtggcgaacgggtgagtaacatatcggaacgtacctagtaatgggggataactaatcgaaaggttggctaataccgcatacgccctgagggggaaagcgggggatcgtaagacctcgcgttattagagcggccgatatctgattagctagttggtggggtaaaggcccaccaaggcgacgatcagtagctggtctgagaggacgaccagccacactggaactgagacacggtccagactcctacgggaggcagcagtggggaattttggacaatgggcgcaagcctgatccagccattccgcgtgagtgaagaaggccttcgggttgtaaagctctttcgcaagggaagaaaacttaccttctaataaagggtgaggttgacggtaccttgataagaagc

SEQ ID NO: 2325 - DNA, 490 bp, Unknown
  Ascusbbf_1805943, encodes 16S rRNA
agagtttgatcatggctcaggatgaacgctagcggcaggcttaacacatgcaagtcgaggggcagcgcgttgtagcaatacaatggcggcgaccggcgcaagggtgcgtaacgcgtgagcaacatgcccgcaacagtgggataaccggaggaaactccgactaatacctcataaggatgtaggatggcatcgtccagcatctaaacttacgagggttgcggattggctcgcgggacattaggtagacggcggggtaacggcccaccgtgccgacgatgtctaggggttctgagaggaaggtcccccacactggaactgagacacggtccagactcctacgggaggcagcagtgaggaatattggacaatggtcggaagactgatccagccatgccgcgtgcaggaagacggtcctatggattgtaaactgcttttgtacgggagcaataaggtgtacgcgtacaccgatgagagtaccgtacgaataagc

SEQ ID NO: 2326 - DNA, 490 bp, Unknown
  Ascusbbf_195917, encodes 16S rRNA
agagtttgatcctggctcaggatgaatgctggcggcgtgcctaatacatgcaagtcgagcggtaacagggtttcaccgtgttcttgacactccgggctataagcgggaggttagatttcgaggacaccgtgaagctgctgacgagcggcggacggctgagtaacgcgtgggaacgtaccccaaactgagggataacgcaccgaaaggtgtgctaataccgcatatgatcttcggattaaagcttcggcggtttgggaatggcctgcgtacgattagatagttggtgaggtaatggctcaccaagtcgacgatcgttagatggtttgagaggatgatcatccagactgggactgagacacggcccagactcctacgggaggcagcagtagggaatctttcacaatgggcgaaagcctgatggagcaacgccgcgtgcaggatgaaggccttcgggttgtaaactgcttttataagcgagaaatatgatggt

SEQ ID NO: 2327 - DNA, 490 bp, Unknown
  Ascusbbf_404092, encodes 16S rRNA
agagtttgatcctggctcaggacgaacgctggcggcgtgcctaacacatgcaagtcgaacggggaagagaagcttgcttttctttctagtggcggacgggtgagtaacgcgtgagcaacctacctatcagtgggggataacgtctggaaacagacgctaataccgcatatcgtacataattcgcatgaataagtgtatgaaaggagtaatttgctggtagatgggctcgcgtccgattagccggttggtggggtaacggcctaccaaagcaacgatcggtagccggactgagaggttgaacggccacattgggactgagacacggcccagactcctacgggaggcagcagtgggggatattgcgcaatggaggaaactctgacgcagcaacgccgcgtgaaggatgaaggttttcggattgtaaacttctgttcttggtgaagaaaaaaatgacggtagccaagcagcaagctccggctaactacgtgcc

SEQ ID NO: 2328 - DNA, 490 bp, Unknown
  Ascusbbf_222712, encodes 16S rRNA
agagtttgatcctggctcaggacgaacgctggcggcgtgcttaacacatgcaagtcgaacggacgattccccttcgggggaaaagttagtggcggacgggtgagtaacgcgtgagtaacctgccttggagtggggaataacacagggaaacttgtgctaataccgcataacatcgcgaaggggcatctctttgcgatcaaagatttattgctccaagatgggctcgcgtccgattagatagttggcggggtaacggcccaccaagtcgacgatcggtagccggactgagaggttggccggccacattgggactgagatacggcccagactcctacgggaggcagcagtgaggaatattaggcaatgggggaaaccctgacctagcgacgccgcgtgaaggatgaaggttttcggattgtaaacttcttttatgagggacgatagtgacggtacctcatgaataagccacggctaactacgtgccagcagc

SEQ ID NO: 2329 - DNA, 488 bp, Unknown
  Ascusbbf_1102196, encodes 16S rRNA
agagtttgatcctggctcagaatgaacgctggcggcatggattaggcatgcaagtcgaacggggcccctcggggcccagtggcggaagggtgagtaacacgtgagcaacccgcccccaaggccggaacaagcgctggaaacggcgtctgaaaccggatgaggatccccaccgcatggtggggcgtccaaatattcataccctggggatgggctcgcggcccattagcttgtcggcggggcgacggcccaccgaggcgacgacgggtaggtggtctgagaggatggtcacccacactgggactgagacactgcccagactcctgcgggaggctgcagtcgagaatcttccgcaatgggcgcaagcctgacggagcgatgccgcgtgagggacggaggccttcgggtcgtgaaaatatgtagaaagggacgatgatgacggtaccgggaaaggaagccacggctaaccacgtgccagcagccgcggtaat

SEQ ID NO: 2330 - DNA, 490 bp, Unknown
  Ascusbbf_490980, encodes 16S rRNA
agagtttgatcatggctcagaacgaacgctggcggcgcgtcttaagcatgcaagtcgagcggcaagatgcctccgggcatcctagagcggcggactggtgagtaacacgtggatgacgcaccctcccgacggggatagcctgtggaaacacagggtaataccggataaggccgccagggctggagcctggcggggaaaggggctattgccccgcgggaggagcggtccgcggcccatcagctggttggcggggtaaaggcccaccaaggcgatgacgggtatccggcctgagagggtgagcgggcacattgggactgagatacggcccagactcctacgggaggcagcagctaagaatattccgcaatgggcgaaagcctgacggagcgacgccgcgtggacgatgaaggccggaaggttgcagagtcctttggcgcctgaggaaggagcgcgggagtggaaagcccgcgcggtgactgtagggcgagaa

SEQ ID NO: 2331 - DNA, 490 bp, Unknown
  Ascusbbf_104951, encodes 16S rRNA
agagtttgatcatggctcaggatgaacgctggcggcgtgcttaacacatgcaagtcgaacggagtatagacgctgcagagatttcggtcaaagcttgtttatacttagtggcggacgggtgagtaacgcgtgggtaacctgccgtatgcagggggacaacagttggaaacgactgctaataccgcatatgcgcacagtaccgcatggtacagtgtggaaagatttatcggcatacgatggacccgcgtttgattagatagttggtgaggtaacggctcaccaagtcgacgatcaatagccggcctgagagggcaatcggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagatgatgacggtacctgactaagaagccccgg

SEQ ID NO: 2332 - DNA, 490 bp, Unknown
  Ascusbbf_117769, encodes 16S rRNA
agagtttgatcatggctcaggatgaacgctggcggcgtgcttaacacatgcaagtcgaacggagttttgatgtgagcgagaggtagcttgctattaatcaatcttttcaaaacttagtggcggacgggtgagtaacgcgtgggtaacctgccctgtacagggggataacagttggaaacgactgctaacaccgcataacatcgcgagggcgcatgaccttgcgatcaaatatttataggtacaggatgggcccgcgtctgattagctagatggtgaggtaacggcccaccatggcgacgatcagtagccgtactgagaggtagaacggccacattgggactgagacacggcccaaactcctacgggaggcagcagtggggaatattggtcaatgggggcaaccctgaaccagcgacgccgcgtgagtgaagaagtatttcggtatgtaaagctctatcagcagggacgatgatgacggtacctgactaag

SEQ ID NO: 2333 - DNA, 490 bp, Unknown
  Ascusbbf_398942, encodes 16S rRNA
agagtttgatcatggctcaggatgaacgctggcggcgtgcttaacacatgcaagtcgaacgaggaattattcaacgttttcggacagagagttattccgagtggcggacgggtgagtaacgcgtgggtaacctgccgtatgcagggggacaacagccggaaacagctgctaataccgcataagccggcggggccgcatggcccagccggaaaagatttatcggcatacgatggacccgcgtctgattagccagttggtgaggtaacggcccaccaaagcgacgatcagtagccgaactgagaggttgaccggccacattgggactgagacacggcccagactcctacgggaggcagcagtggggaatattgcacaatggggggaaccctgatgcagcaacgccgcgtgagtgaagaagtatttcggtatgtaaagctctatcagcagggaagaggttgacggtacctgcataagaagccccggctaacta

SEQ ID NO: 2334 - DNA, 490 bp, Unknown
  Ascusbbf_299420, encodes 16S rRNA
agagtttgatcctggctcaggatgaacgctggcggcgtgcctaacacatgcaagtcgaacggttaaggcatcttcggatgcgaatagagtggcgaacgggtgagtaacacgtgaccaacctgccccccgcaccgggacaacgggcggaaacgcctgctaataccggatactccgcgacggacgcctgtccggcgcgggaaagcccaggcggcgggggatggggtcgcggcccatcagctagacggcggggtgacggcccaccgtggcgactacgggtagccgggttgagagaccgaccggccacattgggactgagacacggcccagactcctacgggaggcagcagtggggaatattgcgcaatgggcgcaagcctgacgcagcaacgccgcgtgcgggaaggaggccttcgggtcgtaaaccgctttcatcggggaagacgtcgactgtacccgaggaagaagccccggctaaatacgtgccagcagc

SEQ ID NO: 2335 - DNA, 490 bp, Unknown
  Ascusbbf_193295, encodes 16S rRNA
agagtttgatcctggctcagagttaacgctggcatcgtgcataacacatgcaagtcgaacgggacttagttcttcggaattaagtttagtggcagacgggtgagtaatgtatgagaaacctacctttgagtggggaataacggtccgaaaggattgctaataccccataacatctttgagtggcatcacttaaagattaaagatttatcgcttgaagacggtctcatattccatcagctagttggcagtgtaacggactaccaaggcaacgacggatagccggcctgaaagggcgaccggccacaagggcactgagacacgggccctactcctacgggaggcagcagtggggaattttggtcaatgggcgaaagcctgaaccagcaacgatgcgtggaggatgaaggttctcggattgtaaactccttttgtgagggaagaaaaaaatgacggtacctcacgaataagccacggctaactacgtgccagc

SEQ ID NO: 2336 - DNA, 490 bp, Unknown
  Ascusbbf_287179, encodes 16S rRNA
agagtttgatcctggctcaggatgaacgctggcggcatgcctaagacatgcaagtcgaacgaagtggcccaacaaaaactgagtgcttgcacaaggttggcgatggaatttccacttagtggcagacgggtgagtaacacgtaagtaatctacctcggagactggaataatgtttggaaacggacactaataccggataattcatatttagacaactggatatgctaaaaggagcgtttgctccacttcgagatgagcttgcggcgtattaactagttggtggggtaatggcctaccaaggtgacgatgcgtagccgaactgagaggttgatcggccacattgggactgagacacggcccaaactcctacgggaggcagcagttaggaatattcgtcaatggaggaaactctgaacgagcaatgccgcgtgagtgatgacggtctttatgattgtaaaactctgttgtaaggaacgaacccttgggatag

SEQ ID NO: 2337 - DNA, 490 bp, Unknown
  Ascusbbf_164423, encodes 16S rRNA
agagtttgatcctggctcaggatgaacgctagcggcaggcctaacacatgcaagtcgaggggtaggagacttcggtttctgagaccggcgcacgggtgcgtaacacgtatgcaatctaccttgtacagagggatagcccggagaaattcggattaatacctcatagtattatagagtggcatcattttatgattaaagatttatcggtacaagatgagcatgcgtcccattagttagttggtgtggtaacggcacaccaagacgatgatgggtaggggtcctgagagggagatcccccacactggtactgagacacggaccagactcctacgggaggcagcagtgaggaatattggtcaatggaggcaactctgaaccagccatgccgcgtgcaggaagaaggttctatggattgtaaactgcttttatacaggaagaaattatccctcgtgagggagcttgacggtactgtacgaataaggatcggcta

SEQ ID NO: 2338 - DNA, 490 bp, Unknown
  Ascusbbf_1798795, encodes 16S rRNA
agagtttgatcctggctcaggacaaacgctggcggcgtgcctaacacatgcaagtcgaacgaagcaccggggaaagagacttcggtcaattgaagcggtgacttagtggcggacgggtgagtaatgcatgagcaacctgccctggagagggggacaacagctggaaacggctgctaataccgcataatactgacgggaggcatcttttgtcagtcaaagatttatcgctctgggatgggctcatgtctgattagttagttggcggggcaacggcccaccaagacttcgatcagtagccggactgagaggttgaacggccacattgggactgagatacggcccagactcctacgggaggcaacagtggggaatattgggcaatgggcgcaagcctgacccagcaacgccgcgtgaaggaagaaggctttcgggttgtaaacttcttttatcagggacgaaggatgtgacggtacctgatgaataagccacg

SEQ ID NO: 2339 - DNA, 490 bp, Unknown
  Ascusbbf_93394, encodes 16S rRNA
agagtttgatcatggctcaggatgaacgctggcggcgtgcctaatacatgcaagtcgaacgaggtggatgggagcttgctccttgatacctagtggcgaacgggtgagtaacacgtaggtaacctgcctttcagtttgggatacccagaggaaactttggctaataccaaattattccattcaaggcatcttggatggctaaaaggggcctttaaagcctcgctgatcgatggacctgcggagcattagttagttggtgagataacagcccaccaagacgaggatgcttagccgacctgagagggtgaacggccacactggaactgagacacggtccagactcctacgggaggcagcagtagggagttttcgtcaatgggcgcaagcctgaacgagcaacgccgcgtgaacgatgaaggccttcgggtcgtaaagttctgttgtgagggaaaaatgatagcttgaggaaatgctggctatttgatggtac

SEQ ID NO: 2340 - DNA, 490 bp, Unknown
  Ascusbbf_225780, encodes 16S rRNA
agagtttgatcatggctcaggacgaacgctggcggcgtgcttaacacatgcaagtcgaacgaagcttgatttcggaatccttcgggatgaagaatgatatgacttagtggcggacgggtgagtaacgcgtgagtaacctgcctttcagaggggaataacgtttggaaacgaacgctaataccgcataacatcacgatgtcgcatggcaatgtgatcaaagatttatcgctgaaagatggactcgcgtccgattaggtagttggtagggtaacggcctaccaagccgacgatcggtagccggactgagaggttgaacggccacattgggactgagacacggcccagactcctacgggaggcagcagtggggaatattgcacaatgggcgcaagcctgatgcagcaacgccgcgtgagggaagacggtcttcggattgtaaacctttgtctttggtgaagaagaaagtgacggtagccaaggaggaagccac

SEQ ID NO: 2341 - DNA, 490 bp, Unknown
  Ascusbbf_204438, encodes 16S rRNA
agagtttgatcctggctcaggacgaacgctggcggcgtgcttaacacatgcaagtcgaacgagggttatttggtagcttgctactgggtaattcgagtggcggacgggtgagtaacgcgtgaataatctgtcctatacagggggataacgcatcgaaagatgtgctaataccgcgtaggaccacgatgtcgcatggcattgaggtgaaaggagcaatccagtatagggtgagttcgcgtctgattagatagttggtgaggtaacggcttaccaagtcaacgatcagtagccgacctgagagggtgatcggccacattgggactgagacacggcccagactcctacgggaggcagcagtggggaatattgggcaatgggcgaaagcctgacccagcaacgccgcgtgaaggaagaaggttttcggattgtaaacttctgtcctatgtgaagagtggtagacggtagcataggaggaagccccggctaacta

SEQ ID NO: 2342 - DNA, 490 bp, Unknown
  Ascusbbf_350670, encodes 16S rRNA
agagtttgatcctggctcaggacgaacgctggcggcgtgcctaacacatgcaagtcgagcggggacttattggatgagagcttcggcaggattccggtaagttctagcggcggacgggtgagtaacgcgtgagcaatctgtctcagacagggggataacgcagcgaaagttgcactaataccgcatgagaccacagagccgcatggcttaggggtcaaaggagtaatccggtctgaggtgagctcgcgtcctattaggtagttggtgaggtaacggcccaccaagcctacgataggtagccgacctgagagggtgatcggccacactggaactgagacacggtccagactcctacgggaggcagcagtggggaatattgggcaatgggcgaaagcctgacccagcaacgccgcgtgagtgaagaaggtcttcggattgtaaatctctgtcctaagagaagaggggaagacggtatcttaggaggaagccc

SEQ ID NO: 2343 - DNA, 490 bp, Unknown
  Ascusbbf_709478, encodes 16S rRNA
agagtttgatcatggctcaggatgaacgctggcggcgtgcctaacacatgcaagtcgagcgggaaattgcggaaataagcttcggcagaaataagcgatggatagcggcggacgggtgagtaacgcgtaggtaagctgccccgtgcagagggatagcctagggaaacctggattaataccacataatgcggaggggtcacatggctccatcgccaaagatttatcggcatgggatgcacctgcgtctgattagatagttggtagggtaacggcctaccaagtcaacgatcagtagccgacctgagagggtaatcggccacattggaactgagacacggtccaaactcctacgggaggcagcagtggggaatattgcacaatgggcgcaagcctgatgcagcaacgccgcgtgagtgatgaaggtcttcgggtcgtaaaactctgtccttggggacgaaggaagtgacggtacccaaggaggaagccccgg

SEQ ID NO: 2344 - DNA, 490 bp, Unknown
  Ascusbbf_383825, encodes 16S rRNA
agagtttgatcatggctcaggataaacgctggcggcgtgcttaacacattcaagtcgaacggacaaaggggggcttgccccccggcgttagtggcggacgggtgagtaacgcgtgagcaacctgcctttctccgggggataacattgggaaaccggtgctaataccgcataaagcagccatgtcacatggcgaggctgccaaaggagcaatttggggaaagatgggctcgcgtctgattaggtagttggtggggtaacggcctaccaagccgacgatcagtagccggactgagaggttgaacggccacattggaactgagatacggtccagactcctacgggaggcagcagtggggaatattgggcaatgggcgaaagcctgacccagcgacgccgcgtgaaggaagaaggtcttcggattgtaaacttttgtcagcagggaagaagaaagtgacggtacctgctaagaaagccacggctaactacgtgc

SEQ ID NO: 2345 - DNA, 490 bp, Unknown
  Ascusbbf_1788959, encodes 16S rRNA
agagtttgatcatggctcaggacgaacgctggcggcgtgcctaacacatgcaagtcgagcggggatattggaagagcatgctcggaagatatcttagcggcggacgggtgagtaacgcgtgagcaacctgtcccagacagggggataccagatggaaacatctgctaataccgcataagaccacagtttcgcatgggacagtggtaaaaggagcaatccggtttggggtgggctcgcgtccgattagctggttggtgaggtaacggcccaccaaggcgacgatcggtagccgacctgagagggtgatcggccacattggaactgagacacggtccaaactcctacgggaggcagcagtggggaatattgggcaatgggcgaaagcctgacccagcaacgccgcgtgagggaagaaggttttcggattgtaaacctctgtcctaagcgacgaaggaagtgacggtagcttaggaggaagccccggctaact

SEQ ID NO: 2346 - DNA, 490 bp, Unknown
  Ascusbbf_1479486, encodes 16S rRNA
agatggctcaggacaaacgctggcggcgtgcctaacacatgcaagtcgaacgaagcactgtggaaagagacttcggtcaattgaagctttgacttagtggcggacgggtgagtaatgcatgagcaacctgccctggagagggggacaacagctggaaacggctgctaataccgcatgaagttgcggggaggcatcttcctgcaaccaaagatttatcgctctgggatgggctcatgtctgattagatagttggcggggtaacggcccaccaagtctgcgatcagtagccggactgagaggttgaacggccacattgggactgagatacggcccagactcctacgggaggcagcagtggggaatattgggcagtgggcgcaagcctgacccagcaacgccgcgtgaaggaagaaggctttcgggttgtaaacttcttttatcagggacggagaacgtgacggtacctgatgaataagccacggctaactac

SEQ ID NO: 2347 - DNA, 490 bp, Unknown
  Ascusbbf_133391, encodes 16S rRNA
agagtttgatcatggctcaggacgaacgctggcggcgcgcctaacacatgcaagtcgaacggagttaagggagcttgctctcttaacttagtggcggacgggtgagtaacacgtgagcaacctgcctttcagagggggacaacagttggaaacgactgctaataccgcataacatcatcggacggcatcgtctgatgatcaaagatttatcgctgaaagatgggctcgcgtctgattagatagttggtgaggtaacggcccaccaagtcgacgatcagtagccggactgagaggttgaacggccacattgggactgagacacggcccagactcctacgggaggcagcagtgggggatattggacaatgggggcaaccctgatccagcgacgccgcgtgagggaagaaggttttcggattgtaaacctctgttgacagggaagaaaatgacggtacctgttaagaaagccacggctaactacgtgccagca

SEQ ID NO: 2348 - DNA, 490 bp, Unknown
  Ascusbbf_300190, encodes 16S rRNA
agagtttgatcctggctcagaacgaacgctggcggcatggattaggcatgcaagtcgaacgccgatagcaatatcggagtggcgcaagggtgaggaacacgtgagtaatctgccctcgagttgggaatagctccgggaaactggaattaataccgaataatattgtgagaccgcatggtcttgcacttaaagcagcaatgcgctcgaggaggagctcgcgtcccattagctagttggtgaggtaacggcccaccaaggccatgatgggtagctggtctgagaggacgatcagccacagtgggactgagaactgcccacactcctacgggaggctgcagtcgagaattttgggcaatgggcgaaagcctgacccagcaatgccgcgtgcgggacgaaggtcttcggattgtaaaccgctgtcaagagggacgaaatttgacggtacctctgaaggaagccacggctaactacgtgccagcagccgcggtaa

SEQ ID NO: 2349 - DNA, 490 bp, Unknown
  Ascusbbf_268711, encodes 16S rRNA
agagtttgatcatggctcagaacgaacgctggcggcgcgtcttaagcatgcaagtcgaacgggatcatccagcttgctggatgtgagagtggcggactggtgagtaacacgtgggtgacgtacccttgagacggggatagccggtagaaataccgggtaataccggatgtgaagtgtggtcttggaagccatactggaaaggagcttttgctccgctcgaggaacggcctgcgtcctatcagctagttggtgaggtaaaggcccaccaaggcaatgacaggtatccggccttagagggtaatcggacacattgggactgagatacggcccagactcctacgggaggcagcagctaagaatattccgcaatggacgaaagtctgacggagcgacgccgcgtggatgatgaaggccgtgaggttgtaaaatccttttataacagaggaataagcagaagagtggaatgcttctgtggtgactgtaagttatg

SEQ ID NO: 2350 - DNA, 490 bp, Unknown
  Ascusbbf_910321, encodes 16S rRNA
agagtttgatcctggctcagaacgaacgctggcggcgcgtcttaaccatgcaagtcgagcgggaatatggggcttgccctatatgagagcggcggactggtgagtaacacgtgggtgatgtacctttcggacggggacagcctgtagaaatacggggtaataccggatacgatccatagagtggagtttatggaagaaaggagcttcggctccgccgaaagatcggcctgcggcccatcagctagacggcgaggtaacggctcaccgtggcgacaacgggtatccggcctgagagggtggacggacacattgggactgagatacggcccagactcctacgggaggcagcaggtaagaatattccgcaatggaggaaactctgacggagcgacgccgcgtgtgcgaagaaggccggaaggttgtaaagcactttggtggtcgaagaataaagtgggtagggaatgacctacagatgacggtagaccaagaa

SEQ ID NO: 2351 - DNA, 490 bp, Unknown
  Ascusbbf_721214, encodes 16S rRNA
agagtttgatcatggctcaggacgaacgctggcggcgtgcttcatacatgcaagtcgaacgagaagctgacttcggtcagtggaaagtggcggacgggtgagtaatatgtaggaaatctgcctttaggtgggggacaacagagggaaacttctgctaataccccatatgagctatcttgaaatagatatcttgaaaactctggtgcctagagatgagcctgcatctgattagctagttggtggtgtaatggactaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgaacgattaagcccttcggggtgtaaagttctgtcagtggggacgaaatatgacggtacccacagaggaagcaccggctaactccgtgccagcagccgcg

SEQ ID NO: 2352 - DNA, 490 bp, Unknown
  Ascusbbf_52642, encodes 16S rRNA
agagtttgatcctggctcaggatgaacgctggcggcgtgcctaatacatgcaagtcgagcgaggtagcttgctacctagcggcgaacgggtgagtaacacgttggtaatctacctttcagttggggatacccagaggaaactttggctaataccgtaatacgtaataaggtgaaattccttattataaaaggcccttttgggtcgctgatagatgagcctgcgtctgattagctagttggtgagataatagcccaccaaggcgaggatcagtagccgatctgagaggatgaacggccacaatggaactgagacacggtccatactcctacgggaggcagcagtagggagttttcgacaatgggggcaaccctgatcgagcaacgccgcgtgtgtgatgaaggtcttcggattgtaaagcacttttataagggataaatggtattgatagtggaaagattaatatttgatagtaccttatgaataagtaac

SEQ ID NO: 2353 - DNA, 490 bp, Unknown
  Ascusbbf_381065, encodes 16S rRNA
agagtttgatcatggctcaggatgaacgctggcggcatgcctaagacatgcaagtcgaacgaagtggcccaatgaaaatggagtacttgtacaaaattggatttggatttccacttagtggcagacgggtgagtaacacgtaagtaacctacctttaagactgggataacgtttggaaacgaacgctaataccggacaattcatttttagataactagaaatgctaaaagaagcgtttgcttcacttaaagatgggcttgcggcgtattaactagttggtggggtaatggcctaccaaggtgacgatgcgtagccgggctgagaggctaatcggccacattgggactgagacacggcccaaactcctacgggaggcagcagttaggaatattcgtcaatggaggaaactctgaacgagcaatgccgcgtgagtgatgacagtcttatagattgtaaaactctgttgtaaaggaagaaccctcactatagg

SEQ ID NO: 2354 - DNA, 490 bp, Unknown
  Ascusbbf_34909, encodes 16S rRNA
agagtttgatcctggctcaggatgaacgctagctacaggcttaacacatgcaagtcgcggggcagcatgactttagcttgctaaggttgatggcgaccggcgcacgggtgagtaacgcgtatccaacctgcccatgtctcggggatagcccgctgaaaggcggattaatacccgattcggtcgtttgacggcatccgattacgaccaaaggcttttgtcggacatggatggggatgcgtctgattaggtagtcggcggggtaacggcccaccgagcctatgatcagtaggggttctgagaggaaggtcccccacactggtactgagacacggaccagactcctacgggaggcagcagtgaggaatattggtcaatgggcgcgagcctgaaccagccaagtagcgtgcaggatgactgccctatgggttgtaaactgcttttatgcggggataacatgcgccacttgtggcgcactgcaggtaccgcatga

SEQ ID NO: 2355 - DNA, 490 bp, Unknown
  Ascusbbf_2433, encodes 16S rRNA
agagtttgatcatggctcaggacgaacgctggcggcatgcctaacacatgcaagtcgaacggagctgagaagcttgcttttcagcttagtggcggacgggtgagtaacgcgtgagcaacctgcctttcagtggggaataatatcctgaaaagggtactaataccgcataacgtattgaagccgcatgactttgataccaaagatttatcgctgagagatgggctcgcgtccgattagccagttggtggggtaacggcctaccaaagctacgatcggtagccggactgagaggttgaacggccacattgggactgagacacggcccagactcctacgggaggcagcagtgggggatattgcgcaatgggggaaaccctgacgcagcaatgccgcgtgaaggatgaaggtcttcggattgtaaacttcttttgtcagggacgaaaattgacggtacctgacgaataagctccggctaactacgtgccagcag

SEQ ID NO: 2356 - DNA, 490 bp, Unknown
  Ascusbbf_189987, encodes 16S rRNA
agagtttgatcctggctcaggatgaacgctagcgacaggcctaacacatgcaagtcgaggggcagcgagaggaaagcttgcttttcttgtcggcgaccggcgcacgggtgagtaacgcgtatgcaacctggctactgctacgggatagccttgcgaaagtaagattaataccgtatgtgatatttagagacatctccttatattgaaagatttatcggcagtagatgggcatgcgtctgattagttagttggcggggtaacggcccaccaaggcatcgatcagtaggggttctgagaggaaggtcccccacattggaactgagacacggtccaaactcctacgggaggcagcagtgaggaatattggtcaatggacggaagtctgaaccagccaagtcgcgtgaaggaagacggttctatggattgtaaacttcttttgctcgagggtaaagtgtggtacgtgtaccatattgcaagtatcgagtgaata

SEQ ID NO: 2357 - DNA, 488 bp, Unknown
  Ascusbbf_405652, encodes 16S rRNA
agagtttgatcctggctcagaacgaacgctggcggcaggcttaacacatgcaagttgagcgggattgattgatagcttgctattaatcatgagagcagcgcactggtgagtaacacgtgggaatatacctattggtgggggacaacaattggaaacgattgctaataccgcataagccctgagggggaaagatttattgccgatagattagcccgcggaagattaggtagttggtggggtaatggcctaccaagccgacgatctatagctggtctgagaggacgatcagccacattggaactgagacacggtccagactcctacgggaggcagcagtggggaatattgggcaatggaggcaactctgacccagccatgccgcgtgagtgaagaaggttttcggattgtaaagctctttcggacaggaagataatgacggtactgtctaaagaagccccggctaacttcgtgccagcagccgcggtaat

SEQ ID NO: 2358 - DNA, 490 bp, Unknown
  Ascusbbf_125244, encodes 16S rRNA
agagtttgatcctggctcagaacgaacgctggcggcgtggattaggcatgcaagtcgtacgcgaaagccaccttcgggtggttagtagagtggcgaactggtgagtacaaggtgactaacctgcccttgagtgggggataacgtcgggaaaccggcgctaataccgcatggtctcttagcctttcgaggttacgagtaaagcagcaatgcgctcaaggatggggtcaccccccattagcttgttggtagggtaacggcctaccaaggctacgatgggtagctggactgagaggttggccagccacactgggactgagatacggcccagactcctacggggggcagcagtctagaggctttgacaatgcccgaaagggtgatcaagcgacgccgcgtgtgggatgaatgtcttcggattgtaaaccacttttgtttgggaagaaggcttgtatcgtgaatatgagattgacggtaccaaacgaataagccc

SEQ ID NO: 2359 - DNA, 490 bp, Unknown
  Ascusbbf_43408, encodes 16S rRNA
agagtttgatcatggctcaggatgaacgctggcggcgtgcttaacacatgcaagtcgaacgaagcacatatgaaacgcaagtggaatgtgtgacttagtggcggacgggtgagtaacgcgtgggcaacctaccttgcacagggggataacagttggaaacgactgctaaaaccgcataacatggcgataccgcatgacattgccatcaaatatttataggtgtgagatgggcccgcgtctgattagctagttggtgaggtaacggcccaccaaggcgacgatcagtagccggcttgagagagtgaacggccacattgggactgagacacggcccaaactcctacgggaggcagcagtgggggatattggacaatgggggaaaccctgatccagcgacgccgcgtgagtgaagaagtatttcggtatgtaaagctctatcagcagggaagaaaaagcgcaagcattgactgtacctgactaagaagccccg

SEQ ID NO: 2360 - DNA, 490 bp, Unknown
  Ascusbbf_710566, encodes 16S rRNA
agagtttgatcatggctcaggacgaacgctggcggcgtgcctaatacatgcaagtcgagcggacagaagggagcttgctcccggacgttagcggcggacgggtgagtaacacgtgggcaacctgccccttagactgggataactccgggaaaccggagctaataccggataatccctttctccacctggagagagggtgaaagatggcttcggctatcactaggggatgggcccgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaggaaggccttcgggtcgtaaagctctgttgtgagggaagaagcggtaccgttcgaatagggcggtaccttgacggtacct

SEQ ID NO: 2361 - DNA, 490 bp, Unknown
  Ascusbbf_590317, encodes 16S rRNA
agagtttgatcctggctcaggatgaacgctggcggcgtgcttaacacatgcaagtcgaacggagctgctttgaaagaggattcgtccaattgatgagtatgcttagtggcggacgggtgagtaacgcgtgagtaacctgccttggagtggggaataacacagtgaaaattgtgctaataccgcatgatgcagttgggtcgcatgactctgactgccaaagatttatcgctctgagatggactcgcgtctgattagatagttggcggggtaacggcccaccaagtcgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttctcagggacgaagcaagtgacggtacctgaggaataagccac

SEQ ID NO: 2362 - DNA, 490 bp, Unknown
  Ascusbbf_174006, encodes 16S rRNA
agagtttgatcatggctcagaacgaacgctggtagcgtggattaggcatgcaagtcgaacgggatcggctggatagcaatattcggccgtgagagtggcggattggggaggaacacgtgagcaacctgcccttgagttggggaaaaccgttggaaacgacggctaataccggatgtggcgcctgacggcatcgttggagcgctaaagggggccgcaaggctctcgctcgaggaggggctcgcgcaccatcagctagttggcggggtaacggcccaccaaggcttacggttagctggtctgagaggatgaccagccccactgggactgagatactgcccagactcctacgggaggctgcagtcgaggatcatttgcaatgggcgaaagcctgacaatgcgacgctgcgtggaggatgaaggccttcgggttgtaaactcctgtcatgagggaacaggcgatgatacccaatacgtatcaaagttgagtgta

SEQ ID NO: 2363 - DNA, 490 bp, Unknown
  Ascusbbf_825000, encodes 16S rRNA
agagtttgatcatggctcagattgaacgctggcggcaggcctaacacatgcaagtcgaacggacgagaggagcttgctcctcaagttagtggcggacgggtgagtaacacgtgagcaacctgcccttcggagggggacaacagctggaaacggctgctaataccgcatgatacagtctggaggcatctccgggctgtcaaagattttatcgccgaaggatgggctcgcgtctgattagatagttggtggggtaacggcccaccaagtcgacgatcagtagccggactgagaggttgaacggccacattgggactgagatacggcccagactcctacgggaggcagcagtggggaatattgggcaatgggggcaaccctgacccagcaacgccgcgtggaggaagaaggctttcgggttgtaaactcctttgacgagggacgatagtgacggtacctcgaaaacaagccacggctaactacgtgccagcag

SEQ ID NO: 2364 - DNA, 490 bp, Unknown
  Ascusbbf_52872, encodes 16S rRNA
agagtttgatcatggctcaggacgaacgctggcggcacgcttaacacatgcaagtcgaacggtgaagagtagcttgctacttggatcagtggcggacgggtgagtaacacgtgagcaatctgcctctaagtggggaataacgactggaaacggtcggtaataccgcataacatagccgaaccgcatgatttggttatcaaagatttatcgcttagagatgagctcgcgtctgattagctagttggtgaggtaacggcccaccaaggcgacgatcagtagccggactgagaggttgaacggccacattgggactgagacacggcccagactcctacgggaggcagcagtggggaatattgcacaatgggcgcaagcctgatgcagcgatgccgcgtgagggaagaaggttttcggattgtaaacctctgttgacagggacgataatgacggtacctgttcagaaagctccggctaactacgtgccagcagc

SEQ ID NO: 2365 - DNA, 490 bp, Unknown
  Ascusbbf_208206, encodes 16S rRNA
agagtttgatcatggctcaggatgaacgctagctacaggcttaacacatgcaagtcgcggggcagcatgagggttgcttgcaattcttgatggcgaccggcgtacgggtgagtaacgcgtatccaacctgcccatcactacgggataacccgttgaaaggcggactaataccgtatgatatcgtctgatggcatcagatgacgattaaaggtttggcggtgatggatggggatgcgtctgattaggtagttggtaaggtaacggcttaccaagccttcgatcagtaggggttctgagaggaaggtcccccacattggaactgagacacggtccaaactcctacgggaggcagcagtgaggaatattggtcaatgggcgagagcctgaaccagccaagtagcgtgcaggatgacggccttatgggttgtaaactgcttttatacggggataaatgacgccacgcgtggtgttttgcaggtaccgtatgaat

SEQ ID NO: 2366 - DNA, 490 bp, Unknown
  Ascusbbf_11016, encodes 16S rRNA
agagtttgatcatggctcaggatgaacgctggcggcgtgcataacacattcaagtcgaacggactgattttgtagcttgctacggatgaaagttagtggcggacgggtgagtaacgcgtgagcaacctgcctctgtgtgtgggataccgtctggaaacggacgttaataccgcatgacccatatggatcgcatgttttgtatggcaaagatttattgcacagagatgggctcgcgtctgattaggcagttggtgaggtaacggcccaccaaacctacgatcagtagccggactgagaggttgaacggccacattggaactgagaaacggtccagactcctacgggaggcagcagtggggaatattgggcaatgggcgaaagcctgacccagcgacgccgcgtgaaggaagacggtcctcggattgtaaacttcttttatgagggacgataatgacggtacctcatgaataagccacggctaactacgtgc

SEQ ID NO: 2367 - DNA, 490 bp, Unknown
  Ascusbbf_301225, encodes 16S rRNA
agagtttgatcatggctcaggatgaacgctagcggcaggcttaacacatgcaagtcgcggggcagcgcgctgtagcaatacggtggcggcgaccggcggaagggtgcgtaacacgtgagcaacctgcccgtgacagggggataaccggtggaaacgccgcctaataccccgtaacaacaatgcccgcatgggtgtcgtttgaaagctccggcagtcacggatgggctcgcgcagcattagctagtcggcggggtaacggcccaccgaggcgacgatgcttaggggttctgagaggaagatcccccacactgggactgagacacggcccagactcctacgggaggcagcagtgaggaatattggacaatgggggcaaccctgatccagccatgccgcgtgaaggactgaggccctacgggtcgtaaacttcttttgttgcggagcaataagggtcacgcgtggcccgatgagagtacgcagcgaataagca

SEQ ID NO: 2368 - DNA, 490 bp, Unknown
  Ascusbbf_91323, encodes 16S rRNA
agagtttgatcctggctcaggacgaacgctggcggcgtgcttaacacatgcaagtcgagcggaaaggcccctttttggggtactcgagcggcgaacgggtgagtaacacgtgagtaatctgccctccacttcgggatagccctccgaaagggggattaataccggatggtcatcgcatgctgcatggtgtgtggtggaaagatttggttcggtgggggatgagctcgcggcctatcagcttgttggtggggtgttggcctaccaaggcttcgacgggtagccggcctgagagggtgaccggccacactgggactgagacacggcccagactcctacgggaggcagcagtggggaatattggacaatgggcggaagcctgatccagcaacgccgcgtgggggatgacggccttcgggttgtaaacctctttcagctccgacgaagttcctgctttttggtgggggtgacggtaggggcagaagaaggaccg

SEQ ID NO: 2369 - DNA, 490 bp, Unknown
  Ascusbbf_30653, encodes 16S rRNA
agagtttgatcctggctcaggacgaacgctggcggcgtgcttaacacatgcaagtcgaacgaggttaagagaaggaagtcttcggatggaatttttttaatcgagtggcggacgggtgagtaacgcgtgaggaacctgtcttctacagggggataacggtccgaaaggattgctaataccgcataagaccacgaagccgcatggttttgaggtcaaaggagaaatccggtagaaggtggactcgcgtcccattagatagttggtgaggtaacggcccaccaagtcgacgatgggtagccgacctgagagggtgatcggccacattggaactgagatacggtccagactcctacgggaggcagcagtggggaatattgggcaatgggcgaaagcctgacccagcaacgccgcgtgagggaagaaggtcttcgggttgtaaacctctgtcctaagtgaaaagaaaggatggtagcttaggaggaagctccgg

SEQ ID NO: 2370 - DNA, 490 bp, Unknown
  Ascusbbf_5326, encodes 16S rRNA
agagtttgatcatggctcaggatgaacgctggcggcaggcttaatacatgcaagtcgaacggtaaggccgagtgcagcaatgcatgaggtacacgagtggcgcacgggtgcgtaacgcgtatgcaacctgcccccaaccgggacaaaacagctggaaacggctgctaatatcccatggccacttgggagggcatcctcctgagtgtaaagattcattggttggggatgggcatgcgtattattaggtagttggcggggtaacggcccaccaagccgacgatgattaggggtcctgagagggttaacccccacactggaactgagacacggtccagactcctacgggaggcagcagtagggaatattgggcaatgggagcaatcctgacccagccatgccgcgtgaaggaagacggccctatgggttgtaaacttcttttgccgcagagtaaacctggggacgtgtccccagttgagagtatgcggcgaat

SEQ ID NO: 2371 - DNA, 490 bp, Unknown
  Ascusbbf_66057, encodes 16S rRNA
agagtttgatcatggctcaggatgaacgctagcggcaggcttaacacatgcaagtcgaggggcagcgggtgtagcaatacatgccggcgaccggcgaaagggtgagtaacgcgtgagcaacatgcccgatactgggggatagtcgatggaaacgtcgcgtaataccccgtaacacaaatcttcgcatgggggtttgttgaaagattgattggtatcggattggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggatgacggccctatgggttgtaaaccgcttttgcgggggagcaataaggtgcacgtgtgcaccgatgagagtaccctgcgaataagcatc

SEQ ID NO: 2372 - DNA, 490 bp, Unknown
  Ascusbbf_76482, encodes 16S rRNA
agagtttgatcatggctcagaacgaacgctggcggcgcgtcttaagcatgcaagtcggacggcaagattagagcttgctctgatcctagagtggcggactggtgagtaacgcgtgggtgacgtacccttttgacggggatagcttttagaaataagagataataccggataagctctgcattgttagagggtgcagaggaaaggttctttagaaccgcgaaaggaacggcccgcgtactattagctggttggtgaggtaacggcccaccaaggcgatgatagttacccggcctaagagggtgatcgggcacattgggactgagatacggcccagactcctacgggaggcagcagctaagaatattccgcaatgcacgaaagtgtgacggagcgacgccgcgtggatgatgaaggccggaaggttgtaaaatccttttatacgtgaggaataagtggagtgagagaaacgcttcatggtgactgtagcgta

SEQ ID NO: 2373 - DNA, 490 bp, Unknown
  Ascusbbf_101806, encodes 16S rRNA
agagtttgatcatggctcaggatgaacgctagcggcaggcttaacacatgcaagtcgaggggcagcgcggatagcaatatctggcggcgaccggcgaaagggtgcggaacacgtgagcaacttgcccgtgacagggggataagcgctggaaacggcgtctaataccccgtaacacaagggatggcatcgtcctttgttgaaagtcttcggatggtcacggatgggctcgcgcgacattaggtagacggcggggtaacggcccaccgtgccgacgatgtctaggggttctgagaggaaggtcccccacactggaactgagacacggtccagactcctacgggaggcagcagtgaggaatattggtcaatggccggaaggctgaaccagccatgccgcgtgcaggaataaggtcctatggattgtaaactgcttttatgtgggagcaataaggtctacgtgtagaccgatgagagtaccatatgaataagca

SEQ ID NO: 2374 - DNA, 490 bp, Unknown
  Ascusbbf_219043, encodes 16S rRNA
agagtttgatcatggctcaggatgaacgctggcggcgtgcctaacacatgcaagtcgagcgagaaacttacagatgacgcttcggtcgattcagtaagcggaaagcggcggacgggtgagtaacgcgtaggcaacctgcccttcacacagggatagcctctggaaacggggattaaaacctgataacgcataactgttgcatatcagatatgccaaagatttatcggtgagggatgggcctgcgtctgattagttagttggtggggtaacggcctaccaaggcagcgatcagtagccgacctgggagggtgatcggccacattggaactgagacacggtccagactcctacgggaggcagcagtggggaatattgcacaatgggcgaaagcctgatgcagcaacgccgcgtgagcgatgaaggcctttgggtcgtaaagctctgtccttggggaagaaaaaaatgacggtacccttggaggaagccccgg

SEQ ID NO: 2375 - DNA, 490 bp, Unknown
  Ascusbbf_110689, encodes 16S rRNA
agagtttgatcatggctcaggatgaacgctggcggcatgcctaagacatgcaagtcgaacgaggtgccccattgaagatgaagtgcttgcactgatttggatttggatcagcacctagtggcggacgggtgagtaacacgtgggtgatctacccttaagactggaatacctattggaaacgatagttaataccggataacacattaattcgttttaatgttgaaaggagcccttaaagctctgcttttggatgagcctgcggcgtattagttagttggtggggtaacggcctaccaagacgacgatgcgtagccgaactgagaggttgatcggccacattgggactgagacacggcccaaactcctacgggagacagcagttaggaatattcgtcaatgggggaaaccctgaacgagcaatgccgcgtgaacgatgaaggccctatgggttgtaaagttctgttatatgggaagaatggttagaatagga

SEQ ID NO: 2376 - DNA, 490 bp, Unknown
  Ascusbbf_120358, encodes 16S rRNA
agagtttgatcctggctcaggatgaacgctggcggcgtgcttaatacatgcaagtcgaacggagtttagatgaaacctagtgattctaaacttagtggcggacgggtgagtaacgcgtgggtaacctgccctgtacagggggataacggttggaaacgaccgctaaaaccgcataacatcggaataccgcatgatgttccggtcaaatatttataggtacaggatgggcccgcgtctgattagctagttggcgaggtaacggcccaccaaggcgacgatcagtagccgtactgagaggtagaacggccacattgggactgagacacggcccaaactcctacgggaggcagcagtagggaatattggtcaatgggggaaaccctgaaccagcgacgccgcgtgagtgaagaagtatttcggtatgtaaagctctatcagcagggacgataatgacggtacctgactaagaagccccggctaactacgtgcc

SEQ ID NO: 2377 - DNA, 490 bp, Unknown
  Ascusbbf_656978, encodes 16S rRNA
agagtttgatcatggctcaggatgaacgctggcggcgtgcctaatacatgcaagtcgaacggatcacttcggtgatcagtggcgaacgggtgagtaacacataaacaatctaccctgaagactgggataacggttggaaacgaccgctaataccggataggtgatcttaaggcatcttgagatcattaaagttgggctgcaacactgcaggatgagtttatgtcgcattagctagttggcggggcaacggcccaccaaggcgatgatgcgtagccggtctgagaggatgaacggccacattgggactgagacacggcccagactcctacgggaggcagcagtagggaattttcggcaatgggggaaaccctgaccgagcaacgccgcgtgaacgatgaaggtctttggattgtaaagttctgttacgagggaagaatggcttattcagggaatgggataagcagagacggtacctcgccagaaagccacg

SEQ ID NO: 2378 - DNA, 490 bp, Unknown
  Ascusbbf_37422, encodes 16S rRNA
agagtttgatcctggctcaggacgaacgctggcggcgtgcttcatacatgcaagtcgaacgataaggttccttcgggaatacataagtggcggacgggtgagtaatatgtagagaatctgcctttaggcgggggacaacagagggaaacttctgctaataccccatatgagcgtagctgaaatgctattcttgaaagctccggcgcctagagatgagtctgcatctgattagctagttggcggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgatcgagaagcccttcggggtgtaaagatctgtcagtagggacgaaaaatgactgtacctacagaggaagcaccggctaactccgtgccagcagccgcgg

SEQ ID NO: 2379 - DNA, 490 bp, Unknown
  Ascusbbf_42296, encodes 16S rRNA
agagtttgatcatggctcaggacgaacgctggcggcacgcttaacacatgcaagtcgaacgaacgaaggagagcttgctctccggagttagtggcggacgggtgagtaacacgtgagcaacctgccttcgagcgaggaataatggctggaaacggccactaatacctcataatgcagcggtaccgcatgatactgctgccaaagatttatcacttgaagatgggctcgcgtccgattagttagatggtgaggtaacggctcaccatgaccgcgatcggtagccgtactgagaggtagaacggccacattgggactgagacacggcccagactcctacgggaggcagcagtggggaatattgcacaatggaggaaactctgatgcagcgatgccgcgtgagggaagaaggctttcgggttgtaaacctctgttctcagggacgataatgactgtacctgaggagaaagctccggctaactacgtgccagca

SEQ ID NO: 2380 - DNA, 490 bp, Unknown
  Ascusbbf_490911, encodes 16S rRNA
agagtttgatcctggctcaggatgaacgctggcggcgtgcttaacacatgcaagtcgaacgaagcacctctcccgaagattgacacagcttgctgtagattgattcatttgaggtgactgagtggcggacgggtgagtaacgcgtgggtaacctgcctcatagagggggacaacagttggaaacgactgctaataccgcatagtaagaaggattcgcatgttttcttcttgaaagatttatcgctatgagatggacccgcgtctgattagctagttggtaaggtaacggcctaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacggtacctga

SEQ ID NO: 2381 - DNA, 490 bp, Unknown
  Ascusbbf_36375, encodes 16S rRNA
agagtttgatcatggctcaggatgaacgctggcggcgtgcttaacacatgcaagtcgaacgaagcattaggagcggatctttcgggtgaagcaccttttgacttagtggcggacgggtgagtaacgcgtgggcaacctgcccttaaccgggggacaacagttggaaacggctgctaataccgcataagcgcacggtatcgcatgatacagtgtgaaaaattccggtggttaaggatgggcccgcgttggattaggtagttggtgaggtaacggcccaccaagccgacgatccatagccgacctgagagggtgaccggccacattgggactgagacacggcccagactcctacgggaggcagcagtggggaatattgcacaatgggggaaaccctgatgcagcgacgccgcgtgagtgaagaagtatttcggtatgtaaagctctatcagcagggaagaagatgacggtacctgcacaagaagccccggct

SEQ ID NO: 2382 - DNA, 490 bp, Unknown
  Ascusbbf_76409, encodes 16S rRNA
agagtttgatcatggctcaggatgaacgctggcggcgtgcttaacacatgcaagtcgaacggagtaccctagaaagaggcttcggccaatggaaaggaatacttagtggcggacgggtgagtaacgcgtgagcaacctgcctgggagtggggaataacacatcgaaagatgtgctaataccgcataatgcagagagatcgcatggtttttctgccaaagatttatcgctttcagatggactcgcgtctgattagctagttggtgaggtaacggctcaccaaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttctttgacaggggacgaagaacgtgacggtaccctgaaaacaagccacg

SEQ ID NO: 2383 - DNA, 490 bp, Unknown
  Ascusbbf_116666, encodes 16S rRNA
agagtttgatcctggctcaggatgaacgctggcggcgtgcttaacacatgcaagtcgaacggggaaacaaaaaggaagttttcggatggaattattgttttctagtggcggacgggtgagtaacgcgtaaacaatctgccttagagagggggataacagatagaaatatctgctaataccgcataagaccacaagcaggcatctgcaaggggtaaaaggagcaatccgctttaagatgagtttgcgtactattagctagttggtgaggtaatggcccaccaaggcgacgatggttagccggcctgagagggtgaacggccacattggaactgagatacggtccagactcctacgggaggcagcagtgaggaatattgggcaatgggcgaaagcctgacccagcaacgccgcgtgaaggaagaaggttttaggattgtaaacttctgttgtaagggaaaaagaaagtgatggtaccttacgaggaagctac

SEQ ID NO: 2384 - DNA, 490 bp, Unknown
  Ascusbbf_11478, encodes 16S rRNA
agagtttgatcatggctcaggacgaacgctggcggcgtgcttaacacatgcaagtcgtacgatgacccggctcttcggagctggtgattagtggcgaacgggtgagtaacacgtgggtgacctgccctgcactctgggataagcccgggaaactgggtctaatactggatacgaccagtggccgcatggtctgctggtggaaagcccttcggggtggtgtgggatgggcccgcggcctatcagcttgttggtggggtgatggcctaccaaggcgacgacgggtagccggcctgagagggtgtccggccacactgggactgagacacggcccagactcctacgggaggcagcagtgggaatcttgcacaatgggcgaaagcctgatgcagcgacgccgcgtgagggatgacggccttcgggttgtaaacctctttcggcagggaacaagcctgggggttttcttctgggtgagggtacctgcggaagaagc

SEQ ID NO: 2385 - DNA, 490 bp, Unknown
  Ascusbbf_38997, encodes 16S rRNA
agagtttgatcctggctcaggatgaacgctagcgacaggcctaacacatgcaagtcgaggggcagcatggtcaaagcttgctttgactgatggcgaccggcgcacgggtgcgtaacaggtgtgcaatctgtccataatcggggaatagcccggcgaaagccgaattaaagctccatgtgccatcataccgcatggtaagatggtgaaacgttacggattatggatgagcacgcttctgattaggtagttggtgaggtaacggcccaccaagccgacgatcagtaggggttctgagaggaaggtcccccacattggaactgagacacggtccaaactcctacgggaggcagcagtgaggaatattggtcaatggacgagagtctgaaccagccaagtcgcgtgaaggaagacggttctatggattgtaaacttcttttgtccgagggtaaagttaggtacgtgtacctattggaaagtatcggacgaataa

SEQ ID NO: 2386 - DNA, 490 bp, Unknown
  Ascusbbf_41419, encodes 16S rRNA
agagtttgatcctggctcaggacgaacgctggcggcgtgcttaacacatgcaagtcgaacgaagctgctttggagcttgctctagagtagacttagtggcggacggctgagtaacgcgtgagaaatctgccgtagtcagggggataacagatagaaatatctgctaataccgcataagaccacagtgccgcatggcataggggtaaaagagttatggatcggactacgatgatctcgcgtcctattagctagttggtgaggtaacggcccaccaaggcaacgataggtatccgacctgagagggtgatcggacagactggaactgagaaacggaccagactcctacgggaggcagcagtggggaatattgggcaatggaggcaactctgacccagcaacgccgcgtgaaggatgaaggtcttcggattgtaaacttttgatatagaggaagaagatagtgacggtactctataagaaagccccggctaac

SEQ ID NO: 2387 - DNA, 490 bp, Unknown
  Ascusbbf_1878396, encodes 16S rRNA
agagtttgatcctggctcaggatgaacgctggcggcgtgcctaatacatgcaagtcgaacggcagcagcaatgctgtagtggcgaacgggtgagtaacacgttggtgacctgccccaaagatgggaatatcacctggaaacgggtggcaaaaccgaataagctcgagggagttagagagccttgagtaaaagagagatctactttgggaggggcctgcggcccatcagttagttggtgagggtaacggcccaccaagacggcgacgggtaggggacctgagagggtggtcccccacaatggaactgaaacacggtccatacacctgcgggtggcggcagtagggaatattgcttaatgggcgaaagcctgaagcagcaacgccgcgtggacgaaggaggccttcgggtcgtaaagtccttttataggggacgaattaagacggtaccttatgaataagctccggctaactacgtgccagcagccgcggta

SEQ ID NO: 2388 - DNA, 490 bp, Unknown
  Ascusbbf_829644, encodes 16S rRNA
agagtttgatcctggctcaggatgaacgctggcggcgtgcctaacacatgcaagtcgagcggggatctaccgaatgagagcttcggcaggattttggtagattctagcggcggacgggcgagtaacgcgtgagcaatctgtctcagacagggggaaaacgcagcgaaagttgcactaataccgcatgagaccacagagccacatggctgaggggtcaaaggagcaatccggtctgaggtgagctcgcgtcctattaggtagttggtgaggtaacggcccaccaagccgacggtaggtagccgacctgagagggtgatcggccacactggaactgagacacggtccagactcctacgggaggcagcagtggggaatattgggcaatgggcgaaagcctgacccagcaacgccgcgtgagtgaagaaggccttcgggttgtaaatctctgtcctaagagaagaggggaagacggtatcttaggaggaagccc

SEQ ID NO: 2389 - DNA, 482 bp, Unknown
  Ascusbbf_3869, encodes 16S rRNA
agagtttgatcatggctcagaacgaacgctggcggcacgcctaacacatgcaagtcggacggtatggatagcttgctattcatatagtggcggactggtgagtaatatgtaggaatctgcccataggttagggatagcatcgggaaactggtggtaatacctgataagctggagacaggaaaggagcaattcgccgatggaggagcctatatctgattagatagttggtggtgtaagagaccaccaagtcgatgatcggtagctgttctgagaggaagatcagccacattgggactgagatacggcccaaactcctacgggaggcagcagtggggaatattggacaatggaggaaactctgatccagcgatgccgcgtgagtgaagaaggccttcgggttgtaaagctcttttgtcagggacgatgatgacggtacctgaagaataagcaccggctaactctgtgccagcagccgcggtaat

SEQ ID NO: 2390 - DNA, 490 bp, Unknown
  Ascusbbf_13685, encodes 16S rRNA
agagtttgatcatggctcaggatgaacgctagctacaggcttaacacatgcaagtcgaggggtaacattggcggagcttgctctgccagatgacgaccggcgcacgggtgagtaacgcgtatccaacctgcccatgggtcagggataaactcccgaaagggagcctaatacctgatgttgtgagaagaaggcctctgattttcacgaaagacttcggtcgccgatggatggggatgcgtacgattaggcagcaggcggggtaacggcccacctggccaacgatcgttaggggttctgagaggaaggtcccccacactggtactgagacacggaccagactcctacgggaggcagcagtgaggaatattggtcaatgggcggaagcctgaaccagccaagtagcgtgcaggatgactgccctatgggttgtaaactgcttttatgcggggataaagtgagccacgcgtggcttattgcaggtaccgcatga

SEQ ID NO: 2391 - DNA, 490 bp, Unknown
  Ascusbbf_225876, encodes 16S rRNA
agagtttgatcctggctcagattgaacgctggcggcgtgcttaacacatgcaagtcgaacgcgaaagtggcttcggccacgagtagagtggcgcacgggtgagtaacgcgtggataatctgcctctgcaatcggaataacgactggaaacggtcgctaataccggatacgcttaagttttacctcttaaggaaagatgacctctatttataagttatcgtgcagagatgagtccgcgtcccattagcttgttggcggggtaacggcccaccaaggcgacgatgggtagccgatttaagaggatgatcggccacattggaactgaaacacggtccaaactcctacgggaggcagcagtggggaatattgcgcaatgggcgaaagcctgacgcagcgacgccgcgtgagggatgaaggtcttcggatcgtaaacctctgtcagaagggaaaaatgtacagtgctccaatcaacactgtattgatggtacctt

SEQ ID NO: 2392 - DNA, 490 bp, Unknown
  Ascusbbf_1647071, encodes 16S rRNA
agagtttgatcatggctcaggacgaacgctggcggcgtgcttaacacatgcaagtcgaacggaggatttatttcggtagatccttagtggcgaacgggtgagtaacgcgtgggcaatctgcccttcagatggggacaacatcccgaaaggggtgctaataccgaatacgatccttccaccgcatggcggaaggatgaaagatggcctctatatataagctatcgctgaaggatgagcctgcgtctgattagcttgttggtggggtaacggcctaccaaggcgatgatcagtagccggtctgagaggatgaacggccacattgggactgagacacggcccaaactcctacgggaggcagcagtggggaatattccgcaatggacgaaagtctgacggagcaacgccgcgtgagtgatgaaggttttcggactgtaaagctctgttgtttgggacgaaagtgcctgttgcgaacagttacgggtattgacgg

SEQ ID NO: 2393 - DNA, 490 bp, Unknown
  Ascusbbf_4412, encodes 16S rRNA
agagtttgatcatggctcaggatgaacgctggcggcgtgcttaacacatgcaagtcgaacggggcacccttgacagaggcttcggccaattgataggaatgcctagtggcggacgggtgagtaacgcgtgagtaacctgcctgggagtggggaataacacatcgaaaggtgtgctaataccgcataacacagtaggatcgcatggttttactgtcaaagatttatcgctttcagatggactcgcgtctgattagttagttggcggggtaacggcccaccaagacgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttctttgacagaggacgaagaaagtgacggtactctgaaaacaagccacg

SEQ ID NO: 2394 - DNA, 490 bp, Unknown
  Ascusbbf_16287, encodes 16S rRNA
agagtttgatcatggctcaggatgaacgctagcggcaggcttaacacatgcaagtcgaggggcagcgcgaggtagcaatactttggcggcgaccggcggaagggtgcgtaacgcgtgagcaacatgcccgtatgagggggatagtcattggaaacgatgcgtaataccccgtaacaacagaggcggcatcgcctttgtttgaaagatttatcgcatacggattggctcgcgtgacattagctagttggcggggtaacggcccaccaaggcgacgatgtctaggggaactgagaggttggtcccccacactggaactgagacacggtccagactcctacgggaggcagcagtgaggaatattggtcaatgggcggaagcctgaaccagccatgccgcgtgaaggactaaggccctatgggtcgtaaacttcttttgacggggagcaataagggcgtcgcgcacgtccgatgagagtactcgtcgaataagc

SEQ ID NO: 2395 - DNA, 490 bp, Unknown
  Ascusbbf_10682, encodes 16S rRNA
agagtttgatcatggctcaggattaacgctggcggcatgcctaatacatgcaagtcgaatggaagagcttgcttttccatggcgaacgggtgagtaacacgtaggtaacctaccttaaggacgaggataacctttggaaacgaaggataatactggataggacatcataaaacacatgtttagatgtttaaaggagcaatccaccataagaggggcctgcggcgcattagctagttggtgagataaaggcccaccaaggcgatgatgcgtagccggactgagaggttgaacggccacaatgggactgagaacggcccatactcctacgggaggcagcagtagggaattttcggcaatggacaaaagtctgaccgagcaatgccgcgtgatcgaagaagtatttcggtatgtaaagatcttttatcagggaagaaaagacagattgactgaacctgatgaataagctccggctaactacgtgccagcagcc

SEQ ID NO: 2396 - DNA, 490 bp, Unknown
  Ascusbbf_33654, encodes 16S rRNA
agagtttgatcatggctcaggataaacgctggcggcgtgcctaatacatgcaagtcgaacggacatagcttgctatgtcagtggcgaacgggtgagtaatacataagcaacctgcctacagggaccgggataacacttggaaacgagcgctaataccggataggcaagggaagggcatcctacccttgttaaagttgagagacacaagtagatgggcttatggcgcattagctggttggtagaggtaacggcctaccaaggcgatgatgcgtagccggcctgagagggtgaacggccacattgggactgagacacggcccagactcctacgggaggcagcagtagggaattttcggcaatggaggaaactctgaccgagcaacgccgcgtgagtgaagacggtcttcggattgtaaagctctgttgtaagggaagaaactatggattgataatccatactgacggtaccttaccagaaagccacggctaa

SEQ ID NO: 2397 - DNA, 490 bp, Unknown
  Ascusbbf_1562881, encodes 16S rRNA
agagtttgatcctggctcaggatgaacgctggcggcgtgcttaacacatgcaagtcgaacggagactgcttacgaagctgaagtagcttgctatggaggtggagtgagtattcttagtggcggacgggtgagtaacgcgtgggtaacctacctcatacaggggaatagcagttggaaacgactgataaaaccgcataaaacggcagcagggcatcctgcaaccgtcaaatatttataggtatgagatgggcccgcgtctgattaggcagttggtgaggtaacggcccaccaaacctacgatcagtagccggcctgagagggtgaacggccacattgggactgagacacggcccaaactcctacgggaggcagcagtggggaatattggacaatgggggaaaccctgatccagcgacgccgcgtgagtgaagaagcatttcggtatgtaaagctctatcagcagggaagatgatgacggtacctgactaag

SEQ ID NO: 2398 - DNA, 490 bp, Unknown
  Ascusbbf_730503, encodes 16S rRNA
agagtttgatcatggctcaggatgaacgctggcggcatgcctaagacatgcaagtcgtacgaggtggcccgttgagttctgtgcttgcacaaaacaattcggatccccacctagtggcgaaagggtgagtaacacgtgggttatctacctcagagactgggataactactggaaacggtagctaataccggatgatatatagaacgatacgttgttctatagtaaaaggagcctttaaagcttcactttgagatgagcctgcgacgtattagctagttggtaaggtaatggcttaccaaggcgacgatgcgtagccgacctgagagggtgatcggccacactgggactgagacacggcccagactcctacgggagacagcagttagggatattcgtcaatggaggaaactctgaacgagcaatgccgcgtgagtgatgacagttctttggattgtaaaactctgttgttagggaagaacgacctatatag

SEQ ID NO: 2399 - DNA, 490 bp, Unknown
  Ascusbbf_124860, encodes 16S rRNA
agagtttgatcctggctcagattgaacgctggcggtatgcttaacacatgcaagtcgaacggcagcattttctagcttgctagagagatggcgagtggcggacgggtgagtaacgcgtaggaatatgccttaaagagggggacaacttggggaaactcaagctaataccgcataatttctttggaaaaaagctggggaccttcgggcctggcgctttaagattagcctgcgtacgattagctagttggtagggtaaaggcctaccaaggcgacgatcgttagctggtctgagaggatgaccagccacactggaactgagacacggtccagactcctacgggaggcagcagtggggaatattggacaatggggggaaccctgatccagcaataccgcgtgtgtgaagaaggcctgagggttgtaaagcactttcagtggggaggagggttgccaggttaagagccgggtgactggacgttacccacagaag

SEQ ID NO: 2400 - DNA, 490 bp, Unknown
  Ascusbbf_2321, encodes 16S rRNA
agagtttgatcatggctcagaacgaacgctggcggcgcgtcttaagcatgcaagtcgagcggtaagttgtagcttgctacaacctagagcggcggactggtgagtaacgcgtgggtgacgtacccttttgacggggatagcctgtggaaacacagggtaataccggataagttcggatgtgtcagaggcattcgaagaaaggttcttttgaaccgcgaaaggagcggcccgcgtgctattagttagttggcggggtaacggcccaccaagacgacgatagctacccggcctaagagggtgaacgggcacattgggactgagatacggcccagactcctacgggaggcagcagctaagaatattccgcaatggacgaaagtctgacggagcgacgccgcgtggatgatgaaggccggaaggttgtaaaatccttttggaagcgaggaataagtggaatgagagaaacgttccatggtgacggtagcttctg

SEQ ID NO: 2401 - DNA, 490 bp, Unknown
  Ascusbbf_10450, encodes 16S rRNA
agagtttgatcatggctcagattgaacgctggcggcatgccttacacatgcaagtcgaacggcagcgggggtgcttgcacctgccggcgagtggcgaacgggtgagtaatgcatcggaacgtacccagtcgtgggggataacgcagcgaaagctgtgctaataccgcatacgtcctgagggagaaagcaggggatcttcggaccttgtgcgattggagcggccgatgtcagattagctagttggtgaggtaaaagctcaccaaggcgacgatctgtagctggtctgagaggatgatcagccacactggaactgagacacggtccagactcctacgggaggcagcagtggggaattttggacaatgggggcaaccctgatccagccatgccgcgtgagtgaagaaggccttcgggttgtaaagctctttcggccgggaagaaatcgtgcaggctaataccctgtatggatgacggtaccggaataagaagc

SEQ ID NO: 2402 - DNA, 490 bp, Unknown
  Ascusbbf_16862, encodes 16S rRNA
agagtttgatcatggctcaggatgaacgctagctacaggcttaacacatgcaagtcgaggggcatcatggtggtagcttgctaccgctgatggcgaccggcgcacgggtgagtaacacgtatccaacctgccttgagctcagggatagccctctgaaaggaggattaatacctgatgtggttgttggctgacatcagctttcaattaaagatttatcggctcatgatggggatgcgtctgattagcttgttggcggggtaacggcccaccaaggcgacgatcagtaggggttctgagaggaaggtcccccacataggaactgagacacggtcctaactcctacgggaggcagcagtgaggaatattggtcaatggtcgagagactgaaccagccaagtagcgtgaaggatgactgccctacgggttgtaaacttcttttatgcgggaataaagtgtggcacgtgtgccattttgtatgtaccgcatgaat

SEQ ID NO: 2403 - DNA, 490 bp, Unknown
  Ascusbbf_26051, encodes 16S rRNA
agagtttgatcatggctcaggacgaacgctggcggcgtgcctaatacatgcaagtcgagcgagccgaactaacagatttgcttcggcaatgacgctaggaaagcgagcggcggatgggtgagtaacacgtgggtaacctgcccttaagcctgggataccacttggaaacaggtgctaataccggataacaactagagctgcatggttctagtttgaaaggcggcttcggctgtcacttaaggatggacccgcggtgcattagctagttggtaaggtagcggcttaccaaggcgacgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttattggtgaagaaggatagaggtagtaactggcctt

SEQ ID NO: 2404 - DNA, 490 bp, Unknown
  Ascusbbf_36784, encodes 16S rRNA
agagtttgatcatggctcaggatgaacgctggcggcgtgcttaacacatgcaagtcgaacggaacatttcgcccgatgattgaagtagcttgctacggattgaatcaactgaaatgtttagtggcggacgggtgagtaacgcgtgggtaacctaccttacacagggggataacagttagaaatgactgctaataccgcataagcgcacagtaccgcatggtacggtgtgaaaaactccggtggtgtaagatggacccgcgtctgattagctagttggtgaggtaacggcccaccaaggcgacgatcagtagccggcctgagagggtgaacggccacattggaactgagacacggtccaaactcctacgggaggcagcagtggggaatattgcacaatgggggaaaccctgatgcagcgacgccgcgtgagtgatgaagtatttcggtatgtaaagctctatcagcagggaagatcatgacggtacctgac

SEQ ID NO: 2405 - DNA, 490 bp, Unknown
  Ascusbbf_23855, encodes 16S rRNA
agagtttgatcctggctcaggacgaacgctggcggcacgcttaacacatgcaagtcgaacggagtttttgagagcttgcttttaaaaacttagtggcggacgggtgagtaacacgtgagcaatctgcctttcagagggggatagcagttggaaacgactgataataccgcataatatatacggaccgcatgatctgtatatcaaagatttatcgctgaaagatgagctcgcgtctgattagatagttggtgaggtaacggctcaccaagtcgacgatcagtagccggactgagaggttgaacggccacattgggactgagacacggcccagactcctacgggaggcagcagtggggaatattgcacaatgggcgcaagcctgatgcagcgatgccgcgtgagggaagaaggttttaggattgtaaacctctgtctttggggacgataatgacggtacccaaggaggaagctccggctaactacgtgccag

SEQ ID NO: 2406 - DNA, 490 bp, Unknown
  Ascusbbf_110291, encodes 16S rRNA
agagtttgatcctggctcaggatgaacgctggcggcgtgcttaacacatgcaagtcgaacggaactgcttttgaagattctcttcggagatgattcagttgtagtttagtggcggacgggtgagtaacgcgtgagtaacctgcccttgagagggggataacgttctgaaaagaacgctaataccgcataaaactattgaaccgcatgattcgatagtcaaaactgaggtgctcaaggatggactcgcgtccgattagctagttggtaaggtaacggcttaccaaggcgacgatcggtagccggactgagaggttgaacggccacattgggactgagacacggcccagactcctacgggaggcagcagtgggggatattgcgcaatgggggaaaccctgacgcagcaacgccgcgtggatgatgacggttttcggattgtaaagtccttttcttagggacgaataatgacggtacctaaggaataagctcc

SEQ ID NO: 2407 - DNA, 490 bp, Unknown
  Ascusbbf_150381, encodes 16S rRNA
agagtttgatcatggctcaggatgaacgctggcggcgtgcttaacacattcaagtcgaacggagtatttttgaaagcttgcttttgagaatacttagtggcggacgggtgagtaatgcatgagcaacctgcctttaagagggggataacacagagaaatctgtgctaataccgcatagaacactgagatggcatcatcatagtgggaaaggagcaatccgcttaaagatgggctcatgtctgattagatagttggcggggtaacggcccaccaaatccgcgatcagtagccggactgagaggttgaacggccacattggaactgagatacggtccagactcctacgggaggcagcagtggggaatattgggcaatgggcgaaagcctgacccagcgacgccgcgtgagggaagaaggtcttcggattgtaaacctctgttgataggaacgaaaaaatgacggtacctatcgaggaagccacggctaacta

SEQ ID NO: 2408 - DNA, 490 bp, Unknown
  Ascusbbf_1857348, encodes 16S rRNA
agagtttgatcctggctcaggatgaacgctggcggcgtgcctaacacatgcaagtcgagcggacttatgataagattcttcggatgatttttataagttagcggcggatgggtgaggaacgcgtggagaacctacccttcacagggggataacagctggaaacggctgttaataccgcatatgctcacggtggcgcatgtcacagggaggaaagctccggcagtgaaggatggctccgcgtcggattaactagttggcggggtaacggcccaccaaggtgatgatccgtagccggcctgagagggcgaccggccacattgggactgagacacggcccaaactcctacgggaggcagcagtgggggatattgcacaatgggcgcaagcctgatgcagcgacgccgcgtgatggaggaagtacttcggtatgtaaacatctatcagcagggaagaagatgacgatacctgcagaagaagccccggctaacta

SEQ ID NO: 2409 - DNA, 490 bp, Unknown
  Ascusbbf_1524245, encodes 16S rRNA
agagtttgatcctggctcaggacgaacgctggcggcgtgcctaacacatgcaagtcgagcggagacagaggaaggaaggcttcggccggaaagcttctgttttagcggcggacgggtgagtaacgcgtgagcaacctgtccttcacagggggataagataccgaaaggtgttctaataccgcataagaccacagagtcgcatgacagaggggtcaaaggagaaatccggtgaagggtgggctcgcgtccgattagatagttggtgaggtaacggcccaccaagtcaacgatcggtagccgacctgagaaggtgatcggccacattgggactgagacacggcccagactcctacgggaggcagcagtggggaatattgggcaatggggggaaccctgacccagcaacgccgcgtggaggaagaaggtcttcggatcgtaaactcctgtcctaagagacgagcaggagacggtaacttaggaggaagccccg

SEQ ID NO: 2410 - DNA, 490 bp, Unknown
  Ascusbbf_5641, encodes 16S rRNA
agagtttgatcctggctcaggatgaacgctagctacaggcttaacacatgcaagtcgaggggcagcatggtcttagcttgctaaggctgatggcgaccggcgcacgggtgagtaacacgtatccaacctgccgtctactcttggccagccttctgaaaggaagattaatccaggatgggatcatgagttcacatgtccgcatgattaaaggtattttccggtagacgatggggatgcgttccattagatagtaggcggggtaacggcccacctagtcaacgatggataggggttctgagaggaaggtcccccacattggaactgagacacggtccaaactcctacgggaggcagcagtgaggaatattggtcaatgggcgatggcctgaaccagccaagtagcgtgaaggatgactgccctatgggttgtaaacttcttttataaaggaataaagtcgggtatgcatacccgtttgcatgtactttatga

SEQ ID NO: 2411 - DNA, 490 bp, Unknown
  Ascusbbf_18801, encodes 16S rRNA
agagtttgatcatggctcaggacgaacgctggcggcgtgcctaacacatgcaagtcgaacggagtgcttaaagcttgctttgaacacttagtggcggacgggtgagtaacgcgtggggaacctgcctttcagagggggataacgttctgaaaagaacgctaataccgcataacgtatgaccgtcgcatggcggacataccaaaggagcaatccgctgaaagatggccccgcgtccgattagatagttggcgaggtaacggctcaccaagtcgacgatcggtagccggactgagaggttgaacggccacattgggactgagacacggcccagactcctacgggaggcagcagtgggggatattgcacaatgggggaaaccctgatgcagcaacgccgcgtgagggaagaaggttttcggattgtaaacctctgtccttggtgaagataatgacggtagccgaggaggaagctccggctaactacgtgccag

SEQ ID NO: 2412 - DNA, 490 bp, Unknown
  Ascusbbf_72651, encodes 16S rRNA
agagtttgatcatggctcaggatgaacgctggcggcgtgcttaacacatgcaagtcgaacggagactgttgatgaagcggaagggcttgcccggaagtggaattgatagtcttagtggcggacgggtgagtaacgcgtgggtaacctacctcatacaggggaatagcagttggaaacgactgataaaaccgcataaaacggcagcagggcatcctgcaaccgtcaaatatttataggtatgagatgggcccgcgtctgattaggcagttggtgaggtaacggcccaccaaacctacgatcagtagccggcctgagagggtgaacggccacattgggactgagacacggcccaaactcctacgggaggcagcagtggggaatattggacaatggggggaaccctgatccagcgacgccgcgtgagtgaagaagtatttcggtatgtaaagctctatcagcagggaagatgatgacggtacctgactaagaa

SEQ ID NO: 2413 - DNA, 490 bp, Unknown
  Ascusbbf_90424, encodes 16S rRNA
agagtttgatcatggctcagattgaacgctggcggcatgctttacacatgcaagtcggacggcagcacgagtacttgtacttggtggcgagtggcgaacgggtgagtaatgcattggaacgtaccgagtagtgggggataactagtcgaaagattagctaataccgcatacgtcttgagagagaaagcaggggatcttcggaccttgcgctatttgagcggccaatgtctgattagctagttggtggggtaagggcctaccaaggcgacgatcagtagtgggtctgagaggatgatccgccacactgggactgagacacggcccagactcctacgggaggcagcagtggggaattttggacaatgggggcaaccctgatccagccatgccgcgtgtctgaagaaggccttcgggttgtaaaggacttttgtcagggaagaaaaggcgattgctaatatcagttgctgatgacggtacctgaagaataagc

SEQ ID NO: 2414 - DNA, 490 bp, Unknown
  Ascusbbf_166164, encodes 16S rRNA
agagtttgatcctggctcaggatgaacgctggcggcaggcctaatacatgcaagtcgcacgggatcgctccttcgggggcgtgagagtggcggacgggtgcgcaacgcgtatgcaaccagccccctgcaggcggatagccggtggaaacgccggataatacgccatgtttcgggtagagggcatcctttacctgagaaagcggagacgcggcgggggacgggcatgcgtcccattagctagttggcggggtgagggcccaccaaggctgtgatgggtaggggatctgagaggacggtcccccacactggcactgagacacgggccagactcctgcgggaggcagcagtaggggatattgggcaatgggcggaagcctgacccagccatgccgcgtgaggggatgaggccctacgggtcgtgaacctcttttatgcggggacaacgccccccacgagatgggggtttgagggtaccgcaggaataagcgcc

SEQ ID NO: 2415 - DNA, 490 bp, Unknown
  Ascusbbf_855758, encodes 16S rRNA
agagtttgatcatggctcaggacgaacgctggcggcatgcctaacacatgcaagtcgaacggagccaacctgatgatcccttcggggtgaattaggggaagcttagtggcggacgggtgagtaacgcgtgagtaacctgcctctgagaggggaataacgttccgaaaggaacgctaataccgcataatgtgattttatcgcatggtagagtcaccaaagatttatcgctcagagatggactcgcgtctgatttgctggttggtgaggtaacggcccaccaaggcgacgatcagtagccgagctgagaggctgatcggccacattgggactgagacacggcccagactcctacgggaggcagcagtgggggatattgcgcaatgggggaaaccctgacgcagcaatgccgcgtgaaggaagaaggtcttcggatcgtaaacttttgtctttggggacgataatgacggtacccgaggaggaagccacggct

SEQ ID NO: 2416 - DNA, 490 bp, Unknown
  Ascusbbf_316628, encodes 16S rRNA
agagtttgatcctggctcaggatgaacgctagctacaggcttaacacatgcaagtcgcggggcagcatgtatccgggcaaccgggtatgatggcgaccggcgcacgggtgcgtaacgcgtatccaacctgcccgcaagacggggacagcccggcgaaagtcggattaatccccgatgtggtgtgacgagggcatctgagtgacaccaaagggagcgatccgcttgcggatggggatgcgtacgattaggtagacggcggggtgatggcccaccgtgccgacgatcgttaggggttctgagaggaaggtcccccacactggtactgagacacggaccagactcctacgggaggcagcagtgaggaatattggtcaatgggcggatgcctgaaccagccaagtagcgtgcaggacgacggccctacgggttgtaaactgcttttatgcggggataacagggtgcacgtgtgcgcctttgcaggtaccgcatg

SEQ ID NO: 2417 - DNA, 490 bp, Unknown
  Ascusbbf_752378, encodes 16S rRNA
agagtttgatcctggctcaggacgaacgctggcggcgtgcctaatacatgcaagtcgaacgcacagacaacggaacttgttccgttagacgtgagtggcgcacgggtgagtaacacgtgggaaacctacccttcagcgggggataaccgtcggaaacgatggctaataccgcataggtctttgaaccacctggtttaaagaggaaagacggctttggctgtcactgaaggatggtcctgcggtgcattagctagttggtaaggtaacggcttaccaaggcgatgatgcatagccgacctgagagggtgatcggccacattgggactgagacacggcccaaactcctacgggaggcagcagtagggaatctgccgcaatggacgcaagtctgacggagcaacgccgcgtgtgtgaagaaggtcttcggatcgtaaagtactgttattagagaagaacaaccggtagagtaactgttactggcttgacggta

SEQ ID NO: 2418 - DNA, 490 bp, Unknown
  Ascusbbf_105076, encodes 16S rRNA
agagtttgatcatggctcagattgaacgctggcggcaggcctaacacatgcaagtcggacggtagcacagagagcttgctcttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcatcgattgacgttacccgcagaagaa

SEQ ID NO: 2419 - DNA, 490 bp, Unknown
  Ascusbbf_143232, encodes 16S rRNA
agagtttgatcatggctcaggatgaacgctggcggcgtgcctaacacatgcaagtcgaacggagatatgtggaatgcggacttgtccaaatgaaacatatgcttagtggcggacgggtgagtaacgcgtggataacctgcctttttctgggggatagcagttggaaacgactggtaataccgcatgagcttgtccctgggcatccaggggtgaggaaagatttatcgggaaaagatggatccgcgtctgattagccagttggcggggtaacggcccaccaaagcgacgatcagtagccggcctgagagggtgaacggccacattgggactgagacacggcccagactcctacgggaggcagcagtgggggatattgcacaatggggggaaccctgatgcagcgacgccgcgtgagtgaagaagtatttcggtatgtaaagctctatcagcagggaagaaagacccttcggggggatgacggtacctgact

SEQ ID NO: 2420 - DNA, 490 bp, Unknown
  Ascusbbf_1716470, encodes 16S rRNA
agagtttgatcatggctcaggatgaacgctggcggcgtgcttaacacatgcaagtcgaacgaagcactttttgaatcttcggaggaaagaagtgactgagtggcggacgggtgagtaacgcgtggggaacctgccttataccgggggatagcagttggaaacgactggtaaaaccgcataagcgcacgggtacgcatgtacctgtgtgaaaaactctggtggtataagatggacccgcgtctgattaggcagttggcggagtaacggcccaccaaaccgacgatcagtagccgacctgagagggtgaccggccaaattgggactgagacacggcccagactcctacgggaggcagcagtggggaatattgcacaatggaggaaactctgatgcagcgacgccgcgtgagtgaagaagtatttcggtatgtaaagctctttcggcagggaagataatgacggtacctgcagaagaagcaccggctaaatac

SEQ ID NO: 2421 - DNA, 490 bp, Unknown
  Ascusbbf_138166, encodes 16S rRNA
agagtttgatcatggctcaggatgaacgctggcggcgtgcttaacacatgcaagtcgaacgattaaaccggcttcggccggatatagagtggcgaacgggtgagtaacacgtgatcaacctacctcgtacttcgggatagcctcgtgaaaacgggattaataccggatactccgattgaaccgcatgattctttcgggaaagcctttacggtacgagatgggatcgcggcccattagatagttggtggggtaacggcctaccaagtcgatgatgggtagccgggttgagagaccgaccggccacattgggactgagatacggcccagactcctacgggaggcagcagtggggaatattgcgcaatgggggaaaccctgacgcagcaacgccgcgtgcgggatgaaggccttcgggttgtaaaccgctttcagtagggacgaataaatgacggtacctacacaagaagccccggctaattacgtgccagca

SEQ ID NO: 2422 - DNA, 472 bp, Unknown
  Ascusbbf_155287, encodes 16S rRNA
agagtttgatcatggctcagaacgaacgctggcggcaggcctaacacatgcaagtcgaacgctcgtagcaatacgggagtggcagacgggtgagtaacgcgtgggaacataccctttggttcggaataactcatggaaacgtgagctaataccggatacggcagagatgcgaaagatttatcgccgaaggattggcccgcgttcgattagctagttggtgaggtaatggctcaccaaggcgacgatcgatagctggtctgagaggatgaccagccacactgggactgagacacggcccagactcctacgggaggcagcagtggggaatattggacaatgggcgcaagcctgatccagccatgccgcgtgagtgatgacggccttagggttgtaaagctctttcgccagggacgataatgacggtacctggataagaagccccggctaacttcgtgccagcagccgcggtaat

SEQ ID NO: 2423 - DNA, 490 bp, Unknown
  Ascusbbf_1622711, encodes 16S rRNA
agagtttgatcatggttcagaacgaacgctggcggcgcgtcttaagcatgcaagtcggacggcatgaggaatgcttgcattcctcagagagtggcggactggtgagtaacacgtgggtgacctacccttgagatggggatagccgttagaaatagcggataataccgaatacgctctacgaactgtggtttgtagaggaaatcaggctacggcctggctcaaggatgggcccgcgtcccattagctagttggtgaggtaacggcccaccaaggcgacgatgggtatccggcctgagagggtgtacggaaacattgggactgagatacggcccaaactcctacgggaggcagcagctaagaatattccgcaatggacgaaagtctgacggagcgacgccgcgtggatgaagaaggccgaaaggttgtaaagtccttttgctgatgaagaataagcgtggtagggaatgaccgcgtgatgacattagtcggt

SEQ ID NO: 2424 - DNA, 490 bp, Unknown
  Ascusbbf_303410, encodes 16S rRNA
agagtttgatcctggctcaggatgaacgctggcggcgtgcctaatacatgcaagtcgagcggcagcatgcttctcaccgaggttcgaagtaatatctgataaatgatatctgatattcacttggagctttagtgagaagtgatggcgagcggcggacgggtgagtaacacgtgggaatctaccccaaactgagggataagcatcggaaacggtgtctaataccgcatatggtcttcggattaaagcttcggcggtttgggaagagcccgcgcaagattagctagttggtaaggtaatggcttaccaaggcgacgatctttagctggtttgagaggatgatcagccacactggaactgagacacggtccagactcctacgggaggcagcagtaaggaattttccacaatgggggcaaccctgatggagcaacgccgcgtgcaggatgaatgccttcgggttgtaaactgcttttatatgcgaagaatatga

SEQ ID NO: 2425 - DNA, 490 bp, Unknown
  Ascusbbf_41581, encodes 16S rRNA
agagtttgatcatggctcaggatgaacgctggcggcgtgcctaatacatgcaagtcgaacgagggtgcttgcaccctagtggcgaacgggtgagtaacacgtaggtaacctgcccttaagcttgggatacccagaggaaactttggctaataccggataacaacagatgaggcatctcaactgcttgaaaggccctttacggggtcacttaaggatggacctgcggcgcattagctagttggtgagataacagcccaccaaggcgaggatgcgtagccgaactgagaggttgatcggccacattggaactgagacacggtccaaactcctacgggaggcagcagtaaggagttttcggcaatgggggaaaccctgaccgagcaacgccgcgtgagtgatgacggccctatgggttgtaaagctcttttattagagacgaatggtgagattaggaaatgaatctcacttgactgtatcttttgaataagcc

SEQ ID NO: 2426 - DNA, 490 bp, Unknown
  Ascusbbf_17829, encodes 16S rRNA
agagtttgatcctggctcaggacgaacgctggcggcgtgcctaacacatgcaagtcgaacggactgattctcttcggagatgaaagtcagtggcggacgggtgagtaacgcgtgagtaacctgccttacagagggggataacgtttggaaacgaacgctaataccgcataacgtgcagatgtcgcctggcatcagtaccaaaggagcaatccgctgtaagatggactcgcgtccgattagatagttggcggggtaacggcccaccaagtcgacgatcggtagccggactgagaggttgaacggccacattgggactgagacacggcccagactcctacgggaggcagcagtgagggatattgcacaatgggcgaaagcctgatgcagcaacgccgcgtgagggaagacggttttcggattgtaaacctctgttctcagtgaagataatgacattagctgaggagaaagccacggctaactacgtgccagc

SEQ ID NO: 2427 - DNA, 490 bp, Unknown
  Ascusbbf_205626, encodes 16S rRNA
agagtttgatcctggctcaggacgaacgctggcggcgtgcctaacacatgcaagtcgagcggagacacgggacttcggttctgtgtttcagcggcggacgggtgagtaacgcgtgagcaatctgtcccagtcaccgggataacaactggaaacagttgctaataccgggcgagaccacagcaccgcatggtgcaggggtaaaagggataccggattggggtgagctcgcgtcccattaggtagttggtgaggtaacggcccaccaagccgacgatgggtagccgacctgagagggtgatcggccacactggaactgagacacggtccagactcctacgggaggcagcagtgggaatattgggcaatgggcgaaagcctgacccagcaacgccgcgtgagggaagaaggttttcggattgtaaacctctgtccttggtgacgaaggaagtgacggtagccaaggaggaagccccggctaactacgtgccag

SEQ ID NO: 2428 - DNA, 490 bp, Unknown
  Ascusbbf_132485, encodes 16S rRNA
agagtttgatcatggctcaggatgaacgctagcgggaggcctaacacatgcaagccgagcggtatttatagcttgctatagagagagcggcgcacgggtgcgtaacgcgtatggaacttgccctttagaatgggatagcccggagaaattcggattaataccgtataatatatgataaggcatcttattgtattgaaagatttattgctaaaggatagtcatgcgttagattagttagttggtaaggtaacggcttaccaagacgatgatctataggggtcctgagagggagatcccccacactggtactgagacacggaccagactcctacgggaggcagcagtgaggaatattggacaatgggtggaagcctgatccagccatcccgcgtgtaggaagactgccttatgggttgtaaactacttttatctggggataaacctactctcgtgagagtagctgaaggtaccagaagaataagcaccggct

SEQ ID NO: 2429 - DNA, 490 bp, Unknown
  Ascusbbf_150430, encodes 16S rRNA
agagtttgatcctggctcagaacgaacgctggcggcgcgcctaacacatgcaagtcggacgcactcgggtcttcgggcccggatgagtggcggacgggtgagtaacacgtgggaacctgccctggggtctgggatagctgcgggaaactgcaggtaacaccggatgcgccctttcccgagagggggaggggaaagtttacgccctgggatgggcccgcgtcggattaggtagttggtgaggtagtggctcaccaagcctgcgatccgtagccggtctgagaggatgatcggccacactgggactgagacacggcccagactcctacgggaggcagcagtggggaatcttggacaatgggggcaaccctgatccagcgacgccgcgtgggtgatgaaggccttcgggtcgtaaagcccttttgccggggaagatgatgacggtacccggagaagaagcaccggctaactctgtgccagcagccgcggtaat

SEQ ID NO: 2430 - DNA, 490 bp, Unknown
  Ascusbbf_192087, encodes 16S rRNA
agagtttgatcctggctcaggatgaacgctggcggcgtgcttaatacatgcaagtcgaacggacgccttgagtagcttgctacaagaggtagtgcgtggcgaacgggtgagtaatacataggcaatctaccccggtgagcgggataaccaagggaaactctggataataccgcataggtaatcggaaggcatcttctgattattaaagtcgcgtttgcgacactccgggatgagcttatggcgcattagttagttggtgaggtaacggcccaccaagaccgtgatgcgtagccggcctgagagggtgaacggccacattgggactgagacacggcccagactcctacgggaggcagcagtaaggaattttcggcaatggacgaaagtctgaccgagcaacgccgcgtgagtgatgaaggtcttcggatcgtaaagctctgttgtaaaggaagaactgatatcggaggaaatgccggtatcttgacggtac

SEQ ID NO: 2431 - DNA, 490 bp, Unknown
  Ascusbbf_5948, encodes 16S rRNA
agagtttgatcatggctcaggatgaacgctggcggcgtgcttaacacatgcaagtcgaacgaatttcttaccgatcgcgacttcggtcaagagaggtttgaagtgagtggcggacgggtgagtaacgcgtgggtaacctgccttacaccgggggataacagagggaaacttctgctaataccgcataagaccacggtaccgcatggtacagaggtaaaagttccggcgatgtaagatggacccgcgtctgattagccagttggcggggtaacggcccaccaaagcgacgatcagtagccgacctgagagggtgatcggccacattgggactgagacacggcccaaactcctacgggaggcagcagtggggaatattgggcaatgggcgcaagcctgacccagcgacgccgcgtgagtgaagaagtatttcggtatgtaaagctctttaagcagggaagataatgacggtacctgcagaataagcaccggc

SEQ ID NO: 2432 - DNA, 490 bp, Unknown
  Ascusbbf_18488, encodes 16S rRNA
agagtttgatcatggctcaggatgaacgctagcggcaggcctaacacatgcaagtcgaggggcagcgcggggtagcaataccctggcggcgaccggcggatgggtgcgtaacgcgtatgcaacctgcctccgagagggggataacccgtggaaacgcggactaataccccgtatgcgcacgccgtcgcatggcggagtgcggaaagattgatcgctcggagatgggcatgcgtggcattaggtagttggcggggcaacggcccaccaagccatcgatgcctaggggagctgagaggctaatcccccacactggtactgagacacggaccagactcctacgggaggcagcagtgaggaatattggtcaatggagggaactctgaaccagccatgccgcgtgagggaagacggccctacgggttgtaaacctcttttagccgggagcaataaggcgcgtgcgcgcgtcgacgagagtaccggcggaataagc

SEQ ID NO: 2433 - DNA, 490 bp, Unknown
  Ascusbbf_35492, encodes 16S rRNA
agagtttgatcatggctcaggatgaacgctggcggcgtgcttaacacatgcaagtcgaacgaggaattaccgatgaagttttcggatggatttggtttttccgagtggcggacgggtgagtaacgcgtgggtaacctgccttacactgggggacaacagagagaaatttctgctaataccgcataacccgctaggggcgcatgccccggacggaaaagatttatcggtgtaagatggacccgcgtctgattagcttgttggcggggtaacggcccaccaaggcgacgatcagtagccgaactgagaggttgaccggccacattgggactgagacacggcccagactcctacgggaggcagcagtggggaatattgcacaatgggggaaaccctgatgcagcaacgccgcgtgagtgatgaagtatttcggtatgtaaagctctatcagcagggaagataatgacggtacctgactaagaagccccggcta

SEQ ID NO: 2434 - DNA, 490 bp, Unknown
  Ascusbbf_148924, encodes 16S rRNA
agagtttgatcatggctcaggatgaacgctggcggcgtgcctaacacatgcaagtcgaacggagatacgcggaatgcggattcgtccaaatgaaacgtatacttagtggcggacgggtgagtaacgcgtggataacctgcctttttccgggggatagcagttggaaacgactggtaataccgcataagcttcctttgaggcatctcagagggaggaaagatttatcgggagaagatggatccgcgtctgattagccagttggcggggtaacggcccaccaaagcaacgatcagtagccggcctgagagggtgaacggccacattgggactgagacacggcccagactcctacgggaggcagcagtgggggatattgcacaatggggggaaccctgatgcagcgacgccgcgtgagtgaagaagtatttcggtatgtaaagctctatcagcagggaagaaaggcccattatgggagatgacggtacctgac

SEQ ID NO: 2435 - DNA, 490 bp, Unknown
  Ascusbbf_111838, encodes 16S rRNA
agagtttgatcatggctcaggatgaacgctagctacaggcttaacacatgcaagtcgaggggcatcatggggtttgcttgcaagccctgatggcgaccggcgcacgggtgagtaacgcgtatccaacctgcccccgagtagggaacagcccggcgaaagtcggattaatgccctatgtatcccatgacggcatcagaatgggatgaaagatttatcgcttggggatggggatgcgtaggattagcttgcaggcggggtaacggcccacctgggcatcgatccttaggggttctgagaggaaggtcccccacactggtactgagacacggaccagactcctacgggaggcagcagtgaggaatattggtcaatgggcgtgagcctgaaccagccaagtagcgtgcaggatgacggccctacgggttgtaaactgcttttatgcgtggataaagtggcctacgtgtaggctattgcaggtatcgcatgaata

SEQ ID NO: 2436 - DNA, 490 bp, Unknown
  Ascusbbf_136732, encodes 16S rRNA
agagtttgatcctggctcaggatgaacgctggcggcgtgcataacacattcaagtcgaacgaagcattaagacggaagccttcgggtggaagatttaatgacttagtggcggacgggtgagtaacgcgtgagcaaccttcctgcctgtgagggataacacagggaaacttgtgctaataccgcataaagcatttgagtcgcatggtttaggtgccaaagatttattgcaggcagatgggctcgcgtctgattagatagtaggtgaggtaacggcccacctagtcgacgatcagtagccggactgagaggttgaacggccacattggaactgagagacggtccagactcctacgggaggcagcagtggggaatattgggcaatgggcgaaagcctgacccagcgacgccgcgtgagggaagaaggtcttcggattgtaaacctctttcagcaaggaagaagaaagtgacggtacttgcagaagaagccacg

SEQ ID NO: 2437 - DNA, 490 bp, Unknown
  Ascusbbf_344779, encodes 16S rRNA
agagtttgatcatggctcaggatgaacgctggcggcatgcctaagacatgcaagtcgaacggagtgacccattgaagttggagtgcttgcacaaagacggatttggattttcactcagtggcagacgggtgagtaacgcgtgggtaatctacctcgaagactgggataacttctggaaacggatgctaataccggataattcatatttagataactagatatgctaaaaggggcttcggcctcacttcgagatgagcttgcgttgtattagctagttggtggggtaatggcctaccaaggcaacgatgcatatccgagctgagaggctgatcggacacattgggactgagacacggcccagactcctacgggagacagcagttaggaatattcgtcaatgggggaaaccctgaacgagcaatgccgcgtgaatgatgacaatcctctggattgtaaaattctgttgtaaaggaagaaaccttatcatagg

SEQ ID NO: 2438 - DNA, 490 bp, Unknown
  Ascusbbf_331010, encodes 16S rRNA
agagtttgatcatggctcagattgaacgctggcggcatgccttacacatgcaagtcgaacggcagcacgggggcaaccctggtggcgagtggcgaacgggtgagtaatgcatcggaacgtgcccggtagtgggggatagcccggcgaaagccggattaataccgcatacgtactgaggtagaaagcggggaccttcgggcctcgcgctatcggagcggccgatgtcggattagctagttggtggggtaaaggcctaccaaggcgacgatccgtacctggtctgagaggacgaccaggcacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaatctcctgggttaatacctcggggggatgacggtaccggaagaataagcacc

SEQ ID NO: 2439 - DNA, 490 bp, Unknown
  Ascusbbf_203157, encodes 16S rRNA
agagtttgatcatggctcaggatgaacgctggcggcgtgcctaacacatgcaagtcgaacgaagcatcgcgcccgaggaaatggagtgcttgcacgagatggaatcaattgtgatgacttagtggcggacgggtgagtaacgcgtgggtaacctaccctatacagggggataacagttagaaatgactgctaataccgcataagcgcacactgttgcatgacagagtgtgaaaagccgagacggtataggatggacccgcgtctgattagccagttggcagggtaacggcctaccaaagcaacgatcagtagccggcctgagagggtgaacggccacattgggactgagacacggcccaaactcctacgggaggcagcagtgggggatattgcacaatgggggaaaccctgatgcagcgacgccgcgtgagtgaagaagtatttcggtatgtaaagctctatcagcagggaagaaaatgacggtacctga

SEQ ID NO: 2440 - DNA, 490 bp, Unknown
  Ascusbbf_292642, encodes 16S rRNA
agagtttgatcctggctcaggatgaacgctagcggcaggcctaacacatgcaagtcgaggggtataaatagcttgctattttgagaccggcggatgggtgcgtaacgcgtatgcaatctaccttatacattgggatagcccggagaaattcggattaataccttatagtatattaaagtggcatcattttaatattaaagatttatcggtataagatgagcatgcgtcccattagttagttggtgtggtaacggcataccaagactatgatgggtcggggtcctgagagggagatcccccacactggtactgagacacggaccagactcctacgggaggcagcagtgaggaatattggtcaatggacggaagtctgaaccagccatgccgcgtgcaggaagaatgtcctatggattgtaaactgcttttatacgggaagaaacgcatcgacgtgtcgatgtttgacggtaccgtaagaataaggatcggc

SEQ ID NO: 2441 - DNA, 490 bp, Unknown
  Ascusbbf_918786, encodes 16S rRNA
agagtttgatcatggctcaggatgaacgctggcggcgtgcttaatacatgcaagtcgaacgctgaagcaactagcttgctagatgtggatgagtggcgaacgggtgagtaatacataggcaacctaccctagagtgggggatagcagttggaaacgactattaataccccataggtaatttgaaggcatcttcgaattattaaagatgcgtttgcatcgctgtaggatgggcttatggtgcattagtttgttggtgaggtaacggctcaccaagactatgatgcatagccggcctgagagggtgaacggccacattgggactgagacacggcccagactcctacgggaggcagcagtaaggaattttcggcaatgggcgaaagcctgaccgagcaacgccgcgtgaatgatgaaggtcttcggatcgtaaaattctgttgtaaaggaagaactgatacatgaggaaatgcttgtatcttgacggtacttt

SEQ ID NO: 2442 - DNA, 490 bp, Unknown
  Ascusbbf_23388, encodes 16S rRNA
agagtttgatcatggctcagaacgaacgctggcggcgcgtcttaagcatgcaagtcgaacggcaagattggtgcttgcaccgatcctagagtggcggactggtgagtaacgcgtgggtgatttaccctgaagatggggatagccgatagaaatatcggataataccgaatacgcttggtgaggttagagtgcatcaaggaaaggagcttcggctccgcttcaggaaaggcccgcgtactattagctagttggtgaggtaacggcccaccaaggcaacgatagttatccggcctaagagggtgaacggacacattgggactgagatacggcccagactcctacgggaggcagcagctaagaatattccgcaatggacgaaagtctgacggagcgacgccgcgtggatgatgaaggccggaaggttgtaaaatccttttaagcacgaagaataagcaggagaggtaatgcttctgtggtgactgtactgcta

SEQ ID NO: 2443 - DNA, 490 bp, Unknown
  Ascusbbf_92233, encodes 16S rRNA
agagtttgatcctggctcaggacgaacgctggcggcgcgcctaacacatgcaagtcgaacgaagagtgtgtttttgattccttcgggatgataagcgcatttcttagtggcggacgggtgagtaacacgtgagcaacctgccttgcagtgggggataacggttggaaacgatcgctaatacctcataatatatgattgtcgcatggctttcatatcaaagttttttcgctgcaagatgggctcgcgtctgattagattgttggtggggtaatggctcaccaagtcgacgatcagtagccggactgagaggttgatcggccacattgggactgagacacggcccagactcctacgggaggcagcagtgggggatattgcacaatgggggaaaccctgatgcagcgacgccgcgtgagggaagaaggtcttcggattgtaaacctctgtctttggggacgataatgacggtacccaaggaggaagctccggc

SEQ ID NO: 2444 - DNA, 490 bp, Unknown
  Ascusbbf_67945, encodes 16S rRNA
agagtttgatcatggctcagaacgaacgctggcggcgcgttttaagcatgcaagtcgagcggtagtagcaatacgagagcggcggacgggtgagtaacacgtgggtaatctgcctttcagtcggggatagcctgtggaaacacaggataataccggatgcgatgccatgtacacatgtacgaggcaggaaaggggccaaggccccgctggaagatgagcccgcggcccattagctagatggtgaggtaaaggcccaccatggcgatgatgggtagccggcctgagagggtgaacggtcacattggaactgagacacggtccagactcctacgggaggcagcagctaagaatcttccacaatggacgaaagtctgatggagcgacgccgcgtggacgatgaaggccgtgaggttgtaaagtccttttctgaagggagaataacggggacagggaatggtcctcagatgacgtgaattcaggaataagcccc

SEQ ID NO: 2445 - DNA, 483 bp, Unknown
  Ascusbbf_39678, encodes 16S rRNA
agagtttgatcctggctcaggattaacgctggcggcatgcctaatacatgcaagtcgaatgggaagcttgctttccatggcgaacgggtgagtaacacgtaggtaacctgccttacactcgaggataaccgttggaaacgacggataatactggataggacatgaggtcgcatgaccacatgtttaaaagcaatggtgtatgaggggcctgcggtgcattagctagttggtgaggtaagggctcaccaaggcgatgatgcatagctggactgagaggttgaacagccacaatgggactgagaacggcccatactcctacgggaggcagcagtagggaattttcggcaatgggggaaaccctgaccgagcaatgccgcgtgaacgaagaagtatttcggtatgtaaagttcttttattaggaaagatagtgacggtacctaatgaataagctccggctaactacgtgccagcagccgcggtaat

SEQ ID NO: 2446 - DNA, 490 bp, Unknown
  Ascusbbf_98113, encodes 16S rRNA
agagtttgatcctggctcaggatgaacgctggcggcgtgcttaacacatgcaagtcgaacgaagttgctttaaggaaggtttcggctggaattaaagtagcttagtggcggacgggtgagtaacgtgtgggcaacctaccttgtactggggaataatcactggaaacggtgactaataccgcatacggtcttcggaaggcatcttctgaagaagaaaggatttattcggtataagatgggcccgcatctgattagctagttggtgagataacagcccaccaaggcgacgatcagtagccgacctgagagggtgatcggccacattgggactgagacacggcccaaactcctacgggaggcagcagtggggaatattgcacaatgggggaaaccctgatgcagcaacgccgcgtgaaggaagaaggttttcggatcgtaaacttctatcaatagggacgaaaaaaatgacggtacctaaataagaagcccc

SEQ ID NO: 2447 - DNA, 490 bp, Unknown
  Ascusbbf_609346, encodes 16S rRNA
agagtttgatcctggctcaggatgaacgctggcggcgtgcttaacacatgcaagtcgaacgaagcacctcgcccgatgaaatggagtgcttgcacaaagtggaatcaattgaggtgactgagtggcggacgggtgagtaacgcgtgggtaacctgccctatgcagggggatagcagttggaaacggctgataataccgcataagcgcacggtatcgcatgatacagtgtgaaaaactttcgtggcataggatggacccgcgtctgattagctagttggtgaggtaacggctcaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgatgaagtatttcggtatgtaaagctctatcagcagggaagataatgacggtacctga

SEQ ID NO: 2448 - DNA, 490 bp, Unknown
  Ascusbbf_1858531, encodes 16S rRNA
agagtttgatcctggctcaggacgaacgctggcggcgtgcttcatacatgcaagtcgaacggatgtactagcaatagtgcattagtggcggacgggtgagtaatacatgagtaacctgccttatacagggggataacacctagaaatgggtgctaataccgcataataacctagtatggcatcatattaagaggaaaggagaaatccggtaaaagatggactcatgttcgattagctagttggtagggtaaaggcctaccaaggcaacgatcgatagccgaactgagaggttgaacggccacattggaactgagaaacggtccagactcctacgggaggcagcagtggggaatattgcgcaatgggggaaaccctgacgcagcaacgccgtgtgaaggaagaaggctctagggttgtaaacttctttgattagggacgaaaaaaatgacggtacctaaagaacaagccacggctaactacgtgccagcag

SEQ ID NO: 2449 - DNA, 490 bp, Unknown
  Ascusbbf_319338, encodes 16S rRNA
agagtttgatcatggctcaggatgaacgctggcggcgtgcttaacacatgcaagtcgaacgaagcactggaaaatggagattcgtcaaagttttcctttgactgagtggcgaacgggtgagtaatgcgtgagcaacctgcccttcagagggggacaacagttggaaacgactgctaataccgcatgatgtgttcgggcggcatcgtctgaacaccaaaggagaaatccgctgagggatgggctcacgtctgattagcttgttggcagggtaacggcctaccaaggcgacgatcagtagccggactgagaggttgaacggccacattgggactgagatacggcccagactcctacgggaggcagcagtggggaatattgggcaatgggcgaaagcctgacccagcaacgccgcgtgaaggaagaaggccttcgggttgtaaacttcttttaacagggacgaagaagtgacggtacctgttgaataagccac

SEQ ID NO: 2450 - DNA, 490 bp, Unknown
  Ascusbbf_81829, encodes 16S rRNA
agagtttgatcatggctcaggacgaacgctggcggcgtgcctaacacatgcaagtcgaacggagtgcatttttgagattcgtcgaaagagtgtacttagtggcggacgggtgagtaatgcgtgagcaacctgcccttcggagggggacaacagttagaaatgactgctaataccgcatgatgtagctgggaggcatctcccggttaccaaagattttatcgccgaaggatgggctcacgtctgattagctggttggtggggtaacggcctaccaaggctgcgatcagtagccggactgagaggttgaacggccacattgggactgagatacggcccagactcctacgggaggcagcagtggggaatattgggcaatgggcgcaagcctgacccagcaacgccgcgtgaaggaagaaggccttcgggttgtaaacttcttttatgagggacgaaggacgtgacggtacctcatgaataagccacggctaac

SEQ ID NO: 2451 - DNA, 490 bp, Unknown
  Ascusbbf_240275, encodes 16S rRNA
agagtttgatcatggctcaggatgaacgctggcggcgtgcctaacacatgcaagtcgagcgagaaatcgctcaatgatctttcgggtgatttgagcgatggaaagcggcggacgggtgagtaacgcgtaggtaacctgccccatacagagggatagccactggaaacggtgattaatacctcataacaccggaatatcgcatggtataccggtcaaagtttttcggtatgggatggacctgcgtctgattagctggttggtgaggtaacggctcaccaaggcgacgatcagtagccgacctgagagggtgatcggccacattggaactgagacacggtccaaactcctacgggaggcagcagtggggaatattgcacaatgggcgcaagcctgatgcagcaacgccgcgtgaacgaagaaggctcttgggtcgtaaagttctgttctgagggaagaagatctgacggtacctcaggagaaagccccggct

SEQ ID NO: 2452 - DNA, 490 bp, Unknown
  Ascusbbf_1590329, encodes 16S rRNA
agagtttgatcatggctcaggataaacgctggcggcgcacataagacatgcaagtcgaacggaagtcgtcataatgatttcaatacagatttgaagatttatctgatatgaagttgagaatgatttatgacaatggctttagtggcggactggtgagtaacgcgtaagcaatctgcctattagaggggaataacagtgagaaatcattgctaataccgcatatgccatagtcatcgcatgatgacagtgggaaaggagcaatccgctaatagatgagcttgcgtctgattagctagttggtggggtaatggcctaccaaggcaacgatcagtagccggactgagaggttgaacggccacattgggactgagatacggcccagactcctacgggaggcagcagtcgggaatattgcgcaatggaggaaactctgacgcagtgacgccgcgtataggatgaaggttttcggattgtaaactattgtcgttag

SEQ ID NO: 2453 - DNA, 490 bp, Unknown
  Ascusbbf_420602, encodes 16S rRNA
agagtttgatcctggctcaggacgaacgctggcggcgtgcttaacacatgcaagttgaacggtatgacatggaagcttgctgaagtgtcatatagtagcggacgggtgagtaatgcatgagaagctgccattgggagggggacaacagctggaaacggctgctaataccccgtatgccggaaggtgaaagggagtaatccgcccgatgaggtgctcatgtcctatcagctggttggtggggtaacggcctaccaaggcgacgacgggtagccggcctgagagggtgaacggccacactggaactgagatacggtccagactcctacgggaggcagcagtggggaatattgggcaatggaggaaactctgacccagcgacgccgcgtgagggaagacggccttcgggttgtaaacctcttttgtacgggaagaaggaagtgacggtactgtacgaataagtcccggctaactacgtgccagcagccgcggt

SEQ ID NO: 2454 - DNA, 490 bp, Unknown
  Ascusbbf_341365, encodes 16S rRNA
agagtttgatcctggctcaggatgaacgctggctacaggcttaacacatgcaagtcggggggcagcatgcgggttgcttgcaacctgtgatggcgaccggcggatgggtgagtaacgcgtatccaaccttcccttaaccggggcataacctgccgaaaggcagactaattccccatgcactccaccgacggcatcagacgcggagtaaagggtatcggttatggatggggatgcgtccgattagcttgacggcggggcaacggcccaccgtggcaacgatcggtaggggttctgagaggaaggtcccccacattggaactgagacacggtccaaactcctacgggaggcagcagtgaggaatattggtcaatggacgagagtctgaaccagccaagtagcgtgcaggatgagggccctatgggttgtaaactgcttttatgcggggataaagtcacccacgtgtgggtgtttgcaggtaccgcatgaata

SEQ ID NO: 2455 - DNA, 490 bp, Unknown
  Ascusbbf_334165, encodes 16S rRNA
agagtttgatcatggctcaggataaacgctggcggcgtgcctaatgcatgcaagtcgaacgggagcccatttatgggtcgaccgtggcggacgggtgaggaacacgtggctaacctgcccaacagtgggggataactccgggaaaccggggctaataccgcatacgctcagtagtggggacattgctgaggaaagtcgaaaggcgctgatggagggggctgcggccgattagttagttggtggggtaacggcttaccaagacagtgatcggtagctggtctgagaggacgatcagccacacggggactgagacacggccccgactcctacgggaggcagcagcaaggaattttccacaatgggcgcaagcctgatggagcaacgccgcgtgggggaagacgcttttcggagtgtaaaccccttttcgagaggacgaagcaaatgacggtactctcggaataaggaccggctaactacgtgccagcagccg

SEQ ID NO: 2456 - DNA, 490 bp, Unknown
  Ascusbbf_24295, encodes 16S rRNA
agagtttgatcatggctcaggatgaacgctagcggcaggcctaacacatgcaagtcgaggggcagcgcggggtagcaataccctggcggcgaccggcgcacgggtgcgtaacgcgtatgcaacctgcccgcaacagggggataacggggtgaaaaccccactaataccccgtatggtcatgatttcgcatgggattgtgacgaaagccttggtggttgcggatgggcatgcgtgacattagctggttggtagggtaacggcctaccaaggcgacgatgtctaggggagctgagaggctaatcccccacactggtactgagacacggaccagactcctacgggaggcagcagtgaggaatattggtcaatggagggaactctgaaccagccatgccgcgtgcgggaagaaggccctatgggttgtaaaccgcttttgaccgggagtaataagggccgtgcgcggtccgatgagagtaccggtggaataagc

SEQ ID NO: 2457 - DNA, 490 bp, Unknown
  Ascusbbf_197974, encodes 16S rRNA
agagtttgatcatggctcaggacgaacgctggcggcgtgcctaacacatgcaagtcgagcggagatattttccggaaagcttcggccggaagggggatattttagcggcggacgggtgagtaacgcgtgagcaacctttccttcacagggggataaagcaccgaaaggtgccctaataccgcatgagaccacggcatcacatgaagcaggggtcaaaggaggaatccggtgaagggtgggctcgcgtccgattagccagttggcggggtaacggcccaccaaagcgacgatcggtagccgacctgagagggtgatcggccacattggaactgagagacggtccaaactcctacgggaggcagcagtggggaatattgggcaatgggcgaaagcctgacccagcaacgccgcgtgagggaagaaggtcttcgggtcgtaaacctctgtcctcagtgaggagcagaagactgtagctgaggaggaagccccg

SEQ ID NO: 2458 - DNA, 490 bp, Unknown
  Ascusbbf_97935, encodes 16S rRNA
agagtttgatcatggctcaggataaacgctggcggcgcgcataacacatgcaagtcgagcgagatgagtggcttcggtcatgaatctagcggcggacgggtgagtataatatgaacaacctgccttacagagggggatagccggaagaaatttcgattaataccgcatattctgttgtgatcacatgattgtaatgggaaagtccgaaaggacgctgtaagaggggtttgtatccgattagctagttggagtggtaacggcacaccaaggcgacgatcggtagctggttcgagaggatgtacagccacattgggactgagatacggcccagactcctacgggaggcagcagtggggaatattgcgcaatggaggaaactctgacgcagcgacgccgtgtaaaggatgaaggtcttcggatcgtaaacttatatcgattatgaaaagtaaggatggtaataaagtaagaagccccggctaactacgtgcca

SEQ ID NO: 2459 - DNA, 490 bp, Unknown
  Ascusbbf_109574, encodes 16S rRNA
agagtttgatcctggctcaggatgaacgctagcgggaggcttaacacatgcaagtcgaggggcagcgcgggtggcaacacctggcggcgaccggcggacgggtgagtaacacgtatgcaacctgccctgcacagggggatagcccggagaaatccggattaataccccatggttcacgaaggccgcatggcttttgtggtaaagattcatcggtgcaggatgggcatgcgttccattagctagttggcggggcaacggcccaccaaggcgacgatggatatggggtctaaaaggatggtcccacacattggcactgagatacgggccaaactcctacgggaggcagcagtgaggaatattggtcaatgggcgagagcctgaaccagccatcccgcgtgcaggatgaaggtcttacagattgtaaactgcttttgcaggggacgaataaggatcacgtgtggtccgatgacagtactctgtgaataagcat

SEQ ID NO: 2460 - DNA, 490 bp, Unknown
  Ascusbbf_139325, encodes 16S rRNA
agagtttgatcatggctcaggatgaacgctggcggcgtgcttaacacatgcaagtcgaacggacagaaattggtgaagttttcggatggaactgatggatgttagtggcggacgggtgagtaacgcgtaaacaatctgccttagagagggggataacagatagaaatatttgctaataccgcataagaccacaggtaggcatctactaggggtaaaaggagcaatccgctttaagatgagtttgcgtactattagctagttggtgaggtaacggcccaccaaggcaacgatggttagccggcctgagagggtgaacggccacattggaactgagaacggtccagactcctacgggaggcagcagtgaggaatattgggcaatggaggaaactctgacccagcaacgccgcgtgaaggaagaaggttttaggattgtaaacttctgttataggggaagaagaaagtgacggtaccctatgagaaagctacg

SEQ ID NO: 2461 - DNA, 490 bp, Unknown
  Ascusbbf_358284, encodes 16S rRNA
agagtttgatcatggctcagattgaacgctagcggaatgctttacacatgcaagtcgaacggcagcgcaagagagcttgctctctggcggcgagtggcgaacgggtgagtaatgcatcggaacgtgcccagtagcgggggataactacgcgaaagcgtggctaataccgcatacgccctacgggggaaagggggggattcttcggaacctctcactattggagcggccgatgtcggattagctagttggtggggtaaaggcctaccaaggcgacgatccgtagctggtttgagaggacgaccagccacactgggactgagacacggcccagactcctacgggaggcagcagtggggaattttggacaatgggggcaaccctgatccagccattccgcgtgtgtgatgaaggccttcgggttgtaaagcacttttggcagagaagaaatggcgcgggctaatatcccgtgtcgatgacggtatctgcagaa

SEQ ID NO: 2462 - DNA, 490 bp, Unknown
  Ascusbbf_169198, encodes 16S rRNA
agagtttgatcctggctcagattgaacgctggcggaatgctttacacatgcaagtcgaacggcagcacgggtgcttgcacctggtggcgagtggcgaacgggtgagtaacatatcggaacgtacccagtaatgggggataactaaccgaaaggttggctaataccgcatacgccctgagggggaaagcgggggaccgtaaggcctcgcgttattggagcggccgatatctgattagctagttggtggggtaaaggcctaccaaggcgacgatcagtagctggtctgagaggatgatcagccacactggaactgagacacggtccagactcctacgggaggcagcagtggggaattttggacaatgggggaaaccctgatccagccattccgcgtgagtgaagaaggccttcgggttgtaaagctctttcggcagggaagaaacgctctggactaatactccggggtaatgacggtacctgaagaagaagc

SEQ ID NO: 2463 - DNA, 490 bp, Unknown
  Ascusbbf_1445965, encodes 16S rRNA
agagtttgatcctggctcaggatgaacgctagcggcaggcttaacacatgcaagtcgaggggcagcgcggggtagcactactctggcggcgaccggcggaagggtgcgtatcgcgtgagcaacttgcccgtcactgggggctaggcactggcaacggtgtgtaataccccataatatatggattcacatggattcatattgaaagattcgttggtgacggatgggctcgcgtaacattagctagtcggcgtggtaccggcccaccgaggctacgatgtttaggggttatgagaggaaggtcccacacactggaactgagacacgggccagacgcctacgggaggcagcagtggggaatattgggcaatgggcggaagcctgaaccagccatgccgcgtgcaggaataaggccctatgggtcgtaaactgcttttccttgagggcaataaggggcacgtgtggcccgatgagagtatcaggggaataagca

SEQ ID NO: 2464 - DNA, 490 bp, Unknown
  Ascusbbf_1576212, encodes 16S rRNA
agagtttgatcatggctcaggacgaacgctggcggcgtgcttaacacatgcaagtcgagcggaaaggccccttgtgggtactcgagcggcgaacgggtgagtaacacgtgagtaacctgccccgaactctgggataagcccgggaaactgggtctaataccggatggtcatcgtctgctgcatggcaggggatggaaagtgttagcggttcgggatgggctcgcggcctatcagcttgttggtgaggtaatggcttaccaaggcttttacgggtagccggcctgagagggcgaccggccacactgggactgagatacggcccagactcctacgggaggcagcagtggggaatattgcgcaatgggcgaaagcctgacgcagcaacgccgtgtgagggatgacggccttcgggttgtaaacctctttcaccagggacgaagctttttgtgacggtacctggggaagaagcgccggccaactacgtgccagc

SEQ ID NO: 2465 - DNA, 490 bp, Unknown
  Ascusbbf_858724, encodes 16S rRNA
agagtttgatcatggctcaggacgaacgctggcggcgtgcttaacacatgcaagtcgaacgctgaagcccacttcggtgggtggatgagtggcgaacgggtgagtaacacgtggacaatctgccctgcacttcgggataagccttggaaacgaggtctaataccggataggacactgcatcgcatggtgtggtgtggaaagcgtttaatgcggtgtgggatgagtccgcggcctatcagcttgttggtggggtgatggcctaccaaggcgacgacgggtagccggcctgagagggtgaccggccacactgggactgagacacggcccagactcctacgggaggcagcagtggggaatcttgcgcaatgggcggaagcctgacgcagcaacgccgcgtgggggatgacggccttcgggttgtaaacctctttcggcatcgacgaaggctctcgtgttcgggagttgacggtaggtgcagaagaagcaccgg

SEQ ID NO: 2466 - DNA, 490 bp, Unknown
  Ascusbbf_7437, encodes 16S rRNA
agagtttgatcatggctcaggacgaacgctggcggcatgcttaatacatgcaagtcgaacgggatattgagggcttgcccttgatatctagtggcgaacgggtgagtaacacgtgagcaacctgcctatcacacagggataccagtccgaaaggattgctaataccggatgagatcacgggaccgcatggtcctgtggtaaaagctcaggcggtggtagatgggctcgcggtacattagctagttggtgaggtaacggcccaccaaggcgatgatgtatagccgacctgagagggtgatcggccacattgggactgagatacggcccagactcctacgggaggcagcagtaaggaatattgggcaatgggggcaaccctgacccagcaatgccgcgtgaaggaagaaggttttcggattgtaaacttcttttatataggacgaatggatgacggtactatatgaataagccccggctaactacgtgccag

SEQ ID NO: 2467 - DNA, 490 bp, Unknown
  Ascusbbf_286547, encodes 16S rRNA
agagtttgatcctggctcaggatgaacgctagctacaggcttaacacatgcaagtcgcggggcatcgcgaagggtagcaatactctttggcggcgaccggcggatgggtgagtaacgcgtatccaacctggccctatctcgggcacagcccctcgaaagagggattaattcccgatgttcccgttagttcgcatgttctttcgggcaaaggtatttatcggatagggatggggatgcgttccattaggcagtcggcggggtaacggcccaccgagccgacgatggataggggttctgagaggaaggcccccaacactgggactgggacacggcccagactcctacgggaggcagcagtgaggaatattggtcaatggcggcaacgctgaaccagccaagtagcgtgagggattacggccctatgggttttaaacctcttttgttagggagcaacctatggcactagtgccatactgcgagtacctttcga

SEQ ID NO: 2468 - DNA, 490 bp, Unknown
  Ascusbbf_74130, encodes 16S rRNA
agagtttgatcatggctcaggatgaacgctggcggcgtgcttaacacatgcaagtcgaacggaacttttctcccgaagaagcggagtgcttgcacaaagtggattcatttgaaaagtttagtggcggacgggtgagtaacgcgtgggtaacctgccgtatgccgggggacaacagttggaaacgactgctaataccgcataagcgcacactatcgcatgatagagtgtgaaaaactccggtggcatacgatggacccgcgtctgattagctagttggtgaggtagcggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcaaggaagaaaatgacggtacttgac

SEQ ID NO: 2469 - DNA, 490 bp, Unknown
  Ascusbbf_1080579, encodes 16S rRNA
agagtttgatcctggctcaggatgaacgctggcggcgtgcctaacacatgcaagtcgaacgggactattaggagatgatttcggtctgatcctaatagtttagtggcggacgggtgagtaacgcgtggacaacctgcctttcacagggggatagcagctggaaacggctggtaataccgcatacgctcatgtcaccgcatggtgatgtgaggaaagatttatcggtgaaagatggatccgcgtctgattagccagttggcggggtaacggcccaccaaagcgacgatcagtagccggcctgagagggcggacggcctcattgggactgagacacggcccagactcctacgggaggcagcagtgggggatattgcacaatgggcgcaagcctgatgcagcgacgccgcgtgagtgaagaagtatttcggtatgtaaagctctatcagcagggaagaaaggcccctttggggagatgacggtacctgactaa

SEQ ID NO: 2470 - DNA, 470 bp, Unknown
  Ascusbbf_59775, encodes 16S rRNA
agagtttgatcctggctcagaacgaacgctggcggcaggcttaacacatgcaagtcgaacgcactcttcggagtgagtggcagacgggtgagtaacgcgtgggaacctacctagtagtacggaacaactgagggaaacttcagctaataccgtatacgccctacgggggaaagatttatcgctattagatgggcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccttagggttgtaaagctctttcagtggggacgataatgacggtacccacagaagaagccccggctaacttcgtgccagcagccgcggtaat

SEQ ID NO: 2471 - DNA, 490 bp, Unknown
  Ascusbbf_1568603, encodes 16S rRNA
agagtttgatcatggctcaggatgaacgctggcggcgtgcctaacacatgcaagtcgaacggagatattccgccgttgaagcttcggcagaaacatggaacatcttagtggcggacgggtgagtaacgcgtggataacctgccctgtactgggggatagcagctggaaacggctggtaataccgcataagcgcacggtactgcatagtacagtgtgaaaaactccggtggtacaggatgggtccgcgtccgattagccagttggcggggtaacggcccaccaaagcgacgatcggtagccggcatgggagggcggacggccacattgggactgagacacggcccagactcctacgggaggcagcagtgggggatattgcacaatgggggaaaccctgatgcagcgacgccgcgtgggtgaagaagtatttcggtatgtaaagccctatcagcagggacgatgatgacggtacctgagtaagaagccccgg

SEQ ID NO: 2472 - DNA, 470 bp, Unknown
  Ascusbbf_174002, encodes 16S rRNA
agagtttgatcctggctcagaacgaacgctggcggcaggcttaacacatgcaagtcgagcgctctcttcggagagagcggcggacgggtgagtaacgcgtgggaacatgcccgaaggtacggaacaaccgctggaaacggcggctaatgccgtatgtgccctatgggggaaagatttatcgccttcggattggcccgcgtcggattaggtagttggtggggtaatggctcaccaagccgacgatccgtagctggtttgagaggatgatcagccacactgggactgagacacggcccagactcctacgggaggcagcagtggggaatcttggacaatgggggaaaccctgatccagccatgccgcgtgagcgatgaaggccttagggttgtaaagctctttcacccgtgaagataatgacggtagcgggagaagaagccccggctaactccgtgccagcagccgcggtaat

SEQ ID NO: 2473 - DNA, 490 bp, Unknown
  Ascusbbf_146728, encodes 16S rRNA
agagtttgatcctggctcaggatgaacgctggcggcgtgcctaacacatgcaagtcgaacggagcacattaagcgagaccttcgggtggaactttttatgcttagtggcggacgggtgagtaacgcgtgggtaacctgccttatacagggggataacagagagaaatttctgctaataccccataagcgcacagtatcgcatgatacagggtgaaaaggatttccggtataagatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacggtacctgcacaagaagccccggcta

SEQ ID NO: 2474 - DNA, 490 bp, Unknown
  Ascusbbf_14326, encodes 16S rRNA
agagtttgatcatggctcaggatgaacgctggcggcgtgcctaatacatgcaagtcgaacgagcgagaccaagcttgcttggttaagctagtggcgaacgggtgagtaatacgtaagcaacctgcctacacggactgggataacacctggaaacgggcgctaataccggataggtaacggaagggcatccttctgttattaaaggttagaaacacaagtagatgggcttacggtgcattagctagttggtgaggtaacggcccaccaaggcgatgatgcatagccggcctgagagggtgaacggccacattgggactgagacacggcccagactcctacgggaggcagcagtagggaattttcggcaatgggcgcaagcctgaccgagcaacgccgcgtgagtgatgaaggttttcggatcgtaaagctctgttgtaagggaagaacagcacggatagaatctgtgattgacggtaccttaccagaaagc

SEQ ID NO: 2475 - DNA, 490 bp, Unknown
  Ascusbbf_666737, encodes 16S rRNA
agagtttgatcctggctcaggttgaacgctggcggcatgctttacacatgcaagtcgaacgagaatctggtgcttgcaccagaggaaagtggcggacgggtgagtaatatgtaggaaatctgccctagagagggggacaacagagggaaacttctgctaataccccatatgagcgtacttgaaatagtattcttgaaaactccggtgctctaggatgagcctgcatctgattagcttgttggcggtgtaatggaccaccaaggcgacgatcagtagctggtttgagaggatgatcagcctcaatgggactgagacacggcccatactcctacgggaggcagcagtagggaattttgcgcaatgggcgaaagcctgacgcagcaacgccgcgtgtgtgatgacgcccttcggggtgtaaaacactgtcagtagggacgaaacttgacggtacctacagaggaagcgccggctaactccgtgccagcagccg

SEQ ID NO: 2476 - DNA, 490 bp, Unknown
  Ascusbbf_418277, encodes 16S rRNA
agagtttgatcctggctcagaacgaacgctggcggcgcgtcttaagcatgcaagtcgggcgggaacgggaagcttgcttcccgcgagagcggcggactggtgagtaacgcgtgggtgacgtaccccccggacggggacagcctgcagaaatgcagggtaataccggatacggttctgtatattggaagtacagaaggaaaggagctacggctccgccgggggaacggcctgcggcccatcagctggtcggcggggtaaaggcccaccgaggcgatgacgggtacccggcctgagagggcggacgggcacattgggactgagatacggcccagactcctacgggaggcagcagctaagaatattccgcaatgggggaaaccctgacggagcgacgccgcgtggacgaggaaggccggaaggttgtaaagtccttttggggccgaggaataagtacgggagggaatgcccgtatggtgactgtaagccctga

SEQ ID NO: 2477 - DNA, 490 bp, Unknown
  Ascusbbf_71537, encodes 16S rRNA
agagtttgatcctggctcaggacgaacgctggcggcgcgcctaacacatgcaagtcgaacggagatcatttggtagaagttttcggatggacaccgggtgatcttagtggcgaacgggtgagtaacgcgtgagcaatctgcctcagagtgggggacaacagttggaaacgactgctaataccgcataagcccacagcaccgcatggtgcagggggaaaagatttattgctttgagatgagctcgcgtccaattagctggttggtgaggtaacggcccaccaaggcgacgattggtagccggactgagaggttgaacggccacattgggactgagatacggcccagactcctacgggaggcagcagtggggaatattgcacaatggggggaaccctgatgcagcgacgccgcgtggaggaagaaggtcttcggattgtaaactcctgttgttagggacgataatgacggtacctaacaaggaagcaccggc

SEQ ID NO: 2478 - DNA, 490 bp, Unknown
  Ascusbbf_33981, encodes 16S rRNA
agagtttgatcatggctcaggatgaacgctggcggcgtgcttaacacatgcaagtcgaacggagtttattgagaagcttgctttttggtaaacttagtggcggacgggtgagtaacgcgtgggtaacctgccttataccgggggataacgtctggaaacggacgctaataccgcataagcgcacggacaggcatctgtcagtgtgaaaaactccggtggtataagatggacccgcgtctgattagatagttggtgaggtaacggctcaccaagtcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgagtaagaagccccggctaactacgtg

SEQ ID NO: 2479 - DNA, 490 bp, Unknown
  Ascusbbf_262889, encodes 16S rRNA
agagtttgatcatggctcaggacgaacgctggcggcgtgcttaacacatgcaagtcgaacgaagcttgaagaatgaattcttcggaatgatttctgatatgactgagtggcggacgggtgagtaacgcgtgagcaacctgcccttcggagggggatagtgtctggaaacggacagtaataccgcataaagttaggatatggcatcataacctaaccaaagatttatcgccgagggatgggctcgcgtctgattagatagttggtggggtaacggcctaccaagtcgacgatcagtagccggactgagaggttgatcggccacattgggactgagacacggcccagactcctacgggaggcagcagtggggaatattgcacaatgggggaaaccctgatgcagcaacgccgcgtggaggaagacggttttcggattgtaaactcctgttcttagggaagaagacagtgacggtacctaaggagcaagccac

SEQ ID NO: 2480 - DNA, 490 bp, Unknown
  Ascusbbf_66072, encodes 16S rRNA
agagtttgatcatggctcaggatgaacgctggcggcgtgcttaacacatgcaagtcgaacggagactgcgattgaagctgaagtagcttgctatggatgtggatatcgtattcttagtggcggacgggtgagtaacgcgtgggtaacctacctcatacaggggaatagcagttggaaacgactgataaaaccgcataaaacggcagcagggcatcctgcaaccgtcaaatatttataggtatgagatgggcccgcgtctgattaggcagttggcgaggtaacggctcaccaaaccgacgatcagtagccggcctgagagggtgaacggccacattgggactgagacacggcccaaactcctacgggaggcagcagtggggaatattggacaatgggggcaaccctgatccagcgacgccgcgtgagtgaagaagtatttcggtatgtaaagctctatcagcagggaagatgatgacggtacctgactaag

SEQ ID NO: 2481 - DNA, 490 bp, Unknown
  Ascusbbf_318675, encodes 16S rRNA
agagtttgatcctggctcaggacgaacgctggcggcgtgcctaacacatgcaagtcgaacggaactctctggaacaaggcttcggccaagggaatttgagtttagtggcggacgggtgagtaacgcgtgagcaacctgcccttcggagggggacaacagttggaaacgactgctaataccgcatgacatacaggaatcgcatggtttttgtatcaaagatttatcgccgagggatgggctcgcgtctgattagctagttggtggggtaacggcctaccaaggcgacgatcagtagccggactgagaggttgaacggccacattgggactgagatacggcccagactcctacgggaggcagcagtggggaatattgggcaatgggggcaaccctgacccagcaacgccgcgtgaaggaagaaggctttcgggttgtaaacttcttttatcagggacgataatgacggtacctgatgaataagccacggcta

SEQ ID NO: 2482 - DNA, 490 bp, Unknown
  Ascusbbf_395006, encodes 16S rRNA
agagtttgatcctggctcaggacgaacgctggcggcgtgcctaacacatgcaagtcgaacgagaatcagtttattgatcccttcggggtgatttagattgaggacagtggcggacgggcgagtaacgcgtgagtaacctgcccataagagagggatagccgatggaaacgtcgagtaatacctcatattgtagtgagatcgcatggtttcactatgaaagatttatcgcttatggatggactcgcgtctgattagatagttggcgaggtaacggctcaccaagtcgacgatcagtagccgaactgagaggttgatcggccgcattgggactgagacacggcccagactcctacgggaggcagcagtggggaatattgcgcaatggggggaaccctgacgcagcaacgccgcgtgcaggaagaaggtcttcggattgtaaactgttgtcgcaagggaagaagaaagtgacggtaccttgtgagaaagtcac

SEQ ID NO: 2483 - DNA, 490 bp, Unknown
  Ascusbbf_192268, encodes 16S rRNA
agagtttgatcctggctcaggatgaacgctggcggcgtgcctaacacatgcaagtcgagcgaagatttagaggagtacttgtacaaatttaaatcttagcggcggacgggtgagtaacacgtgagtaacctgcccttcagtggggaataacaacgagaaatcgttgctaataccgcataatgttatcggatcgcatggtctgataaccaaaggatttattcgctgaaggatggactcgcgtccgattagctagttggtgaggtaatggctcaccaaggcaacgatcggtagccgaactgagaggttgatcggccacattgggactgagacacggcccagactcctacgggaggcagcagtggggaatattgggcaatgggggaaaccctgacccagcaacgccgcgtgaaggaagaaggtcttcggattgtaaacttctttgatcagggacgaacaaaatgacggtacctgaggaacaagccacggctaa

SEQ ID NO: 2484 - DNA, 490 bp, Unknown
  Ascusbbf_435875, encodes 16S rRNA
agagtttgatcctggctcaggatgaacgctggcggcgtgcctaacacatgcaagtcgaacggggataaggcgctgagaagcttcggccaatcttgccttatcctagtggcggacgggtgagtaacgcgtggataacctgcccctttctgggggacaacagccggaaacggctgctaataccgcataagcttcatagatcgcatggtctgtggaggaaaggagagatccgggaagggatggatccgcgtccgattagccagttggcggggtaacggcccaccaaagcgacgatcggtagccggcctgagagggcggacggccacattgggactgagacacggcccagactcctacgggaggcagcagtgggggatattgcacaatgggggaaaccctgatgcagcgacgccgcgtgggtgaagaagcttttcggagtgtaaagccctatcagcagggaagaaagcccgcaagggttagacggtacctgact

SEQ ID NO: 2485 - DNA, 490 bp, Unknown
  Ascusbbf_7504, encodes 16S rRNA
agagtttgatcatggctcaggacgaacgctggcggcgtgcttaacacatgcaagtcgaacgaagattatggagagcttgcttgaaataatctgagtggcggacgggtgagtaacgcgtgaataatctgtcctatacagggggataacgcatcgaaagatgtgctaataccgcgtaggaccacggtactgcatggtactgaggtgaaaggagcaatccagtatagggtgagttcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgaaagcctgacccagcaacgccgcgtgaaggaagaaggttttcggattgtaaacttctgtcctatgtgaagagaagtagacggtagcataggaggaagccccggctaactacg

SEQ ID NO: 2486 - DNA, 490 bp, Unknown
  Ascusbbf_64935, encodes 16S rRNA
agagtttgatcatggctcaggatgaacgctggcggcgtgcctaacacatgcaagtcgaacgaagcacataccttcggggatgtgactgagtggcggacgggtgagtaacgcgtgggtaacctgccctctacagggggacaacagccagaaatggctgctaataccgcataagcgcacggggaggcatcttcccgtgtgaaaaactacggtggtagaggatgggcccgcgtctgattagctggttggcggggtaaaagcccaccaaggcgacgatcagtagccggtctgagaggatgaacggccacattggaactgagacacggtccaaactcctacgggaggcagcagtgagggatattgcacaatgggggaaaccctgatgcagcaacgccgcgtgggtgaagaagtatttcgatatgtaaagccctatcagcagggaagatgatgacggtacctgactaagaagctccggctaaatacgtgccagcag

SEQ ID NO: 2487 - DNA, 490 bp, Unknown
  Ascusbbf_391313, encodes 16S rRNA
agagtttgatcctggctcaggacgaacgctggcggcgtgcttcaaacatgcaagtcgaacgagactcgagggagcttgctcctaagagtctagtggcggacgggtgagtaacgcgtgagcaatctggctattacagggggataacacttggaaacgagtgctaataccgcgtatgaccacaacctggcatcaggaaggggtgaaaggagaaatccggtaataggtgagcttgcgtttcattagctagttggtgaaggtaacggcccaccaaggcgacgatgaatagccgatctgagaggatgaccggccacactggaattgagaacggtccagactcctacgggaggcagcagttaggaatattgggcaatggaggaaactctgacccagcaacgccgcgtgaaggaagaaggttttcggattgtaaacttctgatctgtgggaagaagagagtgacggtaccacaggagaaagccacggctaactacgt

SEQ ID NO: 2488 - DNA, 490 bp, Unknown
  Ascusbbf_122323, encodes 16S rRNA
agagtttgatcctggctcaggatgaacgctagcgacaggcctaacacatgcaagtcgaggggcagcatggttgtagcaatacaactgatggcgaccggcaaacgggtgagtaacaagtgagcaacctgcctataactggaggataacccgtcgaaagacggactaatactgcataatattgagataccgcatgatatttcaattaaactttttgggttatagatgggctcgccttccattagctagttggtaaggtaacggcttaccaaggcgacgatggataggggttctgagaggaaggtcccccacattggtactgagacacggaccaaactcctacgggaggcagcagtgaggaatattggtcaatggacggaagtctgaaccagccaagtcgcgtgcaggaagactgccctatgggttgtaaactgcttttatataggaataaaaaaatctacgtgtaggttattgtaggtactataagaataag

SEQ ID NO: 2489 - DNA, 490 bp, Unknown
  Ascusbbf_722034, encodes 16S rRNA
agagtttgatcatggctcaggatgaacgctggcggcgtgcctaacacatgcaagtcgaacggtgaaaccgcctccgggcggacatggagtggcgaacgggtgagtaacacgtgaccaacctgccccgcgcaccgggacagccccccgaaagggggattaataccggatactccgcccctcccgcatgggaggggcgggaaagctccggcggcgcgggatggggtcgcggcccatcaggtagtaggcggggtagcggcccgcctagccgacgacgggtagccgggttgagagaccgaccggccacattgggactgagatacggcccagactcctacgggaggcagcagtggggaatattgcgcaatgggggcaaccctgacgcagcaacgccgcgtgcgggacgaaggcactcgtgtcgtaaaccgctttcagcagggaagacatcgacggtacctgcagaagaagccccggctaactacgtgccagcagc

SEQ ID NO: 2490 - DNA, 480 bp, Unknown
  Ascusbbf_205680, encodes 16S rRNA
agagtttgatcctggctcaggatgaacgctggcggcgtgcctaatacatgcaagtcgagcggaaaggctccttcgggagtactcgagcggcggacgggtgagtaacgcgtaagaatgtaccccaaactgagggataactgctcgaaagagtagctaataccgcatgtgctcttcggagtaaagcttcggcggtttgggaacagcttgcgtatgattagctagttggtaaggtaatggcttaccaaggcgacgatcattagctggtctgagaggatgatcagccacactgggactgagacacggcccagactcctacgggaggcagcagtagggaattttccacaatgggggcaaccctgatggagcaacgccgcgtgcaggatgaaggccttcgggttgtaaactgcttttgtctgtgacgaatatgacggtagcagacgaataaggatcggctaactacgtgccagcagccgcggtaat

SEQ ID NO: 2491 - DNA, 490 bp, Unknown
  Ascusbbf_252696, encodes 16S rRNA
agagtttgatcatggctcaggatgaacgctggcggcgtgcctaacacatgcaagtcgaacgggacttattatgacgatttcggtctgaattttaagtttagtggcggacgggtgagtaacgcgtggacaacctgcctttcacagggggatagcagctggaaacggctggtaataccgcatacgctcagtgcaccgcatggtgtattgaggaaagatttatcggtgaaagatggatccgcgtctgattagccagttggcggggtaacggcccaccaaagcgacgatcagtagccggcctgagagggcggacggccacattgggactgagacacggcccagactcctacgggaggcagcagtgggggatattgcacaatgggcgcaagcctgatgcagcgacgccgcgtgagtgaagaagtatttcggtatgtaaagctctatcagcagggaagaaaggcccattagggagatgacggtacctgactaagaa

SEQ ID NO: 2492 - DNA, 490 bp, Unknown
  Ascusbbf_245797, encodes 16S rRNA
agagtttgatcatggctcaggatgaacgctggcggcgtgcctaacacatgcaagtcgaacgatgaagcggggaggaagttttcggatggaattcctgtggaagagtggcggacgggtgagtaacgcgtggataacctgccccgtacagggggatagcagcgggaaactgctggtaataccgtatatgcgcacaactgtcgcatgacagggtgtggaaagttacggcggtacgggatgggtccgcgtccgattagccagttggcggggtaaaggcccaccaaagcgacgatcggtagccggcctgagagggcggacggccacattgggactgagacacggcccagactcctacgggaggcagcagtgggggatattgcacaatgggggaaaccctgatgcagcgacgccgcgtgggtgaagaagtatttcggtatgtaaagccctatcagcagggacgatgatgacggtacctgcagaagaagccccggct

SEQ ID NO: 2493 - DNA, 490 bp, Unknown
  Ascusbbf_687263, encodes 16S rRNA
agagtttgatcctggctcaggatgaacgctagcggcaggcctaacacatgcaagtcgaggggtagagttagcttgctaacttgagaccggcgcacgggtgcgtaacgcgtatgcaatctaccttttactaaggaatagcccagagaaatttggattaatgccttatagtatgttaagatggcatcatttaaacattaaagaacttcggtaaaagatgagcatgcgtcccattagttagttggtaaggtaacggcttaccaagacgatgatgggtaggggtcctgagagggagatcccccacactggtactgagacacggaccagactcctacgggaggcagcagtgaggaatattggtcaatggaggcaactctgaaccagccatgccgcgtgcaggaagacggtcctatggattgtaaactgcttttgtacaggaagaaaaagtatcacgagtggtatattgacggtactgtaagaataaggatcggct

SEQ ID NO: 2494 - DNA, 490 bp, Unknown
  Ascusbbf_20073, encodes 16S rRNA
agagtttgatcctggctcaggatgaacgctagctacaggcttaacacatgcaagtcgaggggcatcagggatccagcttgctggatttgctggcgaccggcgcacgggtgagtaacgcgtatccaacctgtcccatagtagggaacagcccggcgaaagtcggattaatgccctatgttgttccttgagagcatttgattggaaccaaagatttatcgctatgggttggggatgcgtccgattaggtagacggcggggtaacggcccaccgtgccttcgatcggtaggggttctgagaggaaggtcccccacattggaactgagacacggtccaaactcctacgggaggcagcagtgaggaatattggtcaatgggcgcgagcctgaaccagccaagtagcgtgcaggatgacggccctatgggttgtaaactgcttttggaggggaataaagtcgcctacgcgtaggtgtttgcatgtaccctcagaat

SEQ ID NO: 2495 - DNA, 490 bp, Unknown
  Ascusbbf_5254, encodes 16S rRNA
agagtttgatcatggctcaggatgaacgctggcggcaggcttaatacatgcaagttgaacggtaacatgagagtagcaatacttttgatgacgagtggcgtacgggtgcgtaacacgtgtgcaacctaccttataccggaacaaaacatcgagaaattggtgctaatattccataacattatagataggcatctatttataattaaagatacgttggtatgagatgggcacgcggtccattagctagttggtaaggtaacggcttaccaaggcgacgatggataggggttctgagaggattaccccccacattggaactgagacacggtccaaactcctacgggaggcagcagtaaggaatattggtcaatggaggcaactctgaaccagccatgccgcgtgcaggaagacggccctatgggttgtaaactgcttttattagaggataaagtgatgcacgtgtgcattattgcaggtatctaatgaataa

SEQ ID NO: 2496 - DNA, 490 bp, Unknown
  Ascusbbf_152278, encodes 16S rRNA
agagtttgatcatggctcaggatgaacgctagcggcaggcttaacacatgcaagtcgaggggcagcgcggtgtagcaatacactggcggcgaccggcggaagggtgcgtaacgcgtgagcaacatgcccgtatcagggggataatcggtggaaacgccgtctaatactccataacacttttttggacatccaggggagttgaaagcttttttgcggatacggattggctcgcgtgacattagctggttggcggggtaacggcccaccaaggcgacgatgtctaggggttctgagaggaaggtcccccacactggaactgagacacggtccagactcctacgggaggcagcagtgaggaatattggtcaatgggcggaagcctgaaccagccatgccgcgtgcaggaataaggccctacgggtcgtaaactgcttttgacgtggagcaataaggactacgtgtagtctgatgagagtactcgtcgaataag

SEQ ID NO: 2497 - DNA, 490 bp, Unknown
  Ascusbbf_127942, encodes 16S rRNA
agagtttgatcctggctcaggatgaacgctggcggcgtgcctaacacattcaagtcgaacggtgaagggacttcggtcccggatcagtggcggacgggtgagtaacgcgtgagcaacctgcctttgcttgggggataacgtttggaaacgaacgctaataccgcataaaacagcattccggcatcgggaagctgtcaaagatttattgagcagagatgggctcgcgtccgattagatagttggtgaggtaacggctcaccaagtcgacgatcggtagccggactgagaggttgaacggccacattggaactgagatacggtccagactcctacgggaggcagcagtggggaatattgggcaatgggcgaaagcctgacccagcgacgccgcgtgaaggaagaaggccctcgggttgtaaacttcagtcaacagggaagaaacaaatgacggtacctgtggaggaagccacggctaactacgtgccagcag

SEQ ID NO: 2498 - DNA, 490 bp, Unknown
  Ascusbbf_1801352, encodes 16S rRNA
agagtttgatcctggcttaggacgaacgctggcggcgtgcctaatacatgcaagtcgggcggagcccgaggggagcttgctccttttcgggctcagcggcggacgggtgagtaacacgtgggtaacctgcccgtaagaccgggataactccgggaaaccggggctaataccggataacaccgggggccccatggcttccggttgaaaggcggcctttggctgccacttacggatgggcccgcggcgcattagctagttggcggggtaacggcccaccaaggcgacgatgcgtagccggcctgagagggtggacggccacactgggactgagacacggcccagacccctacgggaggcagcagtagggaatcttccgcaatgggcgaaagcctgacggagcgacgccgcgtgagcgaggaaggccttcgggtcgtaaagctctgttgtcagggaagaaggcgcgccgttcgaatagggcggcgcggtgacg

SEQ ID NO: 2499 - DNA, 490 bp, Unknown
  Ascusbbf_26832, encodes 16S rRNA
agagtttgatcctggctcaggataaacgctggcggcgcacataagacatgcaagtcgaacggacttaatcgattcttttagattcgaagcggttagtggcggactggtgagtaacgcgtgagcaacctgcctatcagaggggaataacagtgagaaatcattgctaataccgcatatgctcacagtatcacatgatgctgtgaggaaaggagcaatccgctgatagatgggctcgcgtctgattagctagttggtggggcaacggcctaccaaggcgacgatcagtagccggactgagaggttgaacggccacattgggactgagatacggcccagactcctacgggaggcagcagtcgggaatattgcgcaatggaggaaactctgacgcagtgacgccgcgtataggaagaaggttttcggattgtaaactattgtcgttagggaagaaacaagacagtacctaaggaggaagccccggctaactatg

SEQ ID NO: 2500 - DNA, 490 bp, Unknown
  Ascusbbf_42599, encodes 16S rRNA
agagtttgatcctggctcaggacgaacgctggcggcgtgcttaacacatgcaagtcgaacgaggtttatggaagagcttgctcggaagtaaaccgagtggcggacgggtgagtaacgcgtgagcaacctgtctcacacaggggaataacgcatcgaaagatgtgctaataccgcataggaccacgggagggcatccttccgaggtgaaaggagcaatccggtgtgaggtgggctcgcgtctgattagatagttggtggggtaacggcctaccaagtcaacgatcagtagccgacctgagagggtgatcggccacattgggactgagacacggcccagactcctacgggaggcagcagtggggaatattgggcaatgggcgcaagcctgacccagcaacgccgcgtgaaggaagaaggttttcggatcgtaaacttctgtccttggtgaagataatgacggtagccaaggaggaagccccggctaactacg

SEQ ID NO: 2501 - DNA, 490 bp, Unknown
  Ascusbbf_21325, encodes 16S rRNA
agagtttgatcatggctcaggatgaacgctagcgggaggcttaacacatgcaagtcgaggggcagcgcggggtagcaataccctggcggcgaccggcagacgggtgagtaacacgtatgcaacctgccctgcacaggggaatagcccggagaaattcggattaatgccccatggtccgcgggagccgcatggcttcttcggtaaagattcatcggtgcaggatgggcatgcgttccattagctagttggcggggtaacggcccaccaaggcgacgatggatatggggtctaaaaggatggtcccacacattggcactgagatacgggccaaactcctacgggaggcagcagtgaggaatattggtcaatgggcgagagcctgaaccagccatcccgcgtgcaggatgaaggtcttacagattgtaaactgcttttgctggggacgaataaggggtacgcgtaccccgatgacagtactcagtgaataagc

SEQ ID NO: 2502 - DNA, 490 bp, Unknown
  Ascusbbf_24524, encodes 16S rRNA
agagtttgatcatggctcaggatgaacgctagcggcaggcttaacacatgcaagtcgaggggcagcgcgaggtagcaatactttggcggcgaccggcggaagggtgcgtaacgcgtgagcaacttgcccgtatctgggacataaccggtggaaacgccgactaatttcccataacaacagagatgacatcttctttgtttgaaagcttcggtggatacggatgggctcgcgtgacattagctagttggagtggtaacggcacaccaaggcgacgatgtctaggggttctgagaggaaggtcccccacactggaactgagacacggtccagactcctacgggaggcagcagtgaggaatattggtcaatgggcggaagcctgaaccagccatgccgcgtgcaggaataaggccctatgggtcgtaaactgcttttgacggggagcaataagggctacgcgtagcccgatgagagtactcgtcgaataagca

SEQ ID NO: 2503 - DNA, 490 bp, Unknown
  Ascusbbf_212721, encodes 16S rRNA
agagtttgatcctggctcaggatgaacgctggcggcgtgcctaatacatgcaagtcgagcggcttggggagcaatccccttgcagcggcgaacgggtgagtaacacgtaggcaacctgcctttgagactgggatacccaggcgaaagcttggctaataccggataacaacgaggaccgcatggtccccgcttgaaaggtgctccaaagcaccgctcttagatgggcctgcggcacattagctagttggtgaggtaacggcccaccaaggcgaggatgtgtagccgacctgagagggtgaccggccacaatgggactgagacacggcccatactcctacgggaggcagcagtagggagttttcggcaatgggcgaaagcctgaccgagcaacgccgcgtgagtgatgaaggtcttcggatcgtaaagctctgttacgagggaaaaacacgcccgcgaggaaatgcgcggacgccgatggtacctcgccaga

SEQ ID NO: 2504 - DNA, 490 bp, Unknown
  Ascusbbf_128794, encodes 16S rRNA
agagtttgatcatggctcagattgaacgctggcggcaggcctaacacatgcaagtcgagcggtaacagtccttcgggagctgacgagcggcggacgggtgaggaatgcttgggaatctgcccgatagagggggataactacgggaaactgtagctaataccgcatgatctctaaggagcaaagcgggggaccttcgggcctcgcgctatcggatgagcccaagtgggattagctagttggtggggtaaaggctcaccaaggcgacgatctctaactggtctgagaggatgatcagtcacactggaactgagacacggtccagactcctacgggaggcagcagtggggaatattggacaatgggggcaaccctgatccagccatgccgcgtgtgtgaagaaggccttcgggttgtaaagcacttttggcggggaggaagaagcgtttgtgaataatgaacgcttttgacgttacccgcagaataagcaccg

SEQ ID NO: 2505 - DNA, 490 bp, Unknown
  Ascusbbf_151349, encodes 16S rRNA
agagtttgatcatggctcagaacgaacgctggcggcaggcttaacacatgcaagttgaacgggatccttgaaatagcttgctattttaaggtgagagtagcgcacgggtgagtaacacgtgggaacataccatacagtgggggataacaattggaaacgattgataataccgcataagcccgagaggggaaaggagaaattcgctgaatgattggcccgcggaagattaggcagttggtggggtaaaggcctaccaaacctacgatctatagctggtctgagaggacgatcagccacattgggactgagacacggcccaaactcctacgggaggcagcagtgaggaatattgggcaatgggggaaaccctgacccagccatgccgcgtgagtgatgaaggttttcgaattgtaaagctctttcggatgtgaagatgatgacggtagcatctaaagaagccccggcaaacttcgtgccagcagccgcggta

SEQ ID NO: 2506 - DNA, 490 bp, Unknown
  Ascusbbf_164986, encodes 16S rRNA
agagtttgatcctggctcaggataaacgctagcggcaggcctaacacatgcaagtcgagcggtaacacggtgtagcaatacattggtgacgagcggcggacgggtgagtaacgcgtatgcaacctacccactacacaaggatagccttccgaaaggaggattaatacttgatagtactctaagatggcatcaaaacagagttaaagatttatcggtagtggatgggcatgcgtggcattagttagttggcggggtaacggcccaccaagacgatgatgcctaggggttctaaaaggaagatcccccacatcggtactgagacacggaccgaactcctacgggaggcagcagtgaggaatattggacaatggaggagactctgatccagccaaaccgcgtgaaggaagaaggttctctgaatcgtaaacttcttttgtaagagaataaaagtagctatgtatagcgatttgaatgtaccttacgaataagc

SEQ ID NO: 2507 - DNA, 490 bp, Unknown
  Ascusbbf_304006, encodes 16S rRNA
agagtttgatcatggctcaggatgaacgctggcggcgtgcctaacacatgcaagtcgaacggaaacaggactttcgctaagcttcggcttagttgttttgttttagtggcggacgggtgagtaacgcgtggacaacctgccgtatacagggggataacagagagaaatttctgctaataccgcataagcgcacggggaggcatcttcttgtgtgaaaagatttatcggtatacgatggatccgcgtctgattagccagttggcggggtaaaggcccaccaaagcgacgatcagtagccggcctgagagggtgaacggccacattgggactgagagacggcccaaactcctacgggaggcagcagtgggggatattgcacaatgggggaaaccctgatgcagcgacgccgcgtgagtgaagaagtatttcggtatgtaaagctctatcagcagggaagaagcagacggtacctgactaagaagcaccggct

SEQ ID NO: 2508 - DNA, 490 bp, Unknown
  Ascusbbf_1502957, encodes 16S rRNA
agagtttgatcctggctcaggatgaacgctagctacaggcctaacacatgcaagtcgaggggcatcgcgcgggtgagcgatcacctgtggcggcgaccggcggatgggtgagtaacgcgtatccaacctgccccaagcccgggcacagcccctggaaacggggagtgactcccgatagcgcggagacgccgcatggcggttccgctaaattccgaggcttgggatgggggtgcgtccgattaggtagttggcggggcaacggcccaccaagccgacgatcggtaggggttctgagaggaaggtcccccacattgggactgagacacggcccaaactcctacgggaggcagcagtgaggaatattggtcaatgggcggaagcctgaaccagccaagtagcgtggaggatgacggccctacgggttgtaaactcctttagcgcggggataacatgctccacgtgtggggcactgcaggtaccgcgagaataa

SEQ ID NO: 2509 - DNA, 490 bp, Unknown
  Ascusbbf_1787950, encodes 16S rRNA
agagtttgatcatggctcaggatgaacgctggcggcatgcctaagacatgcaagtcgaacggagcggcctattgaagacggagtgcttgcacaaagttggatttagattcccgctcagtggcagacgggtgagtaacacgtgggtaatctaccctagagactgggacaacagttggaaacgactgctaataccggataattcatatttagaaaactagatatgctaaaaggagcctttaaagcttcactctaggatgagcttgcggcgcattagctagttggtggggcaatggcctaccaaggcaacgatgcgtatccgagctgagaggctgatcggacacactgggactgagacacggcccagactcctacgggagacagcagttaggaatattcgtcaatggaggaaactctgaacgagcaatgccgcgtgagtgatgaaggtcttatagatcgtaaaactctgttgtaaggaacgaaaccacgatat

SEQ ID NO: 2510 - DNA, 490 bp, Unknown
  Ascusbbf_1378037, encodes 16S rRNA
agagtttgatcctggctcaggacgaacgctggcggcgtgcctaacacatgcaagtcgaacgaagcactggaaatgattccttcgggttgattttcctttgactgagtggcggacgggtgagtaacacgtgagcaacctgcctttcagagcgggatagcagttggaaacgactgataataccgcatgacatgtctcttccgcatgagagagacatcaaatgatttttcgctgaaagatgggctcgcctccgattaggtagttggtgacgcaacggctcaccaagacgactatcggtagccggaactgagaggtggatcggcaaaattgggactgagtcacgggccagactccgccgggaggcagcagtgggggatattgcacaatgggcgcaagcctgatgcagcaacgccgcgtgagggaggacggtcttcggattgtaaacctctgtcattggggaagaaacaaatgacggtacccttggaggaagcca

SEQ ID NO: 2511 - DNA, 490 bp, Unknown
  Ascusbbf_285932, encodes 16S rRNA
agagtttgatcatggctcaggacgaacgctggcggcgtgcctaatacatgcaagtcgagcggacttgatgagaagcttgcttctctgagagttagcggcggacgggtgagtaacacgtaggcaacctgcctgtaagactgggataactaccggaaacggtagctaataccggataggtgattttctcgcatgagggaatcaagaaagacggagcaatctgtcacttacggatgggcctgcggcgcattagctagttggtgaggtaatggctcaccaaggcgacgatgcgtagccgacctgggagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtcttagagagtaactgctctaagagtgacggta

SEQ ID NO: 2512 - DNA, 490 bp, Unknown
  Ascusbbf_876044, encodes 16S rRNA
agagtttgatcctggctcaggatgaacgctagcgacaggcctaacacatgcaagtcgaatggaagagcttgcttttccatggcgaacgggtgagtaacacgtaggtaacctaccttaaggacgaggataacctttggaaacgaaggataatactggataggacattataaagcacatgcttaaatgtttaaaggagcaatccaccataagaggggcctgcggcgcattagctagttggtgagataaaggcccaccaaggcgatgatgcgtagctggactgagaggttgaacagccacaatgggactgagaacggcccatactcctacgggaggcagcagtagggaattttcggcaatgggcaaaagcctgaccgagcaatgccgcgtgatcgaagaagtatttcggtatgtaaagatcttttatcagggaagaaaaaacaaattgactgaacctgatgaataagctccggctaactacgtgccagcagcc

SEQ ID NO: 2513 - DNA, 490 bp, Unknown
  Ascusbbf_31389, encodes 16S rRNA
agagtttgatcatggctcaggatgaacgctggcggcgtgcttaacacatgcaagtcgaacgattaacccgccttcgggcggtcatagagtggcgaacgggtgagtaacacgtgaccgacctgccccatacaccgggacaaccgctggaaacggcggctaataccggatactccgcggatgccgcatggcgtgcgcgggaaagctccggcggtatgggatggggtcgcggcccatcaggtagacggcggggcaacggcccaccgtgccgacgacgggtagccgggttgagagaccgaccggccacattgggactgagatacggcccagactcctacgggaggcagcagtggggaattttgcgcaatgggggaaaccctgacgcagcaacgccgcgtgcgggacgaaggccttcgggttgtaaaccgctttcagcagggaagacatcgacggtacctgcagaagaagccccggctaaatacgtgccagcagc

SEQ ID NO: 2514 - DNA, 490 bp, Unknown
  Ascusbbf_177985, encodes 16S rRNA
agagtttgatcatggctcaggatgaacgctggcggcgtgcttaacacatgcaagtcgaacgaagcatgagtgaagagtaatcagatctcatgacttagtggcggacgggtgagtaacgcgtgggtaacctacctcacacagggggataacagttggaaacgactgctaaaaccgcataacatggcgataccgcatgacattgccatcaaatatttataggtgtgagatgggcccgcgtctgattagctagttggtgaggtaaaggcccaccaaggcgacgatcagtagccggcttgagagagtgaacggccacattgggactgagacacggcccaaactcctacgggaggcagcagtgggggatattggacaatgggggaaaccctgatccagcgacgccgcgtgagtgaagaagtatttcggtatgtaaagctctatcagcagggaagaaaaagcgcaagcattgactgtacctgactaagaagccccg

SEQ ID NO: 2515 - DNA, 490 bp, Unknown
  Ascusbbf_132670, encodes 16S rRNA
agagtttgatcatggctcaggatgaacgctggcggcgtgcctaatacatgcaagtcgaacgaagtacttcggtacttagtggcgaacgggtgagtaacacgtaggcaacctgcccatatgactgggataacagttggaaacgactgctaataccggataggtaagcgtatggcatcataagcttattaaagttgagatacacatatggatggacctgcggtgcattagttagttggtgaggtaacggcccaccaagacgatgatgcatagccgacctgagagggtgaccggccacactgggactgagacacggcccagactcctacgggaggcagcagtagggaattttcggcaatgggggcaaccctgaccgagcaacgccgcgtgagtgaagacggtcttcggattgtaaagctctgttgtaagggaagaatgttagtgatagtatcattaagtgacggtaccttaccagaaagtcacggctaactac

SEQ ID NO: 2516 - DNA, 490 bp, Unknown
  Ascusbbf_711960, encodes 16S rRNA
agagtttgatcatggctcaggatgaacgctggcggcgtgcctaacacatgcaagtcgaacggagatatcgcagcgagaggattcgtctgatcaagtggtatcttagtggcggacgggtgagtaacgcgtggagaacctgcctctttccgggggatagcagttggaaacgactggtaataccgcatgagcgcacggtaccgcatggtatagtgtgaaaagatttatcggggagagatggctccgcgtctgattagccagttggcggggtaacggcccaccaaagcgacgatcagtagccggcctgagagggcggacggccacattgggactgagacacggcccagactcctacgggaggcagcagtgggggatattgcacaatggggggaaccctgatgcagcgacgccgcgtgagtgaagaagtgtttcgacatgtaaagctctatcagcagggaagaaaggccctttaagggagatgacggtacctgac

SEQ ID NO: 2517 - DNA, 490 bp, Unknown
  Ascusbbf_532280, encodes 16S rRNA
agagtttgatcctggctcaggacgaacgctggcggcgtgcttaacacatgcaagtcgaacgaggttaagttgggagcttgctcttggcttaaccgagtggcggacgggtgagtaacgcgtgaggaacctgtctcacacaggggaataacgcatcgaaagatgtgctaataccgcatatgaccacagggtcgcatggcccaggggtgaaaggagcaatccggtgtgaggtggactcgcgtctgattagatagttggtgaggtaacggcccaccaagtcaacgatcagtagccgacctgagagggtgatcggccacagagggactgagacacggcccagactcctacgggaggcagcagtggggaatattgggcaatgggcgcaagcctgacccagcaacgccgcgtgaaggaagaaggttttcggatcgtaaacttctgtcctacatgaagagatagagacggtagtgtaggaggaagccccggctaacta

SEQ ID NO: 2518 - DNA, 490 bp, Unknown
  Ascusbbf_675430, encodes 16S rRNA
agagtttgatcctggctcaggatgaacgctggcggcgtgcttaacacatgcaagtcgaacgagaaagcaccctcgggtgcgagtagagtggcgaacgggtgagtaacacgtgagcaacctgccccccgcaccgggataaccgggcgaaagcccggctaataccggatgcacccggcaccgcgcatgcggggccggggaaagccctggcggcgggggatgggctcgcggcccattaggtagacggcggggtagcggcccaccgtgcccgcgatgggtagccgggttgagagaccgaccggccacattgggactgagacacggcccagactcctacgggaggcagcagtggggaattttgcgcaatgggggaaaccctgacgcagcaacgccgcgtgcgggatggaggccttcgggttgtaaaccgctttcagcagggaagacactgacggtacctgcagaagaagctccggctaactacgtgccagcagcc

SEQ ID NO: 2519 - DNA, 490 bp, Unknown
  Ascusbbf_9176, encodes 16S rRNA
agagtttgatcctggctcaggacgaacgctggcggcgtgcctaacacatgcaagtcgaacggagatatatcgaatgaagatttcggttggaatttgatatatcttagtggcggacgggtgagtaacgcgtgagtaacctgccgatgagagtggaataacgttctgaaaagaacgctaataccgcataacgtatcgaagccgcatgactttgataccaaagattttatcgctcatcgatggactcgcgtccgattagccagttggcggggtaacggcccaccaaagctacgatcggtagccggactgagaggttgaacggccacattgggactgagacacggcccagactcctacgggaggcagcagtgggggatattgcgcaatgggggaaaccctgacgcagcaacgccgcgtgaaggatgacggtcttcggattgtaaacttcttttgttgaggacgaagaaagtgacggtactcaacgaataagctc

SEQ ID NO: 2520 - DNA, 490 bp, Unknown
  Ascusbbf_3054, encodes 16S rRNA
agagtttgatcatggctcaggactaacgctggcggtgcgcctaacacatgcaagtcgtacgggctccttcgggagctagtggcagacgggtgagtaacgcgtaggtaatgtacctcttcgctggggatacctacctgaaaaggtggctaaaaccgaatgagcttttcaagcggcatcgcttgatttgcaaacctccggggcgaagagatcagcttgcgtactatcagctagtaggtgaggtaatggcttacctaggcttcgacggttagccggtctgagaggatgatcggccacattggaactgaaacacggtccagactcctacgggaggcagcagtgaggaatcttgcgcaatgggcgaaagcctgacgcagcgacaccgcgtgagggatgaaggtcttcggattgtaaacctttgtcagtggggacgagaacggacggtacccgctgaggaagcatcggcttactacgtgccagcagccgcggtaat

SEQ ID NO: 2521 - DNA, 490 bp, Unknown
  Ascusbbf_7363, encodes 16S rRNA
agagtttgatcatggctcaggatgaacgctagctacaggcttaacacatgcaagtcgagcggaatggcttcggccatttagcggcagacgggtgagtaacacgtatccaacctttcccttactcgggtatagcctcgggaaactgagagtaatccccgatgaagtgtacgaggagcattttttgcacaccaaagatttatcggtgaggggtggggatgcgttccattagttagtaggcggggcaacggcccacctagacgatgatggataggggttctgagaggaaggtcccccacattggaactgcgacacggtccaaactcctacgggaggcagcagtgaggaatattggtcaatggtcggaagactgaaccagccaagtagcgtgcaggatgacggccctatgggttgtaaactgcttttgtgcgggaataacggtctcctcgtgaggggatgtgcatgtaccgtacgaataaggatcggctaactc

SEQ ID NO: 2522 - DNA, 490 bp, Unknown
  Ascusbbf_96955, encodes 16S rRNA
agagtttgatcatggctcaggatgaacgctggcggcgtgcataacacattcaagtcgaacggtgaagtcccttcgggggcggaacagtggcggacgggtgagtaacgcgtgagcaacctgccgtatagtgggggataacacagggaaacttgtgctaataccgcatgacacaaggggatcgcatggtttccttgtcaaagatttattgctgtacgatgggctcgcgtatgattagacagttggcagggtaacggcctaccaaatcaacgatcattagccgaactgagaggttgaacggccacattggaactgagaaacggtccagactcctacgggaggcagcagtggggaatattgggcaatgggcgaaagcctgacccagcgacgccgcgtgagggaagaaggtcttcggattgtaaacctctttcagcagggaagaaaagatgacggtacctgcagaagaagtcacggctaactacgtgccagcagc

SEQ ID NO: 2523 - DNA, 490 bp, Unknown
  Ascusbbf_193349, encodes 16S rRNA
agagtttgatcctggctcaggacgaacgctggcggcgtgcctaatacatgcaagtcgcacgaacggcgacggaacttgttccgtcaaagttagtggcgcacgggtgagtaacacgtggagaacctacctttcagcgggggataaccattggaaacgatgactaataccgcataggacatctggtcacatgaccgggtgaggaaagacggcttcggctgtcactgaaagatggctccgcggagcattagctagatggtaaggtaacggcttaccatggccatgatgcatagccgacctgagagggtgatcggccacactgggactgagacacggcccagactcctacgggaggcagcagtagggaatcttccgcaatggacgcaagtctgacggagcaacgccgcgtgtgtgaagaaggtcttcggatcgtaaagcactgttgttagagaagaacacccggtagagtaactgctaccggcttgacggtatc

SEQ ID NO: 2524 - DNA, 490 bp, Unknown
  Ascusbbf_6916, encodes 16S rRNA
agagtttgatcctggctcaggatgaacgctggcggcgtgcctaacacatgcaagtcgaacgaataacccgccttcgggcggtcatagagtggcgaacgggtgagtaacacgtgaccaaccttccccccgcatggggataaccgggcgaaagcccggctaatacccaatactccgggccctccgcatggaggggccgggaaagcccaggcggcgggggatggggtcgcggcccattaggtagacggcggggtaacggcccaccgtgcccgcgatgggtagccggactgagaggtcgatcggccacattgggactgagatacggcccagactcctacgggaggcagcagtggggaattttgcgcaatgggggaaaccctgacgcagcaacgccgcgtgcgggatgaaggccctagggttgtaaaccgctttcagcagggaagaaacatgacggtacctgcagaagaagctccggctaactacgtgccagcag

SEQ ID NO: 2525 - DNA, 490 bp, Unknown
  Ascusbbf_9348, encodes 16S rRNA
agagtttgatcatggctcaggacgaacgctggcggcgtgcctaacacatgcaagtcgagcggagccaattaacagatcctttcggggtgacgttgaggaagcttagcggcggacgggtgagtaacgtgtgagtaacctgcctgtaagagggggataacacagagaaatttgtgctaataccgcatattgagcaattatcgcatggtaaatgcttgaaagatttatcgcttacagatggactcgcatctgattagctagttggcgaggtaacggctcaccaaggcgacgatcagtagccgaactgagaggttgatcggccacattgggactgagacacggcccagactcctacgggaggcagcagtgggggatattgcgcaatgggggcaaccctgacgcagcaacgccgcgtgatggaagaaggccttcgggttgtaaacatctgttgcaagggaagaaacaaatgacggtaccttgtgaggaagccacg

SEQ ID NO: 2526 - DNA, 488 bp, Unknown
  Ascusbbf_30539, encodes 16S rRNA
agagtttgatcctggctcagaacgaacgctggcggcatggattaggcatgcaagtcgaacgaagcagcaatgcttagtggcggaagggtgaggaacgcgtgagtaatctgccctcaagttgggaataacagctggaaacggctgctaataccgaatgtggctgttgggtcgcatgatctgacagttaaagatttattgcttgaggatgagctcgcgtcccattagctagttggcggggcaacggcccaccaaggcgatgatgggtagctggtctgagaggatggtcagccacactgggactgagacactgcccagactcctacgggaggctgcagtcgagaatcttgggcaatgcgcgaaagcgtgacccagcaatgccgcgtgcgtgatgaaggtcttcggatcgtaaagcgctgtcaaccgggacgaaagatgacggtaccggtgaaggaagccacggctaactacgtgccagcagccgcggtaat

SEQ ID NO: 2527 - DNA, 490 bp, Unknown
  Ascusbbf_5753, encodes 16S rRNA
agagtttgatcatggctcaggacgaacgctggcggcatgcctaacacatgcaagtcgaacggagttaaaggagcttgcttctttaacttagtggcggacgggtgagtaacgcgtgagcaacctgcctctaagtggggaataatgtactgaaaaggacactaataccgcataacatacagataccgcatgatatttgtatcaaagatttatcgcttagagatgggctcgcgtccgattagccggttggtggggtaacggcctaccaaagctacgatcggtagccggactgagaggttgaacggccacattgggactgagacacggcccagactcctacgggaggcagcagtgggggatattgcgcaatgggggaaaccctgacgcagcaatgccgcgtgaaggatgaaggtcttcggattgtaaacttcttttgttggggatgaaaaatgacggtacccaacgaataagctccggctaactacgtgccagc

SEQ ID NO: 2528 - DNA, 490 bp, Unknown
  Ascusbbf_14917, encodes 16S rRNA
agagtttgatcatggctcagattgaacgctagcgggatgctttacacatgcaagtcgaacggcagcgcgggctttcgggcctggcggcgagtggcgaacgggtgagtaatgtatcggaacgtgcccagtagcgggggataactactcgaaagagtggctaataccgcatacgccctacgggggaaagggggggattcttcggaacctctcactattggagcggccgatatcggattagctagttggtggggtaaaggcctaccaaggcgtcgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcagggaagaaaaggctctggttaatacctggagctgctgacggtacctgcagaataa

SEQ ID NO: 2529 - DNA, 484 bp, Unknown
  Ascusbbf_94282, encodes 16S rRNA
agagtttgatcctggctcagaacgaacgctggcggcaggtcttaggcatgcaagtcgaacggatgacagagagcttgctctctgaagtcagtggcgcacgagtgagtaacgcgtgggaaactgcccttcactggggaataacgtttggaaacgaacgctaataccgcatacgcccgcaaggggaaagatttatcggtgatggatgtgcccgcgttggattagccagttggtggggtaatggcctaccaaagcaatgatccatagctggtctgagaggacgatcagccacgctggaactgagacacggtccagactcctacgggaggcagcagctaagaatattggtcaatgggggaaaccctgaaccagccatgccgcgtgaatgaagaaggccttcgggttgtaaagttcttttagtcgtgaagatgatgacagtagcgacagaaaaagcaccggctaacttcgtgccagcagccgcggtaat

SEQ ID NO: 2530 - DNA, 490 bp, Unknown
  Ascusbbf_21924, encodes 16S rRNA
agagtttgatcctggctcaggacgaacgctggcggcgtgcttaacacatgcaagtcgagcggtaaggcccttcggggtacacgagcggcgaacgggtgagtaacacgtgagtaatctgcccttcacttcgggataactaccggaaacggtggctaataccggatatgactcccttctgcatggttgggggtggaaagttctggcggtgaaggatgtgctcgcggcctatcagcttgttggtgaggtaatggctcaccaaggcttcgacgggtagccggcctgagagggtgaccggccacactgggactgagacacggcccagactcctacgggaggcagcagtggggaatattggacaatgggcgaaagcctgatccagcaacgccgcgtgagggatgactgccttcgggttgtaaacctctttcagtaccgacgaagcgagagtgacggtaggtacagaagaagcaccggccaactacgtgccagcagc

SEQ ID NO: 2531 - DNA, 490 bp, Unknown
  Ascusbbf_51718, encodes 16S rRNA
agagtttgatcatggctcagaacgaacgttagcggcgcgcttaacacatgcaagtcgagcgagaaagggcttcggccccggtaaagcggcgcacgggtgagtaacacgtaggtaatctgccctcgagtggtggataactccccgaaaggggagctaatacagcatgagaccacgactctccggagttggggtcaaagcgggcctctccatggaagctcgtgcttgaggatgagcctgcggcccatcagcttgttggtggtgtaaaagacccccaaggctaagacgggtagctggtctgagaggatgaacagccacactggaactgagacacggtccagactcctacgggaggcagcagtggggaatcttgcgcaatgggcgaaagcctgacgcagcgacgccgcgtgagcgatgaaggccttcgggttgtaaagctctgtggagagggacgaataagggctggcgaatacccagtctgatgacggtacct

SEQ ID NO: 2532 - DNA, 490 bp, Unknown
  Ascusbbf_41961, encodes 16S rRNA
agagtttgatcatggctcaggacgaacgctggcggcgtgcttaacacatgcaagtcgaacggagacggtggagagcttgctcgaagctgtcttagtggcggacgggtgagtaacgcgtgaacaatctgtctcacacagggggataacgcatcgaaagatgtgctaataccgcgtaggaccacggggtcgcatgatcctgaggtgaaaggagaaatccggtgtgaggtgagttcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgaaagcctgacccagcaacgccgcgtgaaggaagaaggttttcggatcgtaaacttctgtccttggtgaagataatgacggtagccaaggaggaagccccggctaactacgtg

SEQ ID NO: 2533 - DNA, 490 bp, Unknown
  Ascusbbf_156304, encodes 16S rRNA
agagtttgatcctggctcaggatgaacgctggcggcgcgcttaacacatgcaagtcgaacggaatttgtaacttcggttgtggattcagtggcggacgggtgagtaacacgtggataacttgccttttagtgggggatagctgagagaaatctcaattaataccgcataatgtaatttgttcgcatgaatagattaataaagatgaaaatcgctaagagataggtctgcgtctgattagctagttggagtggtgatggcacaccaaggcgacgatcagtaaccggtttgagagaatgaacggtaacattgggactgagatacggcccagactcctacgggaggcagcagtggggaatattgcgcaatggaggaaactctgacgcagcgacgccgtgtgaaggatgaaggccttcgggttgtaaacttttatcgattgtgaaaagaatggatggtagcaaagtaagaagctccggctaattacgtgccagc

SEQ ID NO: 2534 - DNA, 490 bp, Unknown
  Ascusbbf_31105, encodes 16S rRNA
agagtttgatcctggctcaggatcaacgctggcggcgtgcctaatgcatgcaagtcgaacggggtcgccttcgggcggctcacgtggcggacgggtgaggaacacgtgggcgatctgccccgaggtgggggatagccaccagaaatggtgggtaaaaccgcatgagctcgccgggttgcgacctggtgaggaaagcccttcggggtgccttgggaggagcctgcggcggattagctagttggtggggtaacggcgtaccaaggcgatgatccgtagctggtctgagaggatgaccagccacaggggaactgagacacggtccccactcctacgggaggcagcagcaaggaattttccgcaatgggcgaaagcctgacggagcaacgccgcgtgggggatgacgcttttcggagtgtaaaccccttttctcagggaagaacacaatgacggtacctgaggaataaggaccggctaactacgtgccagcagc

SEQ ID NO: 2535 - DNA, 490 bp, Unknown
  Ascusbbf_67680, encodes 16S rRNA
agagtttgatcatggctcaggatgaacgctggcggcgtgcttaacacatgcaagtcgaacggagatgcgtgatagaagttttcggatggaaatcacacatcttagtggcggacgggtgagtaacacgtaaataatctgccttcaagagtgggataacagatagaaatatttgctaataccgcataagaccacaggttcgcatgaactaggggtaaaaggagcaatccgcttgaagatgagtttgcggactattagctagttggtagggtaaaggcctaccaaggctgagatggatagccgacctgagagggtgaacggccacactggaactgagatacggtccagactcctacgggaggcagcagtgaggaatattgggcaatggaggaaactctgacccagcaacgccgcgtgaaggaagaaggttttcggattgtaaacttctgttatggaggaaaaaggaagtgatggtactccatgagcaagctac

SEQ ID NO: 2536 - DNA, 470 bp, Unknown
  Ascusbbf_17274, encodes 16S rRNA
agagtttgatcatggctcagaacgaacgctggcggcaggcttaacacatgcaagtcgaacgatgtcttcggacatagtggcagacgggtgagtaacacgtgggaacgtaccttccagtcgggaataactcagggaaacttgagctaataccggatacgcccttttggggaaagatttatcgctggaagatcggcccgcgtctgattagctagttggtggggtaatggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgacggccttagggttgtaaagctctttcgctcgcgacgataatgacggtagcgagagaagaagccccggctaacttcgtgccagcagccgcggtaat

SEQ ID NO: 2537 - DNA, 490 bp, Unknown
  Ascusbbf_1824631, encodes 16S rRNA
agagtttgatcatggctcaggatgaacgctggcggcgtgcttaacacatgcaagtcgaacggagttaagagaagcttgcttttcttaacttagtggcggacgggtgagtaacgcgtgagcaatctgcctttcagtggggaataatgttctgaaaagagcactaataccgcataaagtatcgttgccgcatgacgatggtaccaaagatttatcgctgagagatgagctcgcgtccgattagccagttggtggggtaacggcctaccaaagcgacgatcggtagccggactgagaggttgaacggccacattgggactgagacacggcccggactcctacgggaggcagcagtgggggatattgcgcaatgggggaaaccctgacgcagcaatgccgcgtgaaggatgaaggtcttcggattgtaaacttcttttgtcagggacgaacaatgacggtacctgacgaataagctccggctaactacgtgcca

SEQ ID NO: 2538 - DNA, 472 bp, Unknown
  Ascusbbf_29334, encodes 16S rRNA
agagtttgatcatggctcagaacgaacgctggcggcaggcctaaaacatgcaagttgaacggttacagcaatgtagcagtagcggacgggtgaggaacatatgggaacatgccttttggtgtggaataacatctggaaacgggtgataataccgcataagccctttgggggaaagatttatcgccggaagagtggcccatatcagattagctagttggttaggtaacggctgaccaaggcgacgatctgtagccggtttgagaggatgatcggccacactgggactgagacacggcccagactcctacgggaggcagcagttaggaatattggacaatgggggaaaccttgatccagccatgccgcgtgagtgaagaaggccttcgggttgtaaagctcttttgtatgggaaaatgatgatggtaccataagaataagcaccggcaaacttcgtgccagcagccgcggtaat

SEQ ID NO: 2539 - DNA, 490 bp, Unknown
  Ascusbbf_61427, encodes 16S rRNA
agagtttgatcatggctcaggatgaacgctggcggcatgcctaacacatgcaagtcgaacggagttgaggagtagcttgctatgaatcaacttagtggcggacgggtgagtaacgcgtgagtaacctgcctcttagagggggataacgttctgaaaaggacgctaataccgcatataattacgaaatcgcatggttttgtaatgaaaggagcaatccgctaagagatggactcgcgtctgattagctagatggtggggtaacggctcaccatggcgacgatcagtagccggactgagaggttgaacggccacattgggactgagacacggcccagactcctacgggaggcagcagtgggggatattacgcaatgggggaaaccctgacgtagcaatgccgcgtgaaggaagaaggttttcggattgtaaacttcttttgtcagggacgataatgacggtacctgacgaataagctccggctaactatgtg

SEQ ID NO: 2540 - DNA, 490 bp, Unknown
  Ascusbbf_154589, encodes 16S rRNA
agagtttgatcatggctcagattgaacgctggcggcgtgcttaacacatgcaagtcgaacgcgaaaggggcttcggtcccgagtagagtggcgcacgggtgagtaacgcgtggatgatctgcccctgcagctggaatagcgactggaaacggtcgataataccggatacgcccttgttgaacgatgaggggaaaggagacctctgcttgcaagtttccgtgcagggatgagtccgcgtcccattagcttgttggcggggtaacggcccaccaaggcgacgatgggtagccgatttgagaggatgatcggccacattggaactgaaacacggtccaaactcctacgggaggcagcagtggggaatattgcgcaatgggcgaaagcctgacgcagcgacgccgcgtgagggatgaaggtcttcggatcgtaaacctctgtcggaagggaaaaaggtgcagggtgccaatcagccctgcattgatggtacctt

SEQ ID NO: 2541 - DNA, 490 bp, Unknown
  Ascusbbf_57807, encodes 16S rRNA
agagtttgatcatggctcaggacgaacgctggcggcatgcctaacacatgcaagtcgaacggagccaaccggacaatcccttcggggtgcgactggggaagcttagtggcggacgggtgagtaacgcgtgagtaacctgccttcaagaggggaataacacatcgaaaggtgtgctaataccgcataacgcatatttgccgcatgacagatatgccaaagatttatcgcttgaagatggactcgcgtctgattagctagttggtgaggtaacggctcaccaaggcgacgatcagtagccgaactgagaggttgatcggccacattgggactgagacacggcccagactcctacgggaggcagcagtgggggatattgcgcaatgggggcaaccctgacgcagcaatgccgcgtgaaggatgaaggtcttcggatcgtaaacttttgtcttatgggaagaataatgacggtaccataggaggaagccacggc

SEQ ID NO: 2542 - DNA, 490 bp, Unknown
  Ascusbbf_73665, encodes 16S rRNA
agagtttgatcatggctcaggatgaacgctagctacaggcttaacacatgcaagtcgaggggcagcgggagagtagcttgctactcttgccggcgaccggcgaatgggtgagtaacgcgtatccaacctgccacatgcccgggaatagcccttggaaatgaggattaagtcccgatatgcttatttgtcgcatgacatgtaagtgaaacaggcatgtgatggggatgcgtccgattagcttgccggcggggtaacggcccaccggggcttcgatcggtaggggttctgagaggaaggtcccccacactggtactgagacacggaccagactcctacgggaggcagcagtgaggaatattggtcaatgggcgagagcctgaaccagccaagtagcgtgcaggatgacggccctacgggttgtaaactgctttttccggggaataaccggcgtcacgtgtggcgccctgcatgtacccggtgaataaggacc

SEQ ID NO: 2543 - DNA, 486 bp, Unknown
  Ascusbbf_37006, encodes 16S rRNA
agagtttgatcatggctcagaacgaacgctggcggcaggcttaacacatgcaagtcgaacggaacatattgtgcttgcacagtatgtcagtggcgcacgggtgagtaacgcgtgggaagatgtcttattgacggggatagcctctggaaacggagggtaatacccgataagccctgagggggaaaggaagaaatttgcgataagagttgcccgcgtctgattaggcagttggtggggtaacggcctaccaaaccgacgatcagtagccggtctgagaggatgatcggccacattgggactgagacacggcccaaactcctacgggaggcagcagtggggaatattggacaatggggggaaccctgatccagccatgccgcgtgagtgatgacggccttcgggttgtaaagctcttttaggcgagacgataatgacggtatcgccagaataagcaccggctaacttcgtgccagcagccgcggtaat

SEQ ID NO: 2544 - DNA, 490 bp, Unknown
  Ascusbbf_112536, encodes 16S rRNA
agagtttgatcctggctcaggatgaacgctggcggcaggcttaatacatgcaagtcggacggtaacgcgccggtagcaataccggtggcgacgagtggcgcacgggtgcgtaacgcgtatgcaacctacccataacagggacaaaacgttgagaaatcggcgctaatatcccatgtggatgactccgggcatccggagtcatttaaaggcgcgagctggttatggatgggcatgcgtatcattagctggttggcggggtgacggcccaccaaggcgacgatgattaggggttctgagaggatggtcccccacactggaactgagacacggtccagactcctacgggaggcagcagtagggaatattgggcaatggtcggaagactgacccagccatgccgcgtgaaggaatacggccctatgggtcttaaacttcttttatcgcagagtaaccgcggggacgcgtccctgcctgcaagtatgcgatgaat

SEQ ID NO: 2545 - DNA, 490 bp, Unknown
  Ascusbbf_286251, encodes 16S rRNA
agagtttgatcctggctcaggatgaacgctggcggcatgcctaagacatgcaagtcgtacgaggtggccctttgaactctgtacttgtatagagcgatttggatctccacctagtggcgaaagggtgagtaacacgtgggttatctacctcagagactgggataactactggaaacggtagctaataccggatgatatatacaatgatacgttattgtatagtaaaaggtgcctttaaagcattactttgagatgagcctgcgctgtattagctagttggtaaggtaacggcttaccaaggcgacgatgcatagccgacctgagagggtgatcggccacactgggactgagacacggcccagactcctacgggagacagcagttagggatattcgtcaatggaggaaactctgaacgagcaatgccgcgtgagtgatgacagttctttggattgtaaaactctgttgttagggaagaacgacctatatag

SEQ ID NO: 2546 - DNA, 490 bp, Unknown
  Ascusbbf_99899, encodes 16S rRNA
agagtttgatcatggctcagaacgaacgctggcggcgcgtcttaagcatgcaagtcgagcgggaatagaggtgcttgcacttctatgagagcggcggactggtgagtaacacgtaggcaacgtacccttcggacggggatagccggcagaaatgtcgggtaataccggatgtgaacatgagccgtaaaggttcatgtggaaaggagcttcggctccgccggaggagcggcctgcggcccatcagcttgttggcggggtaaaggcccaccaaggcgatgacgggtatccggcctgagagggtgaacgggcacattgggactgagatacggcccagactcctacgggaggcagcagctaagaatattccgcaatgggggaaaccctgacggagcgacgccgcgtggacgatgaaggccggaaggttgtaaagtcctttagtctgtgaggaataaggagcggagggaatgccgttccggtgactgtagcagga

SEQ ID NO: 2547 - DNA, 490 bp, Unknown
  Ascusbbf_217427, encodes 16S rRNA
agagtttgatcatggctcagaacgaacgctggcggcgcgtcttaagcatgcaagtcgagcggcaagaaggtgcttgcatcttcctagagcggcggactggtgagtaacacgtaggtgacgcaccctccggacggggatagcctgtggaaacacagggtaataccggatacggttccgtaagctggagttacggaaggaaaggagcctcggctccgccggaggagcggcctgcggcccatcagctggttggcggggtaacggcccaccaaggctacgacgggtatccggcctgagagggtgagcgggcacattgggactgagatacggcccagactcctacgggaggcagcagctaagaatattccgcaatgcgcgaaagcgtgacggagcgacgccgcgtggacgatgaaggccggaaggttgcagagtcctttggcgcccgaggaaagaacgcggcagggaatggccgcggattgactgtagggcgaga

SEQ ID NO: 2548 - DNA, 490 bp, Unknown
  Ascusbbf_76074, encodes 16S rRNA
agagtttgatcatggctcaggatgaacgctggcggcgtgcctaacacatgcaagtcgaacggagatattacggatgagggattcgtctggattctgttttatcttagtggcggacgggtgagtaacgcgtggagaacctgcctctttccgggggatagcagttggaaacgactggtaataccgcatgagcgcacagtaccgcatggtacggggtgaaaagatttatcgggaagagatggctccgcgtctgattagccagttggcggggtaacggcccaccaaagcaacgatcagtagccggcctgagagggcggacggccacattgggactgagacacggcccagactcctacgggaggcagcagtgggggatattgcacaatggggggaaccctgatgcagcgacgccgcgtgagtgaagaagtgtttcgacatgtaaagctctatcagcagggaagaaagacccgcaagggggatgacggtacctgac

SEQ ID NO: 2549 - DNA, 490 bp, Unknown
  Ascusbbf_255979, encodes 16S rRNA
agagtttgatcatggctcaggatgaacgctggcggcgtgcttaacacatgcaagtcgaacggagttaagcgctgaatgaggcttcggcggatttcttgcttaacttagtggcggacgggtgagtaacgcgtgagtaacctgccctcgagtggggaataacgttctgaaaaggacgctaataccgcataatatatgtttgtcgcatggcagacatatcaaagatttatcgctcgaggatggactcgcgtccgattagcttgttggcggggtaacggcccaccaaggcgacgatcggtagccggactgagaggttgaacggccacattgggactgagacacggcccagactcctacgggaggcagcagtgggggatattgcgcaatgggggaaaccctgacgcagcaacgccgcgtggaggatgacggttttcggattgtaaactccttttataagggacgaactaagacggtaccttatgaataagctccg

SEQ ID NO: 2550 - DNA, 490 bp, Unknown
  Ascusbbf_120371, encodes 16S rRNA
agagtttgatcatggctcaggatgaacgctagcggcaggcttaacacatgcaagtcgaggggcagcgcgggtagcaatatctggcggcgaccggcgaaagggtgagtaacgcgtgagcaacatgcccgtctgagggggatagtcgatggaaacgtcgcgtaataccccgtaacataagggaccgcatgatcctttattgaaagattcatcgcagacggattggctcgcgtaccattagctagttggcggggtaacggcccaccaaggcgacgatggttaggggttctgagaggaaggtcccccacattggaactgagacacggtccagactcctacgggaggcagcagtgaggaatattggtcaatggccgagaggctgaaccagccatgccgcgtgcgggaagacggccctatgggttgtaaaccgcttttttgagggagcaataaggcccacgagtgggtcgatgagagtaccttgagaataagcatc

SEQ ID NO: 2551 - DNA, 490 bp, Unknown
  Ascusbbf_59049, encodes 16S rRNA
agagtttgatcatggctcaggattaacgctggcggcgtgcctaatacatgcaagtcgaatggtagcaataccatggcgaacgggtgagtaacacgtaggtaacctgtctaaaagacgaggataaccattggaaacgatggataatactggataggacatttgaaggcatctttgaatgtttaaagatttatcactttaagaggggcctgcggcgcattagctagttggtgaggtgaaggctcaccaaggcgatgatgcgtagccggactgagaggttgaacggccacaatggaactgagaacggtccatactcctacgggaggcagcagtagggaattttcggcaatgggcgaaagcctgaccgagcaacgccgcgtgaacgaagaagtatttcggtatgtaaagttcttttattagggacgaaaaagttagaattgacggtacctaatgaataagctccggctaactacgtgccagcagccgcggtaat

SEQ ID NO: 2552 - DNA, 490 bp, Unknown
  Ascusbbf_61871, encodes 16S rRNA
agagtttgatcatggctcaggacgaacgctggcggcgtgcttaacacatgcaagtcgagcggaaaggccccttcgggggtactcgagcggcgaacgggtgagtaacacgtgagcaacctgcccctgactctgggataagcctgggaaactgggtctaataccggatatgactcgcggccgcatggtctgcgggtggaaagatttattggttggggatgggctcgcggcctatcagcttgttggtggggtgatggcctaccaaggcgacgacgggtaaccggcctgagagggcgaccggtcacactgggactgagacacggcccagactcctacgggaggcagcagtgggaatattgcgcaatgggcggaagcctgacgcagcgacgccgcgtgggggatgacggccttcgggttgtaaacctctttcagcatcgacgaagcctttcggggtgacggtaggtgcagaagaagcgccggctaactacgtgcc

SEQ ID NO: 2553 - DNA, 490 bp, Unknown
  Ascusbbf_115211, encodes 16S rRNA
agagtttgatcatggctcaggatgaacgctggcggcgtgcttaacacatgcaagtcgaacggactcttatcgacagaagtatttatacggacgttggtaggcgttagtggcggacgggtgagtaacgcgtgggaaacctgccctattccgggggataccagttggaaacgactgttaataccgcataagcgcacattgccgcatggcagagtgtgaaaaactccggtggaataggatggtcccgcgtctgattaggcagttggcggggtaacggcccaccaaaccgacgatcagtagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaagatgacggtacctgcacaagaagccccggc

SEQ ID NO: 2554 - DNA, 489 bp, Unknown
  Ascusbbf_224473, encodes 16S rRNA
agagtttgatcatggctcaggacgaacgctggcggcgtgcctaatacatgcaagtcgagcgaggaacttcggttcctagcggcgaacgggtgagtaacacgtgggcaacctgccctcaagcctgggataactccgggaaaccggggctaacaccagataatcttttctttcgcatgaaagagaagtaaaagtttacacttgaggatgggcccgcgttgcattagctagttggtggggtaaaggcctaccaaggcgacgatgcatagccgacctgagagggtgaccggccacactgggactgagacacggcccagactcctacgggaggcagcagtagggaattttccgcaatgggggcaaccctgacggagcaacgccgcgtgagtgaagacggtcttcggattgtaaagctctgttcttggggaagaaaacaatgacggtacccaagcagaaagccccggctaactacgtgccagcagccgcggtaat

SEQ ID NO: 2555 - DNA, 490 bp, Unknown
  Ascusbbf_53125, encodes 16S rRNA
agagtttgatcatggctcaggacgaacgctggcggcgtgcctaacacatgcaagtcgaacgggacttaattccggaagttttcggatggaaaggattaagtttagtggcggacgggtgagtaacgcgtgagtaacctgcctttcagagggggataacgtactgaaaaggacgctaataccgcataatatattgaagtcgcatgattttaatatcaaaggagcaatccgctgaaagatggactcgcgtccgattagctggttggtgagataaaggcccaccaaggcgacgatcggtagccggactgagaggttgaacggccacattgggactgagacacggcccagactcctacgggaggcagcagtgggggatattgcgcaatgggggaaaccctgacgcagcaacgccgcgtgaaggaagacggttttcggattgtaaacttcttttgtcagggacgaaaaatgacggtacctgacgaataagctccgg

SEQ ID NO: 2556 - DNA, 490 bp, Unknown
  Ascusbbf_1878586, encodes 16S rRNA
agagtttgatcatggctcaggatgaacgctagcggcaggcctaatacatgcaagtcgaacggtaagcggcccttcgggaccgcgagagtggcggacgggtgcgtaacgcgtatgcaaccaacccccctcaccgggatagccggtggaaacgccggataagaccggatgcgccgcgagggaggcatctcccatgcggcaaggcggcgacgcggagggggacgggcatgcgtgccattagcttgttggcggggcgacggcccaccaaggcgacgatggctaggggatctgagaggacggtcccccacactggtactgagacacggaccagactcctgcgggaggcagcagtaagggatattggtcaatggggggaaccctgaaccagccatgccgcgtgagggaatgaggccctacgggtcgtgaacctcttttgcccggggacaacacggcgcacgtgatgcgccgacgagggtaccgggcgaataagcat

SEQ ID NO: 2557 - DNA, 488 bp, Unknown
  Ascusbbf_61601, encodes 16S rRNA
agagtttgatcctggctcagaacgaacgctggcggcaggccttagatatgcaagttgaacggtctaaggtggagcttgctctactttagatagtagcggacgggtgagtaatacatgggaacgtaccctcttgtggggaatagcttttggaaacgaaaggtaataccgcataagccctacgggggaaaggagtaattcgcgagaggatcggcccatgccagattagcttgttggtgaggtaacggcttaccaaggctacgatctgtagctggtttgagaggatgatcagccacattgggactgagacacggcccaaactcctacgggaggcagcagccaggaatattggacaatgggggaaaccctgatccagccatgccgcgtgagtgaagaaggtcttcggattgtaaagctcttttgtacgggaagatgatgacggtaccgtaagaataagcaccggctaacttcgtgccagcagccgcggtaat

SEQ ID NO: 2558 - DNA, 490 bp, Unknown
  Ascusbbf_192545, encodes 16S rRNA
agagtttgatcatggctcaggatgaacgctagctacaggcttaacacatgcaagtcgaggggcagcgtgtacagatgcttgcatcagtatgacggcgaccggcgcacgggtgagtaacgcgtatccaacctgccatatactcgggtatagcccggtgaaaaccgaattaacccccgatagtgtcctttgcaggcatctaattaggactaaagtttacggtatatgatggggatgcgtctgattagcttgttggcggggtaacggcccaccaaggctacgatcagtaggggttctgagaggaaggtcccccacattggtactgagacacggaccaaactcctacgggaggcagcagtgaggaatattggtcaatgggcggaagcctgaaccagccaagtagcgtgcaggatgacggccctatgggttgtaaactgcttttgtcagggaacaaagtgagggacgtgtccctttttgcgtgtacctgtcgaat

SEQ ID NO: 2559 - DNA, 490 bp, Unknown
  Ascusbbf_78853, encodes 16S rRNA
agagtttgatcatggctcagaacgaacgctggcggcgcgtcttaagcatgcaagtcgaatggcaagattggtgcttgcaccgatcctagaatggcagactggtgagtaacacgtgggtgacataccctccggatggggacagctgttagaaatagcaggtaataccgaatacgcttacacaggttagagtggtgtaaggaaaggtgctttggcaccaccggaggaatggctcgcggcccattagctagttggtgaggtaacggcccaccaaggcaatgatgggtatccggcctaagagggtgaacggacacattgggactgagatacggcccagactcctacgggaggcagcagctaagaatattccgcaatggacgaaagtctgacggagcgacgccgcgtggatgatgaaggccgaaaggttgtaaaatccttttgaaccggacgaataatgagtgtagggaatgacattcaggtgacggtacggttt

SEQ ID NO: 2560 - DNA, 490 bp, Unknown
  Ascusbbf_188096, encodes 16S rRNA
agagtttgatcatggctcagaacgaacgctggcggcgcgtcttaagcatgcaagtcggacggcaagattggtgcttgcactaatcctagagtggcggactggtgagtaacgcgtgggtgacgtaccctccggacggggatagcctgtggaaacacaggataataccggatacggtgtcatgtgtcagaggcatgacaggaaaggttcttttgaaccgccggaggagcggcccgcggactattagctagttggtgaggtaacggcccaccaaggcgacgatagttacccggcctaagagggtgaacgggcacattgggactgagatacggcccagactcctacgggaggcagcagctaagaatattccgcaatgggggaaaccctgacggagcgacgccgcgtggatgatgaaggccggaaggttgtaaaatccttttgggagcgaggaataaggaaagtgagagaaacgctttccggtgacggtagcttc

SEQ ID NO: 2561 - DNA, 490 bp, Unknown
  Ascusbbf_130045, encodes 16S rRNA
agagtttgatcatggctcaggacgaacgctggcggcgtgcttaacacatgcaagtcgagcggaaaggcccttcggggtactcgagcggcgaacgggtgagtaacacgtgagtaacctgcccctgactctgggataagcctgggaaaccgggtctaataccggatacgacactcctccgcatggtgtgggtgtggaaagttttttcggttggggatgggctcgcggcctatcagcttgttggtggggtgatggcctaccaaggcgacgacgggtagccggcctgagagggcgaccggccacactgggactgagacacggcccagactcctacgggaggcagcagtggggaatattgcgcaatgggcggaagcctgacgcagcgacgccgcgtgggggatgacggccttcgggttgtaaacctctttcagcagggacgaagttgacgtgtacctgtagaagaagcgccggctaactacgtgccagcagccgc

SEQ ID NO: 2562 - DNA, 490 bp, Unknown
  Ascusbbf_79554, encodes 16S rRNA
agagtttgatcatggctcaggacgaacgctggcggcgtgcttaacacatgcaagtcgaacgagaatctagtgaaagaggtttcggccgatggagctagaggaaagtggcggactggtgagtaacgcgtgagcaacctgcccttcagagggggacaacagttggaaacggctgctaataccgcatgaggcatatttttcgcatgggagatatgttaaagatttatcgctgagggatgggctcgcgtctgattagctagttggtggggtaatggctcaccaaggcgacgatcagtagccggactgagaggttgaccggccacattgggactgagatacggcccagactcctacgggaggcagcagtggggaatattgggcaatggacgcaagtctgacccagcaacgccgcgtgaaggaagaaggtcttcggattgtaaacttctttgacaggggaagagaaggagacggtaccctgaaaacaagccacggc

SEQ ID NO: 2563 - DNA, 490 bp, Unknown
  Ascusbbf_429794, encodes 16S rRNA
agagtttgatcatggctcaggatgaacgctggcggcgtgcctaacacatgcaagtcgaacgaagcatgtttgaagtaagttttcggacgagcggaagacatgactgagtggcggacgggtgagtaacgcgtgggtaacctgccccatacagggggacaacagagggaaacttctgctaataccgcataagcgcacggatctgcatggatctgtgtgaaaagctgaggcggtatgggatgggcccgcgttggattaggcagttggcggggtaacggcccaccaaaccgacgatccatagccgacctgagagggtgaccggccacattgggactgagacacggcccagactcctgcgggaggcagcagtgggggatattgcacaatgggggaaaccctgatgcagcgacgccgcgtgagtgaagaagtatttcggtatgtaaagctctatcggcagggaagaagatgacggtacctgcagaagaagctccgg

SEQ ID NO: 2564 - DNA, 490 bp, Unknown
  Ascusbbf_108324, encodes 16S rRNA
agagtttgatcatggctcagagcgaacgctagcggcatgctttatacatgcaagtcgaacgaatgagtttatattgagtagcaatacgatttatgaatgagttagtggcgaacgggtgagtaatatataggaatttgcccagtagtgggggacaacagttagaaatgactgctaataccgcatacgtccgagaggagaaagatttatcgctattggagaagcctatacacgattagcttgttggtggggtaaaggcctaccaaggctgtgatcgttagccggtcttagaggatgatcggccacattgggactgagacacggcccagactcctacgggaggcagcagtagggaatattggacaatggacgcaagtctgatccagcaatgccgcgtgagtgatgaaggtgttatgcattgtaaaactcttttgcctgtgaagataatgacggtaacaggagaataagcaccgactaactatgtgccagcagc

SEQ ID NO: 2565 - DNA, 490 bp, Unknown
  Ascusbbf_256558, encodes 16S rRNA
agagtttgatcatggctcaggacgaacgctggcggcacgcttaacacatgcaagtcgaacggagtttagagagcttgctttttaaacttagtggcggacgggtgagtaacacgtgagcaacctgccttcaagcgaggaataatgagtggaaacgctctgtaatacctcataacgtatttttaccgcatgataggaataccaaagatttatcacttgaagatgggctcgcgtccgattagctagttggtgaggtaacggctcaccaaggcgacgatcggtagccgtactgagaggtagatcggccacattgggactgagacacggcccagactcctacgggaggcagcagtggggaatattgcacaatggaggaaactctgatgcagcgatgccgcgtgagcgaagaaggccttttggttgtaaagctctgttatcagggacgaaaatgacggtacctgaggaggaagctccggctaactacgtgccagca

SEQ ID NO: 2566 - DNA, 468 bp, Unknown
  Ascusbbf_396430, encodes 16S rRNA
agagtttgatcctggctcagaacgaacgctggcggcaggcataacacatgcaagtcgaacgccccgcaaggggagtggcagatgggtgagtaacgcgtgggaatctaccgtaccctacggaataacgcatggaaacgtgtgctaataccgtatacgccctacgggggaaagatttatcggggtatgatgagcccgcgttggattagctagttggtggggtaaaggcctaccaaggcgacgatccatagctggtctgagaggatgatcagccacattgggactgagacacggcctaaactcctacgggaggcagcagtggggaatattggacaatgggcgcaagcctgatccagccatgccgcgtgagtgatgaaggtcctaggattgtaaagctctttcaccgatgaagataatgacggtagtcggagaagaagccccggctaacttcgtgccagcagccgcggtaat

SEQ ID NO: 2567 - DNA, 490 bp, Unknown
  Ascusbbf_289866, encodes 16S rRNA
agagtttgatcatggctcaggatgaacgctagcggcaggcctaacacatgcaagtcgaggggcatcacgggggagcttgcttccctggtggcgaccggcgcacgggtgaggagcacgtatggaacctgcccctgtcaggggaatagcccagggaaacttggattaatgccccatggtaccgggatatcgcatgatatcacggttaaagatttatcggacagggatggccatgcgcaccattagctagttgggggggtaacggcccaccaaggcgacgatggttaggggccctgagagggggatcccccacactggtactgagacacggaccagactcctacgggaggcagcagtgaggaatattggacaatggccgagaggctgatccagccatgccgcgtgcaggatgaccgccctatgggtcgtaaactgcttttgtacgggaagaaacccccccacgtgtggggggctgacggtaccgtaagaataa

SEQ ID NO: 2568 - DNA, 490 bp, Unknown
  Ascusbbf_1390105, encodes 16S rRNA
agagtttgatcctggctcaggacgaacgctggcggcatgcttaacacatgcaagtcgaacgggacgttgacaaatcagcgatgaggcggagacgtttagtggcgaacgggtgagtaacgcgtgagcaacctgccttgtacaccgggataccgaagggaaactttcgttaatacgggataagaccacagcaccgcatggtgcaggggtcaaagcgaattagcggtacaagatgggctcgcgtcccattagctagttggcgggataacagcccaccaaggcgacgatgggtagccgacttgagagagggatcggccacaatggaactgagacacggtccatactcctacgggaggcagcagtggggaatattgggcaatgggcgcaagccttacccagcaatgccgcgtgaatgaagaaggtcttcggattgtaaagttcttttattagtgacgaacgcaatgacggtagctaatgaataagccccggctaa

SEQ ID NO: 2569 - DNA, 487 bp, Unknown
  Ascusbbf_107597, encodes 16S rRNA
agagtttgatcatggctcagaacgaacgctggcggcatgcttaacacatgcaagtcgaacgatgttttttagtacttgtattaaggaacatagtggcaaacgggtgagtaacgcgtgggaatgtaccctttagtattgaataacgtttggaaacgaacgctaatacaatataacctcgagagagcaaagagaaatcgctgaaggagcagcccgcgttagattaggtagttggtggggtaaaggcctaccaagcctgcgatctatagctggtctgagaggatgaacagccacattgggactgagacacggcccagactcctacgggaggcagcagtggggaatattggacaatgggggaaaccctgatccagcaatgccgcgtgagtgaagaaggccttcgggtcgtaaaactctttaacaagtgaagataatgacggtaacttgtggaaaaagctccggctaacttcgtgccagcagccgcggtaat

SEQ ID NO: 2570 - DNA, 490 bp, Unknown
  Ascusbbf_304759, encodes 16S rRNA
agagtttgatcctggctcaggatgaatgctggcggcgtgcctaatacatgcaagtcgaacggtaacagggtctcactgttctcttgacgctcttggcctattggtaagagttatagattcgagggaactgtgagattgctgacgagtggcggacggctgagtaacgcgtgggaacataccctaaactgagggataactagtcgaaagattagctaataccgcatattatctacggatcaaagtcttcggacggtttaggaatggcctgcgtacgattagatagttggtgaggtaaaggctcaccaagtcgacgatcgttagatggtttgagaggatgatcatccagactgggactgagacacggcccagactcctacgggaggcagcagtagggaatctttcacaatgggcgaaagcctgatggagcaacgccgcgtgcaggatgaaggccttcgggttgtaaactgcttttatttccgagaaatatgat

SEQ ID NO: 2571 - DNA, 490 bp, Unknown
  Ascusbbf_218570, encodes 16S rRNA
agagtttgatcctggctcaggacaaacgctggcggcgtgcctaacacatgcaagtcgaacgagaatcttcggaaagagacttcggtcaatggaaggagaggacagtggcggacgggtgagtaatgcatgagcaacctgccttggagtgggggacaacagttggaaacgactgctaataccgcatgaagttacgggggggcatcctcctgtaaccaaagatttatcgctctgagatgggctcatgtctgattagatagttggcggggcaacggcccaccaagtctgcgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttatcagggacgaaggatgtgacggtacctgatgaataagccacgg

SEQ ID NO: 2572 - DNA, 490 bp, Unknown
  Ascusbbf_420293, encodes 16S rRNA
agagtttgatcatggctcagaatgaacgttagcggcgtggattaggcatgcaagtcgagcgacaaggtcagatggatcccttcggggtgaagtctgactggaggagcggcaaacggggtagtaaggcgtcggaacgtaccctggggaccaggatagccgcgggaaactgcgtgtaatactggataacctctgtggagcaaatggtttattccgccacaggagcggccgacgtgatactaggtagttggtaaggtaatggcttaccaagcctttgatgtctagggggtgtgagagcatggcccccaccactgggactgagacactgcccagacacctacgggtggctgcagtcgagaatctttggcaatggacgcaagtctgaccaagcgacgccgcgtgcgggatgaaggcccttgggttgtaaaccgctgtcaggggggaggaaagcttcggcttgaccgagccccagaggaagcacgggctaagtacg

SEQ ID NO: 2573 - DNA, 490 bp, Unknown
  Ascusbbf_1816096, encodes 16S rRNA
agagtttgatctggccaggatgaacgctggcggcgtgcttaacacatgcaagtcgaacgaagctccatttaagatttcttcggaatgattttgtggatgacttagtggcggacgggtgagtaacgcgtgaggaacctgccttgcagaggggaataacagttagaaacggctgctaataccgcataatacgaaggagtcgcatgattttttcgtcaaagatttatcgctgtgagatggcctcgcgtctgattagctagttggtgaggtaacggcccaccaaggcgacgatcagtagccggactgagaggttgaacggccacattgggactgagacacggcccagactcctacgggaggcagcagtggggaatattgggcaatgggcgcaagcctgacccagcaacgccgcgtgaaggaagaaggctttcgggttgtaaacttcttttaagtgggacgataatgacggtaccacttgaataagctccggcta

SEQ ID NO: 2574 - DNA, 490 bp, Unknown
  Ascusbbf_191241, encodes 16S rRNA
agagtttgatcctggctcagaatgaacgttggcggcgtggattaggcatgcaagtcgtacgagaacctcaactagcttgctaggagaggggacagtggcgaaagggagagtaaggcgtggttacatgccctcgagttcgggatagtaacgggaaactgttagtaataccggataatatctttggatcaaaggtgagattccgctcgaggattggaccgcgtgctattagcttgttggtgaggtaatggctcaccaaggctacgatggctaccgggtgtgagagcatggcccggctcactgggactgagacactgcccagacacctacgggtggctgcagtcgagaatctttggcaatgggcgaaagcctgaccaagcgacgccgcgtgcgggatgaaggccctcgggttgtaaaccgctgtcagaagctaggaaatgctagggggtactccccttagcttgaccgatcttcagaggaaggacgggctaag

SEQ ID NO: 2575 - DNA, 490 bp, Unknown
  Ascusbbf_207920, encodes 16S rRNA
agagtttgatcatggctcaggatgaacgctggcggcgtgcttaatacatgcaagtcgaacgaagcacctctcccgaagattgatctagcttgctagtgattgattcatttgaggtgactgagtggcggacgggtgagtaacgcgtgggtaacctgccttatacagggggataacagttagaaatgactgctaataccgcataagcgcacagtatcgcatgatacagtgtgaaaaactccggtggtataagatggacccgcgtctgattagctagttggtgaggtaacggcccaccaaggcaacgatcagtagccgacttgagagagtgatcggccacattgggactgagacacggcccaaactcctacgggaggcagcagtagggaatattgcacaatgggggaaaccctgatgcagcgacgccgcgtgaaggatgaagtatttcggtatgtaaacttctatcagcaaggaagaaaatgacggtacttga

SEQ ID NO: 2576 - DNA, 490 bp, Unknown
  Ascusbbf_1780102, encodes 16S rRNA
agagtttgatcatggctcaggacgaacgctggcggcgtgcttaaaacatgcaagtcgaacggagtttatgagtagcttgctacgagtaaacttagtggcggacgggtgagtaacacgtgagcaacctgcctatcacagggggataacacttagaaataggtgctaataccgcatatgaccacagaccggcatcggtcagaggtgaaaggagttaaatctggtgatagaggggcttgcgtatcattagctagttggtgagggtaacggcccaccaaggctacgatgattagccgatctgagaggatgaccggccacattggaactgagatacggtccaaactcctacgggaggcagcagttaggaatattgggcaatggaggaaactctgacccagcaacgccgcgtgaaggatgaaggttttcggattgtaaacttctgatctgtggaaagaaacaaatgacggtaccacaggagcaagccccggctaac

SEQ ID NO: 2577 - DNA, 490 bp, Unknown
  Ascusbbf_287525, encodes 16S rRNA
agagtttgatcatggctcaggatgaacgctagcggcaggcttaacacatgcaagtcgaggggcagcgagatgtagcaatacattgtcggcgaccggcagacgggtgcgtaacgcgtatgcaacctgcccgccacaggggtatagcccggcgaaagccggaataatcccccatagttccacatttccgcatggtaatgtggataaacgggtgaccgggtggcggatgggcatgcgtggcattaggcagttggcggggtaacggcccaccaaaccgacgatgcctaggggtcctgagagggaggtcccccacattggaactgagacacggtccaaactcctacgggaggcagcagtgaggaatattggtcaatgggcgagagcctgaaccagccatgccgcgtgcaggaagacggccttatgggttgtaaactgcttttattggggacgagcatgagtacgcgtactcaaatgacggtacccgatgaataag

SEQ ID NO: 2578 - DNA, 490 bp, Unknown
  Ascusbbf_150745, encodes 16S rRNA
agagtttgatcatggctcaggacgaacgctggcggcgtgcctaacacatgcaagtcgaacggagatacacgctgaagtgagagcagcttgctgaaggatcttcttgtgtatcttagtggcggacgggtgagtaacgcgtgagcaacctgcctttcagagggggataacgtttggaaacgaacgctaataccgcatgagactacggtactgcatggtacagtggtcaaaggagcaatccgctgaaagatgggctcgcgtccgattagatagttggcggggtagaggcccaccaagtcgacgatcggtagccggactgagaggttgaacggccacattgggactgagacacggcccagactcctacgggaggcagcagtgagggatattggtcaatgggggaaaccctgaaccagcaacgccgcgtgagtgatgacggtcttcggattgtaaagctctgtcctctgtgaagatgatgacggtagcagaggag

SEQ ID NO: 2579 - DNA, 490 bp, Unknown
  Ascusbbf_163122, encodes 16S rRNA
agagtttgatcctggctcagaacgaacgctggcggcgcgttttaagcatgcaagttgagcggtaacttggatttattcaagctagagcggcggacgggtgagtaacacgtggataatctggcctacagttgggaatagcctgatgaaagtcaggataatgccgaatgagcagttgacggcacaagctgttgattggaaaggggctaaggcctcgctgaaggatgagtccgcgtcccattagttagatggtggggtaaaggcctaccatggcaatgatgggtagccggcctaagagggtggacggccacattgggactgagatacggcccagactcctacgggaggcagcagctaagaatcttccgcaatggtcgaaagactgacggagcgacgccgcgtgaacgatgaaggccgtgaggttgtaaagttcttttcaggagggagaataaggcttatagggaatgataggctgatgacatgaatcctggaa

SEQ ID NO: 2580 - DNA, 490 bp, Unknown
  Ascusbbf_1525689, encodes 16S rRNA
agagtttgatcatggctcaggatgaatgctggcggcgtgcctaatacatgcaagtcgagcggtaacatggcttcaccgtgttcttgacactccgggcgtattcgcgggaggacagattcgaggacacagtgaagctgatgacgagcggcggacggctgagtaacgcgtgggaacgtaccctaaactgagggataactagtcgaaagattagctaataccgcatatgatcttcggattaaagctttcgggcggtttaggaatggcctgcgtacgattagatagttggtgaggtaacggctcaccaagtcgacgatcgttagatggtttgagaggatgatcatccagactgggactgagacacggcccagactcctacgggaggcagcagtagggaatctttcacaatgggcgaaagcctgatggagcaacgccgcgtgcaggatgaaggccttcgggttgtaaactgcttttatatccgagaaatatgatg

SEQ ID NO: 2581 - DNA, 490 bp, Unknown
  Ascusbbf_252450, encodes 16S rRNA
agagtttgatcctggctcaggatgaacgctggcggcacgcttaacacatgcaagtcgagcgggacttgagacttcggtcttaagttcagcggcggacgggtgagtaacacgtgggtaacctaccctataccgggggataacgtatagaaatgtacgctaataccgcataagccaacagggacgcatgttccggttggaaaagttccggcgatataggatgggcccgcgactgattagctagttggtgaggtaacggcccaccaaggcgacgatcagtagccggtctgagaggatggacggccacattgggactgagacacggcccagactcctacgggaggcagcagtggggaatattgcacaatgggggaaaccctgatgcagcgatgccgcgtgaaggatgaagtatttcggtatgtaaacttctatcagcagggaagaaaaaggacagtacctgactaagcagccccggctaactacgtgccagcag

SEQ ID NO: 2582 - DNA, 490 bp, Unknown
  Ascusbbf_307055, encodes 16S rRNA
agagtttgatcatggctcagaatgaacgttggcggcatggattaggcatgcaagtcgagcgagaaccctaagatggaggcttcggccaaagtcttagggggacagcggcgaaagggtgagtaatacgtagttacctgccccagggtctagaatagcttcgggaaactgaaggtaatgctggataatatctccggatcaaaggtgagattccgccctgggaggggactgcgtcctactagcttgttggtggggtaatggcctaccaaggctacgatgggtagcgggcgtgagagcgtggcccgccacactgggactgagacactgcccagacacctacgggtggctgcagtcgagaatcttcggcaatgcgcgaaagcgtgaccgagcaatgccgcgtgcgggatgaaggccttcgggttgtaaaccgcgaaagtaaggaggaaggctctgcgaagagcagagtttgaccaatttacagtaaggacgggct

SEQ ID NO: 2583 - DNA, 490 bp, Unknown
  Ascusbbf_721678, encodes 16S rRNA
agagtttgatcatggctcaggatgaacgctagcggcaggcttaacacatgcaagtcgaggggcagcggagaagtagcaatacttctgccggcgaccggcgcacgggtgagtaacgcgtatgcaacctttcccagacagggggatagcccagggaaacttggattaataccccgtaagccagaagaggcatcctcgtctggttaaagttccggcggtctggggtgggcatgcgtgccattaggcagttggtggggtaacggcccaccaaaccgacgatggctacggggtctaaaaggatggtcccgcacattggaactgagacacggtccaaactcctacgggaggcagcagtgaggaatattggtcaatgggggtaactctgaaccagccatgccgcgtggaggaagacggccctacgggttgtaaactcctttagcacgggaataaactcagtcacgcgtgactgattgaaggtaccgtgagaataagc

SEQ ID NO: 2584 - DNA, 488 bp, Unknown
  Ascusbbf_579126, encodes 16S rRNA
agagtttgatcctggctcagaatgaacgctggcggcatggattaggcatgcaagtcgaacggggcccttcagggcccagtggcggaagggtgagtaacacgtgagcaacccgcccccaaggccggaacaagcgctggaaacggcgtctgaaaccggatgaggatctcctccgcatggaggggcgtccaaatattcataccctggggatgggctcgcggcccattagcttgtcggcggggcggcggcccaccgaggcgacgacgggtaggtggtctgagaggatggtcacccacactgggactgagacaccgcccagactcctgcgggaggctgcagtcgagaatcttccgcaatgggcgcaagcctgacggagcgatgccgcgtgagggacggaggccttcgggtcgtggacctctgtcgcccgggacgatgatgacggtacctgacgaggaagccacggctaactacgtgccagcagccgcggtaat

SEQ ID NO: 2585 - DNA, 490 bp, Unknown
  Ascusbbf_419469, encodes 16S rRNA
agagtttgatcatggctcaggattaacgctggcggcatgcctaatacatgcaagtcaaacgggtgtacttgtacaccagtggcgaacgggtgagtaatatataggtaacttgcccttaagacgaggataaccattggaaacgatggataatactggataggatagtttaacgcatgttttactatttaaagacgctctcaagcgtcacttaaggagaggcctatatcgcattagcttgttggtgaggtaacggctcaccaaggcgacgatgcgtaactgtgctgagaggcaaaacagtcacattggaacttagacacggtccaaactcctacgggaggcagcagtagggaattttcggcaatgggggaaaccctgaccgagcaatgccgcgtgaatgatgaagatcttcggatcgtaaaattctgttgttagggaagaatgctagtggtaggaaatgatcattagttgacagtacctgactagaaagccc

SEQ ID NO: 2586 - DNA, 486 bp, Unknown
  Ascusbbf_97537, encodes 16S rRNA
agagtttgatcatggctcagaacgaacgctggcggcatgcctaacacatgcaagtcgaacgatggcttcggccatagtggcgcacgggtgagtaacgcgtggggatctgcccagcagtggggaataacctcgggaaactgaggctaataccgcatacgccccttggatgtaagagtccttgggggaaagatttatcgctgttggatgaacccgcgtcggattagctagttggtggggtaagagcccaccaaggcgacgatccgtagctggtctgagaggatgatcagccacactgggactgagacacggcccagactcctacgggaggcagcagtggggaatattggacaatgggcgcaagcctgatccagcaatgccgcgtgaatgatgaaggccctagggttgtaaagttctttcgacggggacgatgatgacggtacccgtagaagaagccccggctaacttcgtgccagcagccgcggtaat

SEQ ID NO: 2587 - DNA, 490 bp, Unknown
  Ascusbbf_737461, encodes 16S rRNA
agagtttgatcctggctcaggacgaacgctggcggcgtgcctaacacatgcaagtcgagcggggacatacggaacgagggattcgtcctgagggaaatgtgttctagcggcggacgggtgagtaacgcgtgaacgatctgtccctgacagggggataacacatggaaacaggtgctaataccgcataagaccacagcgctgcatggcgcaggggtcaaaggagtaatccggtgaggggtgagttcgcgtctgattagatagttggtgaggtaacggcccaccaagtcaacgatcagtagccgacctgagagggtgatcggccacattggaactgagacacggtccaaactcctacgggaggcagcagtgggaatattgggcaatgggcgaaagcctgacccagcaacgccgcgtgagggatgaaggttttcggattgtaaacctctgtccttggtgacgaaggaagtgacggtagccaaggaggaagccc

SEQ ID NO: 2588 - DNA, 480 bp, Unknown
  Ascusbbf_423337, encodes 16S rRNA
agagtttgatcctggctcaggatgaacgctggcggcgtgcctaaaacatgcaagtcgagcggtaaggccccttcgggggtacacgagcggcggacgggtgagtaacacgtgggaatctaccccaaactgagggataagcaccggaaacggtgtctaataccgcatatggtcttcggattaaagcttcggcggtttgggaagagcccgcgtaagattagctagttggtgaggtaaaggcttaccaaggctacgatctttagctggtttgagaggatgatcagccacactggaactgagacacggtccagactcctacgggaggcagcagttaggaattttccacaatgggcgcaagcctgatggagcaacgccgcgtgcaggatgaaggttttcggattgtaaactgcttttatgtgcgaagaatatgacggtaacacatgaataaggatcggctaactccgtgccagcagccgcggtaat

SEQ ID NO: 2589 - DNA, 490 bp, Unknown
  Ascusbbf_228749, encodes 16S rRNA
agagtttgatcctggctcaggatgaacgctggcggcgtgcttaacacatgcaagtcgaacgattaaaccgccctcgggcggacatagagtggcgaacgggtgagtaacacgtgaccaacctgccccatgctccgggataacctgcggaaacgcaggctaataccggatactccgcgcgggccgcatggcccgggcgggaaagcccttacggcatgggatggggtcgcggcccattaggtagacggcggggtgacggcccaccgtgcccgcgatgggtagccgagctgagaggctgaccggccacattgggactgagatacggcccagactcctacgggaggcagcagtggggaattttgcgcaatgggcgaaagcctgacgcagcaacgccgcgtgcgggatggaggccttcgggttgtaaaccgctttcagcagggacgaacgctgacggtacctgcagaagaagctccggctaactacgtgccagcag

SEQ ID NO: 2590 - DNA, 490 bp, Unknown
  Ascusbbf_1826945, encodes 16S rRNA
agagtttgatcatggctcaggatgaacgctagcgacaggcctaacacatgcaagtcgaacgaggttaatgagaggaagacttcggttggaatcttattatccgagtggcggacgggtgagtaacgcgtgagcaacctgtcttacacagggggataacgctccgaaaggagtgctaataccgcataggaccacggtgctgcatggcaccgaggtgaaaggagcaatccggtgtaaggtgggctcgcgtcccattagatagttggtgaggtaacggcccaccaagtcgacgatgggtagccgacctgagagggtgatcggccacattggaactgagatacggtccagactcctacgggaggcagcagtggggaatattgggcaatgggcgcaagcctgacccagcaacgccgcgtgagggaagaaggtcttcgggttgtaaacctctgtcctaagtgaaaaggaaggatggtagcttaggaggaagccccgg

SEQ ID NO: 2591 - DNA, 490 bp, Unknown
  Ascusbbf_1040170, encodes 16S rRNA
agagtttgatcctggctcaggacgaacgctggcggcgtgcctaacacatgcaagtcggacggactgagctccttcgggggcgaaagttagtggcgaacgggtgagtaacgcgtgaggaacctgcctttcagagggggacaacagttggaaacgactgctaataccgcataacatattactttcgcatgaaagggatatcaaagattttatcgctgaaagatggcctcgcgtctgattagatagttggtggggtaacggcccaccaagtcgacgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttaccagggacgaaggatgtgacggtacctggagaaaaagccacagctaactacgtgcca

SEQ ID NO: 2592 - DNA, 490 bp, Unknown
  Ascusbbf_177145, encodes 16S rRNA
agagtttgatcatggctcaggatgaacgctagcggcaggcttaacacatgcaagtcgaggggcagcgcgttgtagcaatacaatggcggcgaccggcgaaagggtgcgtaacacgtgagcaacctgccccgttccgggggataggaggtggaaacgccttgtaataccccataacaacgtaggctgcatggcctatgtttgaaaaattcgttggaacgggatgggctcgcgggacattagctggttggcggggtaacggcccaccaaggcgacgatgtctaggggttctgagaggaaggtcccccacactggaactgagacacggtccagactcctacgggaggcagcagtgaggaatattggtcaatggccggaaggctgaaccagccatgccgcgtgcaggaataaggccctacgggtcgtaaactgcttttgcggtggagcaataaggtgtacgcgtacaccgatgagagtacatcgcgaataagca

SEQ ID NO: 2593 - DNA, 490 bp, Unknown
  Ascusbbf_1847921, encodes 16S rRNA
agagtttgatcatggctcaggatgaacgctggcggcgtgcataacacattcaagtcgaacgaagcactttggcggaaccttcgggggaagctgatttgacttagtggcggacgggtgagtaacgcgtgagcaaccttcctgcttgtgagggataacacagggaaacttgtgctaataccgcatgacgcatagatatcgcatggtgactatgccaaagacatgttgcaggcagatgggctcgcgtctgattagatagtaggtgaggtaacggcccacctagtcgacgatcagtagccggactgagaggttgaacggccacattggaactgagatacggtccagactcctacgggaggcagcagtggggaatattgggcaatgggcgaaagcctgacccagcgacgccgcgtgagggaagaaggtcttcggattgtaaacctctttcagcaaggaagaagaaagtgacggtacttgcagaagaagccacggc

SEQ ID NO: 2594 - DNA, 490 bp, Unknown
  Ascusbbf_716294, encodes 16S rRNA
agagtttgatcctggctcaggatgaacgctggcggcgtgcttaacacatgcaagtcgaacgaagcactggaagcggatttcttcgggatgaagcatcctttgacttagtggcggacgggtgagtaacgcgtgggcaacctgccgtatgcagggggacaacagctggaaacggctgctaataccgcataagcgcacgatgccgcatggcaacgtgtgaaaagatttatcggcatacgatgggcccgcgttggattaggcagttggcgtggcaacggcacaccaaaccgacgatccatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaagtgacggtacctgcacaagaagccccgg

SEQ ID NO: 2595 - DNA, 490 bp, Unknown
  Ascusbbf_726132, encodes 16S rRNA
agagtttgatcatggctcaggatgaacgctggcggcgtgcctaatacatgcaagtcgaacggagacctcttcggagatcttagtggcgaacgggtgagtaacacatgaggaacctgcccattagacggggatagcttctggaaacgggaggtaataccggataaaagcgggggaggcatcttccccatttaaaagggtgctacggcatcgcttatggatggcctcatggtgcattagttagacggcggggtaacggcccaccgtgacgatgatgcatagccgatctgagaggatgaccggccacattgggactgagacacggcccagactcctacgggaggcagcagtagggaattttcggcaatgggcgaaagcctgaccgagcaacgccgcgtgagtgataaggccttcgggttgtaaagctctgttgccggggacgaaggatgcggatagggaatgatccgcaggtgacggtacccggccagaaagc

SEQ ID NO: 2596 - DNA, 490 bp, Unknown
  Ascusbbf_198703, encodes 16S rRNA
agagtttgatcatggctcagagcgaacgctagcggaatgctttatacatgcaagtcgaacgaacgagtttatattgagtagcaatacgatttataaatgagttagtggcaaacgggtgagtaatagttaggaacttgccgaatagtgggggacaacagatagaaatgtctgctaataccgcatattcccgagaggggaaagatttattgctatttgagaggcctaaccacgattagcttgttggtgagataaaagcccaccaaggcggtgatcgttagccggtctaagaggatgatcggccacatcgggactgagacacggcccggactcctacgggaggcagcagtagggaatattggacaatgggggcaaccctgatccagcaattccgcgtgagtgatgaaggtgttatgcattgtaaaactcttttgcctgcgaagataatgacggtagcaggagaataagcaccgactaactatgtgccagcagc

SEQ ID NO: 2597 - DNA, 490 bp, Unknown
  Ascusbbf_1533166, encodes 16S rRNA
agagtttgatcatggctcagaatgaacgttggcggcgtggattaggcatgcaagtcgagcgcgaacccagcaatgggtgaaagccgcggaagggacaggaatgcgtaggttacgtacccttgggactggaatagctgcgggaaactgcaggtaatgccagataatatcttcggatcaaggtgtgattccgcccatggagcggcctacgtcctattagtttgttggtggggtaatggcctaccaaggctttgatgggtagcgggtgtgagagcatgacccgcgtcactgggactgagacactgcccagacacctacgggtggctgcagtcgagaatcttcggcaatgggcgaaagcctgaccgagcgacgccgcgtgcgggatgaaggccttcgggttgtaaaccgctgtcaatggggaggaaggctacgtgaagagcgtagtttgacctatctttggaggaaggacgggctaagttcgtgccagcagcca

SEQ ID NO: 2598 - DNA, 490 bp, Unknown
  Ascusbbf_709213, encodes 16S rRNA
agagtttgatcatggctcaggatgaacgctagcggcaggcttaacacatgcaagtcgaggggcagcgcgggtggcaacacctggcggcgaccggcgaaagggtgagtaacgcgtgagcaacgtgcccgtggttgggggatagtcgatggaaacgtcgcgtaataccccgtaacatcagttaccgcatggtgattggttgagagatttattgtccacggatcggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccgggaggctgatccagccatgccgcgtgcgggaagacggccctacgggttgtaaaccgcttttgcgagggagcaataatcactacgtgtagtgagatgagagtaccttacgaataagcatc

SEQ ID NO: 2599 - DNA, 490 bp, Unknown
  Ascusbbf_1880142, encodes 16S rRNA
agagtttgatcatggctcaggatgaacgctagcggcaggcttaacacatgcaagtcgaggggcagcgcgggtagcaatatctggcggcgaccggcgaaagggtgagtaacgcgtgagcaacatacccgtatgagggggatagtcattggaaacgatgcgtaataccccgtaacatagatcatcgcatggtgatgtattgaaagatttattgcatacggattggctcgcgtaccattaggtagttggcggggtaacggcccaccaagccgacgatggttaggggttctgagaggaaggtcccccacattggaactgagacacggtccagactcctacgggaggcagcagtgaggaatattggtcaatggccgggaggctgaaccagccatgccgcgtgcgggaggacggccctatgggttgtaaaccgcttttgtcggggagcaataagcgccacgtgtggcgcgatgagagtacctggcgaataagcatc

SEQ ID NO: 2600 - DNA, 490 bp, Unknown
  Ascusbbf_1366818, encodes 16S rRNA
agagtttgatcatggctcaggatgaacgctggcggcgtgcctaacacatgcaagtcgagcggggacacggggcttcggtcccgtgtttcagcggcggacgggtgagtaacgcgtgagcaatctgtcccattcaccgggataacaactggaaacagttgctaataccgggcgagaccacggtgccgcatggcgcaggggtagaagggataccggagtggggtgagctcacgtcccattaggtagttggtgaggtaagggcccaccaagccgacgatgggtagccgacctgagagggtgatcggccacactggaactgagacacggtccagactcctacgggaggcagcagtggggaatattgggcaatgggcgaaagcctgacctagcaacgccgcgtgagggaagaaggttttcggattgtaaacctctgtcctaagtgacaaaggaagtgacggtagcttaggaggaagccccggctaactacgtgcca

SEQ ID NO: 2601 - DNA, 490 bp, Unknown
  Ascusbbf_379965, encodes 16S rRNA
agagtttgatcatggctcaggacgaacgctggcggcatgcctaacacatgcaagtcgaacggagagatctcaccgtcgaagcttgaggtgcttgcaccgagagtggagacaccgagatatcttagtggcggacgggtgagtaacgcgtgagcaacctggctttaagagggggacaacactgagaaatcagtgctaataccgcataagactcagttttcgcatgggaaaagagttaaaggagaaatccgcttaaagatgggctcgcgtcccattagttagttggtgaggtaacggctcaccaagacgacgatgggtagccggactgagaggttgaacggccacactgggactgagacacggcccagactcctacgggaggcagcagtggggaatattgggcaatgggcgaaagcctgacccagcaatgccgcgtgaatgaagaaggtcttaggattgtaaaattctgtcctgcgggaagaaacaaatgacg

SEQ ID NO: 2602 - DNA, 490 bp, Unknown
  Ascusbbf_948059, encodes 16S rRNA
agagtttgatcctggctcaggatgaacgctggcggcgtgcctaacacatgcaagtcgaacggttaacccgccttcgggcggttataaagtggcgaacgggtgagtaacacgtgaccaacctgccccgcgctccgggacagcctcgcgaaagcgggattaataccggatgcgcccctcggtccgcatggacggagggggaaagcccaggcggcgcgggatggggtcgcggcccatcaggtagtaggtcgggtagaggccgacctagccgacgacgggtagccgggttgagagaccgaccggccacattgggactgagatacggcccagactcctacgggaggcagcagtggggaatattgcgcaatggggggaaccctgacgcagcaacgccgcgtgcgggatgacggccctcgggttgtaaaccgctttcagcagggaagacatcgacggtacctgcagaagaagccccggctaactacgtgccagcagc

SEQ ID NO: 2603 - DNA, 490 bp, Unknown
  Ascusbbf_1008712, encodes 16S rRNA
agagtttgatcctggctcaggacgaacgctggcggcgtgcttaacacatgcaagtcgaacgagggatatgagagagcttgctcgattgtattccgagtggcggacgggtgagtaacgcgtgaggaacctgtcttacacaggggaataacgcaccgaaaggtgtgctaataccgcataagaccacgcctgcgcatgcaggaggggtcaaaggagcaatccggtgtaaggtggcctcgcgtcccattaggcagttggtgaggtaacggcccaccaaaccgacgatgggtagccgacctgagagggtgatcggccacattggaactgagacacggtccaaactcctacgggaggcagcagtggggaatattgggcaatgggcgcaagcctgacccagcaacgccgcgtgagggaagaaggttttcggattgtaaaactctgtcctcaatgaaaagcgagagatggtaattgaggaggaagccccggctaacta

SEQ ID NO: 2604 - DNA, 490 bp, Unknown
  Ascusbbf_1321098, encodes 16S rRNA
agagtttgatcctggctcaggatgaacgctggcggcgtgcctaatacatgcaagtcgagcggtaaggctcctgcagattatttaagcggtgaatactcacaactcacactcccggctaggagtgagagcaagcttgaataatgcgctggagtacacgagcggcggacgggtgagtaacgcgtaagaatgtaccccaaactgagggataactgctcgaaagagtagctaataccgcatgtgctcttcggagtaaagcttcggcggtttgggaacagcttgcgtaggattagctagttggtaaggtaacggcttaccaaggcgacgatccttagctggtctgagaggatgatcagccacactgggactgagacacggcccagactcctacgggaggcagcagtagggaattttccacaatgggggcaaccctgatggagcaacgccgcgtgatggatgaaggctttcgggtcgtaaacatcttttctctgtg

SEQ ID NO: 2605 - DNA, 490 bp, Unknown
  Ascusbbf_1438290, encodes 16S rRNA
agagtttgatcctggctcaggacgaacgctggcggcgtgcttaacacatgcaagtcgaacgggaagcagcaatgctctcagtggcggacgggtgagtaacgcgtgagcaacctgcccttgtcaggggaataacacagagaaatctgtgctaataccgcataatattatagtgaggcatctcattgtaatcaaagcgatttagcggacaaggatgggctcgcgtcccattaggtagttggtgaggtaacggctcaccaagccgacgatgggtagccgacctgagagggtgatcggccacattggaactgagaacggtccagactcctacgggaggcagcagtggggaatattgggcaatggagggaactctgacccagcaacgccgcgtgaatgaagaaggtcttcggattgtaaagttctgtgatgggggacgaagaaagtgacggtaccccaatagcaagctacggctaactacgtgccagcagccgcg

SEQ ID NO: 2606 - DNA, 490 bp, Unknown
  Ascusbbf_1831408, encodes 16S rRNA
agagtttgatcatggctcaggacgaacgctggcggcgtgcttaacacatgcaagtcgaatggaagtagaaatactttagtggcggacgggtgagtaacgcgtgagcaacctgcccttatcagggggacaacacagagaaatttgtgctaataccgcataacgttacgaacaggcatctgtttgtaaccaaagaattatcggataaggatgggctcgcgtcccattaggtagttggtgaggtaacggcccaccaagccgacgatgggtagccgatctgagaggatgaacggccacattggaactgggagacggtccagactcctacgggaggcagcagtggggaatattgggcaatgggcgcaagcctgacccagcaacgccgcgtgaatgaagaaggttttcggattgtaaagttctgtgatgggggacgaagaaagtgacggtaccccaatagcaagctacggctaactacgtgccagcagccgcggta

SEQ ID NO: 2607 - DNA, 490 bp, Unknown
  Ascusbbf_1872513, encodes 16S rRNA
agagtttgatcatggctcaggacgaacgctggcggcgtgcttaatccatgcaagtcgaacggggcgatcccggaagtccttcggggcggaagggagagcttagtggcgaacgggtgagtaacgcgtgaccaaccaaccttaagcagggggacaacagctggaaacggctgctaataccgcataagaccacggtgaggcatcttacaggggtcaaaggagcaatccggcttaagacggggtcgcgtcccattagttagtaggtgaggcaacggctcacctagactgcgacgggtagccgagctgagaggctgatcggccacactgggactgagatacggcccagactcctacgggaggcagcaggaaggaatattgggcaatgggggaaaccctgacccagcaacgccgcgtgaaggaagaaggccttcgggttgtaaacttctgtgacaggggacgaaggaagtgacggtaccctgagaggaagctccgg

SEQ ID NO: 2608 - DNA, 490 bp, Unknown
  Ascusbbf_2235, encodes 16S rRNA
agagtttgatcatggctcaggacgaacgctggcggcatgcctaacacatgcaagtcgaacggagttaagagagcttgcttttttaacttagtggcggacgggtgagtaacgcgtgagcaacctgcctttcagtggggaataatgttctgaaaagagcactaataccgcatgaagtatactgatcgcatggtcggaataccaaagatttatcgctgaaagatgggctcgcgtccgattagccagttggtggggtaacggcctaccaaagcgacgatcggtagccggactgagaggttgaacggccacattgggactgagacacggcccagactcctacgggaggcagcagtgggggatattgcgcaatgggggaaaccctgacgcagcaatgccgcgtgaaggatgaaggtcttcggattgtaaacttcttttgtcagggacgaacgatgacggtacctgacgaataagctccggctaactacgtgccagc

SEQ ID NO: 2609 - DNA, 490 bp, Unknown
  Ascusbbf_6506, encodes 16S rRNA
agagtttgatcatggctcaggatgaacgctggcggcatgcctaagacatgcaagtcgaacgaagtggcccaacaatgatttgtgcttgcacaattctgcgatggatacccgcttagtggcagacgggtgagtaacacgtaagtaatctgccttcaagactgggataacgtttggaaacgaacgctaataccggatgattcataattagataactatttatgctaaaaggggcttcggcctcacttgaagatgagcttgcggcgtattaactagttggtggggtaatggcctaccaaggtgacgatgcgtagccgagctgagaggctaatcggccacattgggactgagacacggcccaaactcctacgggaggcagcagttagggatattcgtcaatgggggaaaccctgaacgagcaatgccgcgtgagtgatgacggtcctatggattgtaaaactctgttgtaaaggaagaatccttattataggta

SEQ ID NO: 2610 - DNA, 490 bp, Unknown
  Ascusbbf_34954, encodes 16S rRNA
agagtttgatcatggctcaggatgaacgctagcggcaggcttaacacatgcaagtcgaggggcagcgtggagtagcaatactctgacggcgaccggcgaaagggtgagtaacgcgtgagcaacatgcccggtagagagggatagtcattggaaacgatgcgtaatacctcgtaacacacggaagcgcatgattctgtgttgaaagattaatcgctaccggattggctcgcgtgccattagctagttggcggggtaacggcccaccaaggcgacgatggctaggggttctgagaggaaggtcccccacattggaactgagacacggtccagactcctacgggaggcagcagtgaggaatattggtcaatggccgagaggctgaaccagccatgccgcgtgcgggaggacggccctatgggttgtaaaccgcttttgtcagggagcaataaggtccacgtgtggactgatgagagtacctggcgaataagca

SEQ ID NO: 2611 - DNA, 490 bp, Unknown
  Ascusbbf_7008, encodes 16S rRNA
agagtttgatcatggctcaggatgaacgctggcggcatgcctaatacatgcaagtcgaacgggagtgcttgcactccagtggcgaacgggtgagtaatacataggtaacctgtccttaagacgaggatagcttctagaaatggaagataaaactggataggacatcacaaatcacatgattagatgtttaaaagagcaatctacttaaggaggggcctgtggcgcattagccagatggcggggtaatggcccaccatagcgatgatgcgtagccggtctgagaggacgaacggccacattgggactgagacacggcccagactcctacgggaggcagcagtagggaattttcggcaatgggcggaagcctgaccgagcaatgccgcgtgaatgaagaagtatttcggtatgtaaagttcttttatttgggacgaaaaaacaaattgacggtaccaaatgaataagccccggctaactatgtgccagcagc

SEQ ID NO: 2612 - DNA, 490 bp, Unknown
  Ascusbbf_63443, encodes 16S rRNA
agagtttgatcctggctcaggatgaacgctagcgacaggcctaacacatgcaagtcgaggggcagcggggagaaagcttgctttttctgccggcgaccggcgcacgggtgcgtaacaggtgtgcaatctgtccataatcggggaatagcccggcgaaagccgaattaaagctccatgtgccattgaggggcatcccatgatggtgaaacgttaaggattatggatgagcacgcttctgattaggtagttggtgaggtaacggcccaccaagccgacgatcagtaggggttctgagaggaaggtcccccacattggaactgagacacggtccaaactcctacgggaggcagcagtgaggaatattggtcaatggacgagagtctgaaccagccaagtcgcgtgaaggaagacggttctatggattgtaaacttcttttgtccgagggtaaagttaggtacgtgtacctattggaaagtatcggacgaataa

SEQ ID NO: 2613 - DNA, 490 bp, Unknown
  Ascusbbf_62513, encodes 16S rRNA
agagtttgatcctggctcaggatgaacgctggcggcgtgcttaacacatgcaagtcgaacggaaacttaatgaaacctagtgatttaagttttagtggcggacgggtgagtaacgcgtgggtaacctgccgtatgcagggggataacagttagaaatgactgctaataccgcataagaccacagtctcgcatgagacaggggtaaaaactccggtggcatacgatggacccgcgtctgattaggcagttggtgaggtaacggcccaccaaacctacgatcagtagccggcctgagagggtgaacggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagcaccggctaaatacgtgcc

SEQ ID NO: 2614 - DNA, 490 bp, Unknown
  Ascusbbf_1870568, encodes 16S rRNA
agagtttgatcatggctcaggatgaacgctggcggcgtgcttaacacatgcaagtcgaggggcagcgggtgtagcaatacatgccggcgaccggcgaaagggtgagtaacgcgtgagcaacgtgcccgtatgtggggatagtcattggaagcgatgcgtaataccccgtaacacaagggactgcatggtcctttgttgaaagattttattgcatacggatcggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggatgacggccctatgggttgtaaaccgcttttgcgagggggcaataagggtcacgcgtggcccgatgagagtacctcgcgaataagcatc

SEQ ID NO: 2615 - DNA, 490 bp, Unknown
  Ascusbbf_145042, encodes 16S rRNA
agagtttgatcctggctcaggatgaacgctggcggcgtgcctaacacatgcaagtcgagcggagaggttgcggagattcaatcgatgatctgcttcttcttagcggcggatgggtgagtaacacgtgggtaacctgccctgcactggggaataacagttggaaacgactgttaataccgcatatgcgcacggggtcgcatgaccccgggcggaaagatttatcggtgcaggatgggcccgcgtcggattaacttgttggtgaggtaatggcccaccaaggtgatgatccgtagccgacctgagagggtgaccggccacattgggactgagacacggcccaaactcctacgggaggcagcagtgggggatattgcacaatgggcgcaagcctgatgcagcgacgccgcgtgaaggaagacgtatttcggtatgtaaacttctatcagcggggaagaagatgacggtacccgactaagaagccccggctaat

SEQ ID NO: 2616 - DNA, 490 bp, Unknown
  Ascusbbf_159592, encodes 16S rRNA
agagtttgatcctggctcaggatgaacgctggcggcgtgcctaacacatgcaagtcgaacgaagctcctgcgacagattccttcgggatgaagatgcttgagacttagtggcggacgggtgagtaacgcgtgggtaacctgccctgtactgggggacaacagttagaaatgactgctaataccgcataagcctacagagtcgcatgacttagtaggaaaaattccggtggtacaggatgggcccgcgtctgattagctagttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaaatgacggtacctgactaagaagcaccgg

SEQ ID NO: 2617 - DNA, 490 bp, Unknown
  Ascusbbf_118593, encodes 16S rRNA
agagtttgatcatggctcaggattaacgctggcggcgtgcctaacacatgcaagtcgagcgagaaatagtgaagagatacttcggttgaacagatctatggacagcggcggacgggtgagtaacgcgtgggcaacctacccctttcccgaggatagccaagggaaactttgaataatactccataaagcagatgtaccgcatgatacgactgccaaagatttatcggagagggatgggcccgcgtctgattagccagttggtgaggcagcggctcaccaaagcgacgatcagtagccggcctgagagggtgaacggccacattggaactgagacacggtccagactcctacgggaggcagcagtggggaatattgcacaatgggcggaagcctgatgcagcaacgccgcgtgaaggatgaaggttttcggatcgtaaacttctgtccctggggaagaagaaagtgacggtacccaaggaggaagccccgg

SEQ ID NO: 2618 - DNA, 490 bp, Unknown
  Ascusbbf_186150, encodes 16S rRNA
agagtttgatcatggctcaggatgaacgctagcggcaggcctaacacatgcaagtcgagcgggattcggtggcttgccaccgatgagagcggcgcacgggtgcgtaacgcgtatacaacctgccttttgctacgggatagcccagagaaatttggattaacaccgtatggtatagagtcccggcatcgggcttctattaaaggctacggcaaaagatgggtatgcgtcctattagctagatggtgtggtaacggcataccatggcgacgataggtaggggccctgagagggggatcccccacactggtactgagacacggaccagactcctacgggaggcagcagtgaggaatattggacaatgggcggaagcctgatccagccatgccgcgtgcaggaagactgccctatgggttgtaaactgcttttatacgggaagaaacaccccctcgtgagggggcttgacggtaccgtaggaataaggatcggc

SEQ ID NO: 2619 - DNA, 490 bp, Unknown
  Ascusbbf_1515609, encodes 16S rRNA
agagtttgatcctggctcaggatgaacgctggcggcgcgcctaacacatgcaagtcgaacggttaagccaccttcgggtgggaataaagtggcgaacggctgagtaacacgtgggcaacctgcccctcgcaccgggacagcctcgggaaaccgtggatgataccggatactccgcctcccccgcatggggagggcgggaaagcccagacggcgagggatgggcccgcggcctgttagctagttggcggggcagcggcccaccaaggcgatgatgggtagccgggttgagagaccgaccggccacattggaattgggaaacggaccaaactcctacgggaggcagcagtggggaatattgcacaatgggggaaactctgatgcagccatgccgcgtgtgtgaagaaggccttcgggttgtaaagcactttcggaggggaggaacaaatgacgttaccctcagaagaagcaccggctaactccgtgccagca

SEQ ID NO: 2620 - DNA, 490 bp, Unknown
  Ascusbbf_718469, encodes 16S rRNA
agagtttgatcatggctcagaatgaacgctggcggcatggattaggcatgcaagtcgaacgggaaggccttcgggccttcgagtggcgaaagggtgagtaacacgtgagcaacctgcccccgagttccgaataagcagtggaaacgctgtctaatgcgggatgaggagaacttgtctcctgacaatatctccaaagatttatcgcttggggatgggctcgcggcccattagcttgttggtggggtaatggcccaccaaggctacgacgggtaggtggactgagaggtcggtcacccacactgggactgagacactgcccagactcctacgggaggctgcagtcgagaatcttccgcaatgggcgcaagcctgacggagcaatgccgcgtgagggaagaaggccttcgggttgtaaacctctgtcgcctgggacgaaaacaatgacggtaccaggagaggaagtcacggctaactacgtgccagcagccgc

SEQ ID NO: 2621 - DNA, 490 bp, Unknown
  Ascusbbf_486594, encodes 16S rRNA
agagtttgatcatggctcaggacgaacgctggcggcgtgcttaacacatgcaagtcgaacggagcacccctgactgaggcttcggccaaatgaagggaatgcttagtggcggacgggtgagtaacgcgtgagtaacctgcctttcagagggggacaacagttggaaacgactgctaataccgcataacatgtacggaccgcatgatctgtacatcaaagatttatcgctgaaagatggactcgcgtctgattagctagttggcggggtaacggcccaccaaggcgacgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttctcagggaagatgaacagactgtacctgaggaataagccacgg

SEQ ID NO: 2622 - DNA, 490 bp, Unknown
  Ascusbbf_359769, encodes 16S rRNA
agagtttgatcctggctcaggatgaacgctggcggcgtgcctaatacatgcaagtcgaacgagggtgcttgcaccctagtggcgaacgggtgagtaacacgtaggtaacctgcctttaagcttgggatacccagaggaaactttggctaataccggataacaacatttgaggcatctcagatgtttgaaaggccctttacggggtcacttaaagatggacctgcggcgcattagttagttggtgagataacagcccaccaagacgaggatgcgtagccgacctgagagggtgatcggccacattggaactgagacacggtccaaactcctacgggaggcagcagtaaggagttttcggcaatgggggaaaccctgaccgagcaacgccgcgtgagcgatgacggccctatgggttgtaaagctctgttgtaagggaagaatgatccgcttaggaaatgaagtgggtttgacggtaccttaccagaaagcc

SEQ ID NO: 2623 - DNA, 490 bp, Unknown
  Ascusbbf_488523, encodes 16S rRNA
agagtttgatcctggctcaggatgaacgctggcggcgtgcctaatacatgcaagtcgaacgagggtgcttgcaccctagtggcgaacgggtgagtaacacgtaggtaacctgccttccagtttgggatacccagaggaaactttggctaataccgaataactgatttagaggcatctctagattctaaaaggggctccaaagcctcgctgaaagatggacctgcggcgcattagctagttggtgagataacagcccaccaaggcgaggatgcgtagccgacctgagagggtgaacggccaaactggaactgagacacggtccagactcctacgggaggcagcagtagggagttttcggcaatgggggaaaccctgaccgagcaacgccgcgtgagcgatgaaggccttcgggttgtaaagctctgttgtaagggaagaacggtacggtgaggaaatgctccgtatttgacggtaccttattagaaagcca

SEQ ID NO: 2624 - DNA, 490 bp, Unknown
  Ascusbbf_175836, encodes 16S rRNA
agagtttgatcctggctcaggacgaacgctggcggcgtgcttaacacatgcaagtcgagcggaaaggcccttttttgggtactcgagcggcgaacgggtgagtaacacgtgggtaacctgcccctggcttcagaataactccgagaaatcggggctaatgctggatatgacgcgtgaccgcatggtgtgcgcgtggaaagatttggttcggttggggatggactcgcggcctatcagtttgttggtggggtagtggcctaccaaggcttcgacgggtagccggcctgagagggtgaccggtcacactgggactgagacacggcccagactcctacgggaggcagcagtggggaatattgcgcaatgggcggaagcctgacgcagcaacgccgcgtgagggatgacggccttcgggttgtaaacctctttcagctccgacgaagccctgtggggtgactgtaggggcagaagaagcaccggctaactacgt

SEQ ID NO: 2625 - DNA, 490 bp, Unknown
  Ascusbbf_93466, encodes 16S rRNA
agagtttgatcctggctcaggatgaacgctagcggcaggcctaatacatgcaagtcggacggtaagcgccccttcgggggcgcgagagtggcgcacgggtgcgtaacgcgtatgcaaccagccccgtccaggcggatagccggtggaaacgccggataatacgccacggtcccggaggggggcatccctttccgggtgaagcggagacgcgggacgggacgggcatgcgtgccattagctagttggcggggcgacggcccaccaaggctgcgatggctaggggatctgagaggacggtcccccacactggtactgagacacggaccagactcctgcgggaggcagcagtaagggatattggtcaatggggggaaccctgaaccagccatgccgcgtgagggaatgaggccctacgggtcgtgaacctcttttattcggggacaacggcggcgtcgagaacgccgcgtgagggtaccgaaggaataagcgt

SEQ ID NO: 2626 - DNA, 490 bp, Unknown
  Ascusbbf_12311, encodes 16S rRNA
agagtttgatcatggctcaggatgaacgctggcggcgtgcctaacacatgcaagtcgaacggagattcattggaaataagcttcggcagaaataagatggatcttagtggcggacgggtgagtaacgcgtggagaacctgccctgtacagggggataacatccagaaatggatgctaaaaccgcataagcgcacatgaccgcatggtcaagtgtgaaaaactccggtggtacaggatggctccgcgttggattagccagttggcggggtaacggcccaccaaagcgacgatccatagccggcctgagagggtgaacggccacattgggactgagacacggcccagactcctacgggaggcagcagtggggaatattgcacaatggggggaaccctgatgcagcgacgccgcgtgaaggaagaagtatttcggtatgtaaacttctatcagcagggaagaaaatgacggtacctgactaagaagccccggc

SEQ ID NO: 2627 - DNA, 490 bp, Unknown
  Ascusbbf_62919, encodes 16S rRNA
agagtttgatcctggctcaggatgaacgctagcggcaggcttaacacatgcaagtcgaggggcagcgcggggtagcaataccctggcggcgaccggcgcacgggtgcgtaacgcgtatgcaacctgcccgcaacagggggataacggagagaaatctccactaataccccgtattgtcagacttccgcatgggggtctgacgaaagcttcggcggttgcggatgggcatgcgtggcattaggtagttggcggggcaacggcccaccaagcccacgatgcctaggggagctgagaggcttatcccccacactggtactgagacacggaccagactcctacgggaggcagcagtgaggaatattggtcaatggagggaactctgaaccagccatgccgcgtgcgggaagaaggccctatgggttgtaaaccgcttttaaccgggagtaataagggccgtgcgcggtccgatgagagtaccggtggaataagc

SEQ ID NO: 2628 - DNA, 490 bp, Unknown
  Ascusbbf_144394, encodes 16S rRNA
agagtttgatcctggctcaggacgaacgctggcggcgtgcctaacacatgcaagtcgaacgaagtttaaattagagcttgctctggcttaaacttagtggcggacgggtgagtaacgcgtgagcaacctgcctttttgagggggataacaccgggaaaccggtgctaataccgcataacatatcgaggtcgcatggctttgatatcaaaggagcaatccgcaaaaagatgggctcgcgtccgattagctagttggtggggtaaaagcctaccaaggcgacgatcggtagccggactgagaggttgaacggccacattgggactgagacacggcccagactcctacgggaggcagcagtgggggatattgcacaatgggggaaaccctgatgcagcaacgccgcgtgagggaagaaggttttcggattgtaaacctctgtcctaggtgaagaaagaaatgacggtagcctgggaggaagctccggctaact

SEQ ID NO: 2629 - DNA, 490 bp, Unknown
  Ascusbbf_134625, encodes 16S rRNA
agagtttgatcatggctcaggatgaacgctggcggcgtgcctaatacatgcaagtcgaacgagatggatgagagcttgctctttgaagtctagtggcgaacgggtgagtaacacgtaggtaacctgcctttcagtttgggatacccaggggaaactttggctaataccaaattattacattcaaggcatcttgagtgtctaaaaggggcctttaaagcctcgctgatcgatggacctgcggcgcattagttagttggtgagataacagcccaccaagacgaggatgcgtagccgacctgagagggtgaacggccacactggaactgagacacggtccagactcctacgggaggcagcagtagggagttttcggcaatgggggaaaccctgaccgagcaacgccgcgtgaacgatgaaggtcttcggattgtaaagttctgttgtgagggaaaaatgataccatgaggaaatgcttggtgtttgatggtac

SEQ ID NO: 2630 - DNA, 490 bp, Unknown
  Ascusbbf_73215, encodes 16S rRNA
agagtttgatcatggctcaggatgaacgctagcggcaggcctaacacatgcaagtcgaggggcagcggggtgtagcaatacaccgccggcgaccggcgcacgggtgcgtaacgcgtatgcaacctgcccgcgacagggggataacgctgtgaaagcggcactaataccccgtaacacccggggccgcatggccttgggttgaaaggagagatccggtcgcggatgggcatgcgtgacattagctagttggcggggcaacggcccaccaaggctgcgatgtctaggggagctgagaggctaatcccccacactggtactgagacacggaccagactcctacgggaggcagcagtgaggaatattggtcaatggtcggaagactgaaccagccatgccgcgtggaggaagaaggccctacgggtcgtaaacttcttttgcccgggagtaataagcggggtgcgccccgcgatgagagtaccgggcgaataag

SEQ ID NO: 2631 - DNA, 490 bp, Unknown
  Ascusbbf_109552, encodes 16S rRNA
agagtttgatcatggctcaggatgaacgctggcggcgtgcataacacattcaagtcgaacggacttatcggcttcggtcggtaagttagtggcggacgggtgagtaacgcgtgagcaacctgcccctgtgtgtgggataacgtttggaaacgaacgctaataccgcatgacccaatagaaccgcatggttcagttggcaaagatttattgcacagggatgggctcgcgtccgattagatagttggcggtgtaacggaccaccaagtcgacgatcggtagccggactgagaggttgaacggccacattggaactgagaaacggtccagactcctacgggaggcagcagtggggaatattgggcaatgggcgaaagcctgacccagcgacgccgcgtgaaggaagacggtcctcggattgtaaacttcttttatgtaggacgaaagcaatgacggtactacatgaataagccacggctaactacgtgccagc

SEQ ID NO: 2632 - DNA, 490 bp, Unknown
  Ascusbbf_98749, encodes 16S rRNA
agagtttgatcatggctcaggatgaacgctagctacaggcttaacacatgcaagtcgcggggcagcgcgttgcagcaatgcgatggcggcgaccggcgcacgggtgagtaacgcgtatccgacctgtcccttactccgggatagccccccgaaagggggattaatacgggatgtgctgctggggttacatggttccggcagtaaaggagcgatccggtaagggttggggatgcgtcccattaggaagttggcggggtaacggcccaccaatcctgcgatgggtaggggtactgagaggtaggtcccccacactggaactgagacacggtccagactcctacgggaggcagcagtgaggaatattggtcaatgggcgcaggcctgaaccagccaagtagcgtggaggaggaatgccctacgggttgtaaactccttttccgggagggtaacgtgcggcacgcgtgccgtattgcaagtatcccgggaataa

SEQ ID NO: 2633 - DNA, 490 bp, Unknown
  Ascusbbf_383921, encodes 16S rRNA
agagtttgatcctggctcaggatgaatgctggcggcgtgcctaatacatgcaagtcgagcggtaacagggcttcaccgtttccttgacacacttggcctgagtgcaagtggttggatttcgagggaacagtgaagctgctgacgagcggcggacggctgagtaacgcgtgggaacggaccccaaactgagggataactactcgaaagagtggctaataccgcatgtgatcttcggattaaaggatttatccggtttgggactggcctgcgtacgattagatagttggtagggtaatggcctaccaagtcgacgatcgttagatggtttgagaagatgatcatccagactgggactgagacacggcccagactcctacgggaggcagcagtagggaatctttcacaatgggcgaaagcctgatggagcaacgccgcgtgcaggatgacggccttcgggttgtaaactgcttttataagcgagaaatatgat

SEQ ID NO: 2634 - DNA, 490 bp, Unknown
  Ascusbbf_235604, encodes 16S rRNA
agagtttgatcctggctcaggatgaacgctagcggcaggcttaacacatgcaagtcgaggggcagcgagatgtagtaatacattgtcggcgaccggcgcacgggtgcgtaacgcgtatgcaacctaccatatacaggggaataacctttcgaaagggagactaataccccatagtattacaataaggcatcttattgtaattaaagatttattggtatatgatgggcatgcgtgccattagttagttggtgaggtaacggctcaccaagacaacgatggctaggggttctgagaggaagaccccccacactggtactgagacacggaccagactcctacgggaggcagcagtgaggaatattggtcaatggacggaagtctgaaccagccatgccgcgtgcaggaagacggccctacgggttgtaaactgcttttatgtgagaataaccctagtcttgcgagattagctgaaggtatcacatgaataagg

SEQ ID NO: 2635 - DNA, 490 bp, Unknown
  Ascusbbf_676219, encodes 16S rRNA
agagtttgatcatggctcaggacgaacgctggcggcgtgcctaacacatgcaagtcgagcgatgaaaattggagcgttcccttcggggaacaatccgattggattagcggcggacgggtgagtaacacgtgagtaacctgccgtacacattgggatagcctcgggaaactgggattaataccaaatgaaacatacagatagcattatctaaatgtcaaagattttatcggtgtacgatggactcgcgtctgattagctagttggtaaggtaacggcttaccaaggcgatgatcagtagccggcctgagagggtgatcggccacattgggactgagacacggcccaaactcctacgggaggcagcagtggggaatattgcacaatggaggaaactctgatgcagcgacgccgcgtgagcgaagaagggattcgtctcgtaaagctctgtcctatgggaagataatgacggtaccatagaagaaagccccgg

SEQ ID NO: 2636 - DNA, 490 bp, Unknown
  Ascusbbf_403482, encodes 16S rRNA
agagtttgatcctggctcaggacgaacgctggcggcgtgcttaacacatgcaagtcgaacgctgaagcccttcggggtggatgagtggcggacgggtgagtaacacgtgggtaatctgccctgtactctgggataagcctcggaaacggggtctaataccggataggacatcgcctcgcatggggtggtgtggaaagttccggcggtatgggatgagcccgcggtctatcagcttgatggtggggtgatggcctaccatggcgacgacgggtagccggcctgagagggtgaccggccacactgggactgagacacggcccagactcctacgggaggcagcagtggggaatcttgcgcaatgggcgaaagcctgacgcagcaacgccgcgtgagggaggacggccttcgggttgtaaacctctttcgacaccgacgaaggccctcacgtgtgggggtggacggtaggtgtagaagaagcaccggctaacta

SEQ ID NO: 2637 - DNA, 490 bp, Unknown
  Ascusbbf_571474, encodes 16S rRNA
agagtttgatcatggctcaggacgaacgctggcggcgtgcttaacacatgcaagtcgaacgcgccatctttgggtggtgagtggcgaacgggtgagtaacacgtgagtaacctgcccctggctctgggataagccgtggaaacgcggtctaataccggatgtgaccttctgccgcatggtggggggtggaaagggtttctggttggggatgggctcgcggcctatcagcttgttggtggggtgatggctcaccaaggcgattacgggtagccggcctgagagggcgaccggccacactgggactgagacacggcccagactcctgcgggaggcagcagtggggaatattgcgcaatgggcgaaagcctgacgcagcgacgccgcgtgggggatgacggccttcgggttgtaaacctcttttctttccgatgaaggctctggctgttgttggggttgactaggggaggaataaggaccggctgactacgtg

SEQ ID NO: 2638 - DNA, 490 bp, Unknown
  Ascusbbf_80980, encodes 16S rRNA
agagtttgatcatggctcaggatgaacgctagcgacaggcttaacacatgcaagtcgaggggcatcgggggagtggcaacactcctgccggcgaccggcgcactggtgagtaacacgtatgcgacctgccccgcacagggggataatccgtggaaacgcggtctaataccccgtagtaccgtgggctgcatggttcacggtggaaagtggcgacacggtgcgggatgggcatgcggcgcattagcttgttggtggggcaacggcccaccaaggcgacgatgcgtaggggttctgagaggaaggtcccccacactggtactgagacacggaccagactcctacgggaggcagcagtgaggaatattggtcaatggacggcggtctgaaccagccaagtcgcgtgagggaaggaggccctacgggtcgtaaacctcttttgccggggagcaacgtgcgggacgtgtcccgcagtgagagtacccggagaaaa

SEQ ID NO: 2639 - DNA, 490 bp, Unknown
  Ascusbbf_646032, encodes 16S rRNA
agagtttgatcatggctcaggatgaacgctagcggcaggcttaacacatgcaagtcgaggggcagcgcggggtagcaatactctggcggcgaccggcggatgggtgagtaacgcgtatgtaatctgcctgtgacaggaggataacccgacgaaagtcggactaatactccataagaccacgtgggggcatccccgaggggtaaaaggcttcggccggtcacagatgaacatgcgttccattagctagttggtggggtcacggctcaccaaggcgacgatggataggggttctgagaggaagatcccccacattgggactgagacacggcccaaactcctacgggaggcagcagtgaggaatattggtcaatgggcggaagcctgaaccagccatgccgcgtgaaggatgacggccttatgggttgtaaacttcttttatgtgggagcaataaggcgcacgtgtgcgctgatgagagtaccacaggaataa

SEQ ID NO: 2640 - DNA, 490 bp, Unknown
  Ascusbbf_1372864, encodes 16S rRNA
agagtttgatcctggctcaggatgaacgctggcggcgtgcttaacacatgcaagtcaaacggagttatctcgctgaggagagcttactcaaatcttgagataacttagtggcggacgggtgagtaacgcgtggataacctgccttatactgggggataacacttagaaataggtgctaataccgcataagcgcacgttcccgcatgggaaagtgtgaaaaactccggtggtgtaagatggatccgcgtctgattagatagttggtgaggtaacggcccaacaagtcaacgatcagtagccgtcatgaggtgggcaacgacaccattgggactgggacacggcccaaactcctacgggaggcagcagtggggaatattgcacaatgggggaaaccctgatgcagcgacgccgcgtgagtgaagaagtatttcggtatgtaaagctctatcagcaaggaagaaaaaaatgacggtacttgactaagaagccc

SEQ ID NO: 2641 - DNA, 490 bp, Unknown
  Ascusbbf_1482970, encodes 16S rRNA
agagtttgatcctggctcaggatgaacgctggcggcgtgcctaacacatgcaagtcgagcgagaaggaggaagcttgcttccaaattctagcggcggacgggtgagtaacgcgtgggcaacctaccctgtacagggggataacaatgggaaaccattgctaataccccataacaccttctaggggcatcccttaaaggtcaaagaatttcggtataggatgggcccgcgtctgattagctagttggtgaggtaatggctcaccaaggcgacgatcagtagccggcctgagagggtgaacggccacactggaactgagacacggtccagactcctacgggaggcagcagtggggaatattgcacaatgggcgaaagcctgatgcagcaacgccgcgtgagcgatgaaggctttcgggtcgtaaagctctgtcctaagggaagataatgacggtaccttaggaggaagccccggctaactacgtgccagcag

SEQ ID NO: 2642 - DNA, 490 bp, Unknown
  Ascusbbf_174325, encodes 16S rRNA
agagtttgatcatggctcaggatgaacgctagcggcaggcttaacacatgcaagtcgaggggcagcgggtgtagcaatacatgccggcgaccggcgaaagggtgagtaacgcgtgagcaacatgcccgatactgggggatagtcattggaaacgatgcgtaataccccgtaacacaaatcttcgcatgggggtttgttgaaagattgattggtatcggattggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggatgacggccctatgggttgtaaaccgcttttgcgggggagcaataatcactacgagtagtgagatgagagtaccctgcgaataagcatc

SEQ ID NO: 2643 - DNA, 490 bp, Unknown
  Ascusbbf_192195, encodes 16S rRNA
agagtttgatcatggctcaggacgaacgctggcggcgtgcctaacacatgcaagtcgagcggggatgcagggaacggaagctacggcggaagggagctggatttcagcggcggacgggtgagtaacgcgtgaacaatctgtcccggacagggggataacacttggaaacaggtgctaataccgcataagaccacagcgccgcatggcggaggggtcaaaggagagatccggttcggggtgagttcgcgtctgattagctagttggtgaggtaacggcccaccaaggcgacgatcagtagccgacctgagagggtgatcggccacattggaactgagacacggtccaaactcctacgggaggcagcagtgggaatattgggcaatgggcgaaagcctgacccagcaacgccgcgtgagggaagaaggttttcggattgtaaacctctgttgtggatgacgaaggaagtgacggtaatccacaaggaagccc

SEQ ID NO: 2644 - DNA, 490 bp, Unknown
  Ascusbbf_225902, encodes 16S rRNA
agagtttgatcctggctcaggatgaacgctagcggcaggcctaacacatgcaagtcgagcgggattcggtggcttgccaccgatgagagcggcgcacgggtgcgtaacgcgtatgcaacctaccttttgctacgggatagcccagggaaacttggattaataccgtatagtatacgttccccccatggggtccgtattaaaggctacggcaaaagatgggcatgcgtcctattagctagatggtgtggtaacggcataccatggcaacgataggtaggggccctgagagggggatcccccacactggtactgagacacggaccagactcctacgggaggcagcagtgaggaatattggacaatgggcggaagcctgatccagccatgccgcgtgcaggaagactgccctatgggttgtaaactgcttttatacgggaagaaacaccccctcgtgagggggcttgacggtaccgtaggaataaggatcggc

SEQ ID NO: 2645 - DNA, 490 bp, Unknown
  Ascusbbf_408549, encodes 16S rRNA
agagtttgatcctggctcaggatgaacgctagcggcaggcctaacacatgcaagtcgaggggcagcacggtgtagcaatacactggtggcgaccggcgcacgggtgcgtaacgcgtatgcaacctacccataacagggggataacactgagaaattggtactaataccccataacatcaggaccggcatcggttctggttgaaaactccggtggttatggatgggcatgcgttgtattagctggttggtgaggtaacggctcaccaaggcaacgatacatagggggactgagaggttaaccccccacattggtactgagacacggaccaaactcctacgggaggcagcagtgaggaatattgatcaatggacgcaagtctgaaccagccatgccgcgtgcaggaagacggctctatgagttgtaaactgcttttgtacgagggtaaacgctcttacgtgtaagagcctgaaagtatcgtacgaataagga

SEQ ID NO: 2646 - DNA, 490 bp, Unknown
  Ascusbbf_213495, encodes 16S rRNA
agagtttgatcctggctcaggatgaacgctagcgggaggcctaacacatgcaagccgagcggtagaagtccttcgggactttgagagcggcgtacgggtgcgtaacacgtgtgcaacctacctttatctggggaatagcctttcgaaaggaagattaacaccccataatataatgattggcatcaattattattgaaaactccggtggatagagatgggcacgcgcaagattagatagttggtgaggtaacggctcaccaagtctgtgatctttaggggtcctgagagggagatcccccacactggtactgagacacggaccagactcctacgggaggcagcagtgaggaatattggacaatgggtgaaagcctgatccagccatcccgcgtgaaggatgacggtcctatggattgtaaacttcttttgtacaggaataaacctactctcgtgagagtagctgaaggtactgtacgaataagcaccggct

SEQ ID NO: 2647 - DNA, 490 bp, Unknown
  Ascusbbf_938, encodes 16S rRNA
agagtttgatcatggctcaggatgaacgctagcggcaggcttaacacatgcaagtcgaggggcagcacgggtggcaacacctggtggcgaccggcgcaagggtgcgtaacgcgtgagcaacatgcccgtaacagagggataaccggtggaaacgccgactaatacctcataaggatacatgacggcatcgtcgagtatctaaacctacgggggttacggattggctcgcgagacattaggtagacggcggggtaacggcccaccgtgccgacgatgtctaggggttctgagaggaaggtcccccacactggaactgagacacggtccagactcctacgggaggcagcagtgaggaatattggacaatggccggaaggctgatccagccatgccgcgtgcaggaagacggtcctatggattgtaaactgcttttgtacgagagcaataaggtgtacgtgtacaccgatgagagtatcgtacgaataagcat

SEQ ID NO: 2648 - DNA, 490 bp, Unknown
  Ascusbbf_1341, encodes 16S rRNA
agagtttgatcctggctcagagttaacgctggcatcgtgcataacacatgcaagtcgaacgggactttgcgctgtagcaatacagtgtaaagtttagtggcagacgggtgagtaatgtataagaaacctacctctgagtggggaataacagtccgaaaggattgctaataccccataacataatgaaaaggcatctttttattatcaaagatttatcgcttggagatggtcttatattctatcagctagttggcagtgtaacggactaccaaggcaacgacggatagccggcctgaaagggcgaccggccacaagggcactgagacacgggccctactcctacgggaggcagcagtggggaattttggacaatgggcgcaagcctgatccagcaacgatgcgtggaggatgaaggttctcggattgtaaactccttttgtaagggaagaaaaaaatgacggtaccttacgaataagccacggctaactac

SEQ ID NO: 2649 - DNA, 490 bp, Unknown
  Ascusbbf_2465, encodes 16S rRNA
agagtttgatcatggctcaggatgaacgctagcggcaggcttaacacatgcaagtcgaggggcagcgcggagtagcaatactctggcggcgaccggcggaagggtgcgtaacgcgtgagcaacctgcccgtaaccgggacataaccgatggaaacgtcgcctaatttcccataacaactggattggcatcacttcagtttgaaagcttcggtggttacggatgggctcgcgagacattagctggttggtagggtaacggcctaccaaggcgacgatgtctaggggttctgagaggaaggtcccccacactggaactgagacacggtccagactcctacgggaggcagcagtgaggaatattggtcaatgggcggaagcctgaaccagccatgccgcgtgcaggaataaggccctatgggtcgtaaactgcttttgtgcgggagcaataagtattacgtgtaatacgatgagagtaccgtacgaataagca

SEQ ID NO: 2650 - DNA, 490 bp, Unknown
  Ascusbbf_307862, encodes 16S rRNA
agagtttgatcctggctcagaacgaacgctggcggcgcgtcttaagcatgcaagtcgaatggcaagatagagcttgctctatcctagaatggcggactggtgagtaacgcgtgggtgacgtaccctttagatggggatagctggtagaaatatcagataataccgaataagctgtaactctttagaggggttacaggaaaggatcttttgatccgctgaaggagcggcccgcgtactattagctagttggtgaggtaacggcccaccaaggcgatgatagttacccggcctaagagggtgatcgggaacattgggactgagatacggcccagactcctacgggaggcagcagctaagaatattccgcaatggacgaaagtctgacggagcgacgccgcgtggatgatgaaggccggaaggttgtaaaatccttttaagtgtgaagaataagtagtgtgagagaaacgcattatggtgacggtaacacttg

SEQ ID NO: 2651 - DNA, 490 bp, Unknown
  Ascusbbf_1353580, encodes 16S rRNA
agagtttgatcatggctcagaacgaacgctggtggcgtgtcttatacatgcaagtcgaggggcatcgtggagtagcaatactctgacggcgaccggcgaaagggtgagtaacgcgtgagcaacatgcccggtaccggaggatagtcgatggaaacgtcgcgtaatactccgtaacatacggaaccgcatgattctgtattgagagatttatcgctaccggattggctcgcgtcccattaggcagttggcggggtaacggcccaccaaaccgacgatgggtaggggttctgagaggaaggtcccccacattggaactgagacacggtccagacccctacgggaggcagcagtgaggaatattggacaatggccgagaggctgatccagccatgccgcgtgcgggaggacggccctatgggttgtaaaccgcttttgtcagggggcaataagggtcacgtgtggactgatgagagtacctggcgaataagca

SEQ ID NO: 2652 - DNA, 490 bp, Unknown
  Ascusbbf_29293, encodes 16S rRNA
agagtttgatcatggctcaggatgaacgctggcggcaggcttaatacatgcaagtcgaacggtaaggcccgaagtagcaatacggagggtacacgagtggcgcacgggtgcgtaacgcgtatgcaacctgccccgcaccgggacaaaacagctggaaacggctgctaatatcccatagtcacacgagggggcatccctttgtgtgtaaagattcattggtgcgggatgggcatgcgtattattaggtagttggcggggtaacggcccaccaagccgacgatgattaggggtcctgagagggttaacccccacactggaactgagacacggtccagactcctacgggaggcagcagtagggaatattgggcaatggaggaaactctgacccagccatgccgcgtgaaggaagacggccctatgggttgtaaacttcttttgttgcagagtaaacccggccacgcgtggccggctgagagtatgcgacgaat

SEQ ID NO: 2653 - DNA, 490 bp, Unknown
  Ascusbbf_31996, encodes 16S rRNA
agagtttgatcatggctcaggatgaacgctggcggcgtgcataacacattcaagtcgaacgatgaagggacttcggtcctggaatagtggcggacgggtgagtaacgcgtgagcaacctgccttgcattgggggataacgtttggaaacgaacgctaataccgcataacgtataaatatcgcatgttagatataccaaagatttattgatgcaagatgggctcgcgtccgattagatagttggtgaggtaacggcccaccaagtcgacgatcggtagccggactgagaggttgaacggccacattggaactgagaaacggtccagactcctacgggaggcagcagtggggaatattgggcaatgggcgaaagcctgacccagcgacgccgcgtgagggaagaagatcttcggattgtaaacctctttcagcaaggaagaagaaagtgacggtacttgcagaagaagccacggctaactacgtgccagcag

SEQ ID NO: 2654 - DNA, 490 bp, Unknown
  Ascusbbf_141488, encodes 16S rRNA
agagtttgatcatggctcaggattaacgctggcggcatgcctaatacatgcaagtcgaatgggaaagcttgcttttccatggcgaacgggtgagtaacacgtaggtaacctaccttaaggacgaggataacctttggaaacgaaggataatactggataggacattacaaagcacatgcttaaatgtttaaaggagcaatccaccataagaggggcctgcggcgcattagctagttggtgaggtaaaggcccaccaaggcgatgatgcgtagctggactgagaggttgaacagccacaatgggactgagaacggcccatactcctacgggaggcagcagtagggaattttcggcaatggacgaaagtctgaccgagcaatgccgcgtgaacgaagaagtatttcggtatgtaaagttcttttatcagggaagaaaaaacaaattgactgaacctgatgaataagctccggctaactacgtgccagcagcc

SEQ ID NO: 2655 - DNA, 490 bp, Unknown
  Ascusbbf_37121, encodes 16S rRNA
agagtttgatcatggctcaggacgaacgctggcggcatgcctaacacatgcaagtcgaacggagatcagagagcttgctttctgatcttagtggcggacgggtgagtaacgcgtgagcaacctgccctttagtggggaataatgttctgaaaaggacactaataccgcataacgtattgaagccgcatgactttgataccaaaggatttattcgctgaaggatgggctcgcgtccgattagctggttggtggggtaaaggcctaccaaggcgacgatcggtagccggactgagaggttgaacggccacattgggactgagacacggcccagactcctacgggaggcagcagtgggggatattgcgcaatgggggaaaccctgacgcagcaatgccgcgtgaaggacgaaggtcttcggattgtaaacttcttttgtcagggacgaaaaatgacggtacctgacgaataagctccggctaactacgtgcca

SEQ ID NO: 2656 - DNA, 486 bp, Unknown
  Ascusbbf_85133, encodes 16S rRNA
agagtttgatcctggctcagaacgaacgctggcggcacgcttaacacatgcaagtcgaacggagtaatggagcttgctctattacttagtggcggacgggtgagtaacacgtgggaacatgtccatttgtggtggatagcttcgggaaactgaagataatacagcataagcttgagaaaggaaaggtcgaaagatcgcgaatggggtggcccgcggctgattaggtagttggtggggtaaaggcttaccaagccgatgatcagtagctggtctgagaggatgatcagtcacactggaactgagatacggtccagactcctacgggaggcagcagtggggaatattggacaatgggggcaaccctgatccagcgatgccgcgtgagtgaagaaggttttaggattgtaaagctcttttgacagggaagatgatgacggtacctgtagaataagcaccggctaactctgtgccagcagccgcggtaat

SEQ ID NO: 2657 - DNA, 490 bp, Unknown
  Ascusbbf_160619, encodes 16S rRNA
agagtttgatcctggctcaggacgaacgctggcggcgtgcttaacacatgcaagtcgaacgaagctgggagaaagatttcttcggaatgaattcttctaagactgagtggcggacgggtgagtaacgcgtgagcaacctgcccttcggagggggatagtgtctggaaacggacagtaataccgcataacgtacagatacggcatcgtgactgtaccaaagatttatcgccgaaggatgggctcgcgtctgattagatagttggtggggtaacggcctaccaagtcgacgatcagtagccggactgagaggttgatcggccacattgggactgagacacggcccagactcctacgggaggcagcagtggggaatattgcacaatgggcgcaagcctgatgcagcaacgccgcgtggaggaagacggttttcggattgtaaactcctgttcttagggaagaagacagtgacggtacctaaggagaaagccac

SEQ ID NO: 2658 - DNA, 490 bp, Unknown
  Ascusbbf_110519, encodes 16S rRNA
agagtttgatcatggctcaggatgaacgctggcggcgtgcataacacattcaagtcgaacggtgaagtcccttcggggatggagcagtggcggacgggtgagtaacgcgtgagcaacctgccgtacagagggggataacacagggaaacctgtgctaataccgcataacgcatggggatcgcatgttttccatgccaaagagaaattgctgtacgatgggctcgcgtatgattagacagttggcggggtaacggcccaccaaatcaacgatcattagccgaactgagaggttgaacggccacattggaactgagaaacggtccagactcctacgggaggcagcagtggggaatattgggcaatgggcgaaagcctgacccagcgacgccgcgtgagggaagaaggtcttcggattgtaaacctctttcagcagggaagaaggaagtgacggtacctgcagaagaagtcacggctaactacgtgccagcag

SEQ ID NO: 2659 - DNA, 490 bp, Unknown
  Ascusbbf_196595, encodes 16S rRNA
agagtttgatcatggctcagattgaacgctagcggcatgcttaacacatgcaagtcgaacggtaacaggcctagcttgctaggtgctgacgagtggcggacgggtgagtaacgcgtaggaatctacctaatagtgtggaataacctggggaaacccaggctaataccgcatgtgccctaaggggtaaagcaggggactgtaaaaggccttgcgctatttgatgagcctgcgtcggattagctagttggtggggtaaaggcctaccaaggcgatgatccgtagctggtctgagaggacgaccagccacactgggactgagacacggcccagactcctacgggaggcagcagtggggaatattggacaatgggcgcaagcctgatccagcaatgccgcgtgtgtgaagaaggcctgcgggttgtaaagcactttcagtagggaggaaggcttcattgttaataacaatgaagattgacgttacctacagaag

SEQ ID NO: 2660 - DNA, 490 bp, Unknown
  Ascusbbf_265617, encodes 16S rRNA
agagtttgatcctggctcaggatgaacgctagcggcaggcttaacacatgcaagtcgaggggcagcacgaggtagcaatactttggtggcgaccggcgcacgggtgcgtaacgcgtatgcaacctacctttaacaggggcataacactgagaaattggtactaattccccataacattcgagaaggcatcttcttgggttaaaaactccggtggttaaagatgggcatgcgttgtattagctagttggtgaggtaacggctcaccaaggcaacgatacatagggggactgagaggttaaccccccacattggtactgagacacggaccaaactcctacgggaggcagcagtgaggaatattggtcaatggacgcaagtctgaaccagccatgccgcgtgcaggaagacggctctatgagttgtaaactgcttttgtactagggtaaacgcttctacgtgtaggagcctgaaagtatagtacgaataagga

SEQ ID NO: 2661 - DNA, 490 bp, Unknown
  Ascusbbf_118935, encodes 16S rRNA
agagtttgatcctggctcaggacgaacgctggcggcgtgcttaacacatgcaagtcgaacgggaagctttgacaagttttactttgatgagtggacagtggcgaacgggtgagtaacgcgtaggtaaccaaccttatgctgggggatagcctttggaaacgaagagtaataccgcataagaccacactgccgcatggcagaggggtaaaagatttattggcatgagacggacctgcgtaccattagatagttggtggggtaacggcctaccaagtcgacgatggttagccgacctgagagggtgatcggccacattgggactgagacacggcccagactcctacgggaggcagcagtggggaatattgtacaatggaggaaactctgatacagcaacgccgcgtgagtgatgaaggttttaggattgtaaagctctgtctttggggacgaagaaagtgacggtacccaaggaggaagccccggctaacta

SEQ ID NO: 2662 - DNA, 490 bp, Unknown
  Ascusbbf_744755, encodes 16S rRNA
agagtttgatcctggctcaggataaacgctggcggcgcacataagacatgcaagtcgaacgaacttaattcattcttatagattgaaagcggttagtggcggactggtgagtaatgtgtaagcaatctgcctattagaggggaacaacagtcggaaacgactgctaataccgcatatgccataactatcgcatgatagaagtgggaaaggagcaatccgctgatagatgagcttacatctgattagctagttggtggggtaacggcctaccaaggcgacgatcagtagccgaactgagaggttaaacggccacattgggactgagatacggcccagactcctacgggaggcagcagtcgggaatattgcgcaatggaggaaactctgacgcagtgacgccgcgtgcaggaagaaggttttcggattgtaaactgctttagacagggaagaacaaggacagtacctgtagaataagctccggctaactacg

SEQ ID NO: 2663 - DNA, 468 bp, Unknown
  Ascusbbf_208241, encodes 16S rRNA
agagtttgatcctggctcagaacgaacgctggcggcaggcttaacacatgcaagtcgagcgccccgcaaggggagcggcagacgggtgagtaacgcgtgggaatctacccagtccttcggaatagctcctggaaacgggaattaataccggatacgccctttgggggaaagatttatcgggattggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcaccggtgaagataatgacggtaaccggagaagaagccccggctaacttcgtgccagcagccgcggtaat

SEQ ID NO: 2664 - DNA, 490 bp, Unknown
  Ascusbbf_1804299, encodes 16S rRNA
agagtttgatcctggctcaggacgaacgctggcggcgtgctttaaacatgcaagtcgaacggaggttaggtgttccactaagcatttctatatgaggtgtttagtggaatgcttacccttagtggcggacgggtgagtaacgcgtgagtaatctacctctttctgggggacaacagttggaaacgactgctaataccgcatatgaccacagagacacaagtcttaggggtgaaagatttatcgaaaagagatgagctcgggtagcattagttagttggtgaggtaacggcccaccaagacgatgatgcttagccgatctgagaggatgatcggccacactggaactgagatacggtccagactcctacgggaggcagcagttaggaatattgggcaatggaggcaactctgacccagcaacgccgcgtgaaggatgaaggtcctcggattgtaaacttctgtattagaggaagaagatagtgacggtact

SEQ ID NO: 2665 - DNA, 490 bp, Unknown
  Ascusbbf_792346, encodes 16S rRNA
agagtttgatcctggctcaggatgaacgctagcggcaggcctaacacatgcaagtcgaggggtatttggagcttgctccaaagagaccggcgcacgggtgcgtaacgcgtatgcaatctgccttgtactgagggatagcccggagaaatccggattaatacctcatggttaatttagttggcatcaattgaattataaagatttatcggtacaagatgagcatgcgtcccattagctagttggtatggtaacggcataccaaggctatgatgggtaggggtcctgagagggagatcccccacactggtactgagacacggaccagactcctacgggaggcagcagtgaggaatattggtcaatggacggaagtctgaaccagccatgccgcgtgcaggacgacgcatctatggtgtgtaaactgcttctatacgggaagaaacctctctacgtgtagagacttgacggtaccgtaagaataaggatcggc

SEQ ID NO: 2666 - DNA, 490 bp, Unknown
  Ascusbbf_339604, encodes 16S rRNA
agagtttgatcctggctcaggatgaacgctagcgggaggcctaacacatgcaagccgagcggtattgtttcttcggaaatgagagagcggcgtacgggtgcggaacacgtgtgcaacctgcctttatctgggggatagcctttcgaaaggaagattaatactccataatatattgattggcatcaattaatattgaaagctccggcggatagagatgggcacgcgcaagattagctagttggtgaggtaacggctcaccaaggcgatgatctttagggggcctgagagggtgatcccccacactggtactgagacacggaccagactcctacgggaggcagcagtgaggaatattggtcaatgggtgcaagcctgaaccagccatcccgcgtgaaggacgactgccctatgggttgtaaacttcttttgtatagggataaacctaccctcgtgagggtagctgaaggtactatacgaataagcaccggct

SEQ ID NO: 2667 - DNA, 490 bp, Unknown
  Ascusbbf_469459, encodes 16S rRNA
agagtttgatcatggctcaggatgaacgctggcggcgtgcttaacacatgcaagtcgagcgagaactcgctcagccaattcttcggatgaagcagagcgacggaaagcggcggacgggtgagtaacgcgtgggaaacctgccctttgcagggggacagccgagggaaacttcgattaataccccataacaccaaagtatcgcatggtacaatggccaaagatttatcggcaaaggatggtcccgcgtctgattagttagttggtgaggtagcggctcaccaaggcgacgatcagtagccggcctgagagggtgaacggccacgttggaactgagacacggtccagactcctacgggaggcagcagtggggaatattgcacaatgggcgaaagcctgatgcagcaacgccgcgtgaaggaagaaggccttcgggtcgtaaacttctgtcctaggggaagaaaaatgacggtacccttggaggaagccccgg

SEQ ID NO: 2668 - DNA, 490 bp, Unknown
  Ascusbbf_505392, encodes 16S rRNA
agagtttgatcctggctcaggatgaacgctggcggcgtgcttaacacatgcaagtcgaacggagctgttccggacgcctagggcttcggccacgggcggaaggaacgacttagtggcggacgggtgagtaacgcgtgggcaacctgcctttttccgggggataacacagggaaacctgtgctaataccgcataaagtcatctgaggacatcctctaatgaccaaaggaatttttccggggaaagaggggcccgcgtctgattagcttgttggtgaggtaacggcccaccaaggcaacgatcagtagccgaactgagaggttgatcggccacattgggactgagacacggcccagactcctacgggaggcagcagtggggaatattgcgcaatgggggaaaccctgacgcagcaacgccgcgtgaaggatgaaggttttcggattgtaaacttctttgacaggggacgaacaatgacggtaccctgaaaac

SEQ ID NO: 2669 - DNA, 490 bp, Unknown
  Ascusbbf_122064, encodes 16S rRNA
agagtttgatcatggctcaggatgaacgctggcggcgcgcctaacacatgcaagtcgaacggacgaggctcttcggagccaagttagtggcgaacgggtgagtaacacgtgaggaacctgcctttcagagggggataacacttagaaataggtgctaataccgcataagaccacagagcggcatcgctcaggggtcaaaggagcaatccgctgaaagatggcctcgcgtccgattaggtagtaggcggggcaacggcccacctagcctgcgatcggtagccggactgagaggttgatcggccacattgggactgagacacggcccagactcctacgggaggcagcagtggggaatattgggcaatgggggaaaccctgacccagcgacgccgcgtgagggaagaaggttttcggattgtaaacctctgtcttcggggacgataatgacggtacccgaggaggaagctacggctaattacgtgccagcagc

SEQ ID NO: 2670 - DNA, 490 bp, Unknown
  Ascusbbf_1347021, encodes 16S rRNA
agagtttgatcctggctcaggatgaacgctggcggcgtgcttaacacatgcaagtcgaacggagttatctcgctgaggagagcttgctcaaatcttgagataacttagtggcggacgggtgagtaacgcgtggataacctgccttatactgggggataacacttagaaataggtgctactaccgcataagcgcacgttcccgcatgggaaagtgtgaaaaactccggtggtgtacgatggatccgcgtctgattagatagttggtgaggtaacggcccaccaagtcaacgatcagtagccggcctgagagagggaacggcaacattgggactgagcgacggcgcaaacgcctacgggaggcagcagtggggaagattgcacaatgggggaaagcctgaggcagcgacgccgcgtgagtgaagaagtatgtcggtatgtaaagctctatcagcaaggaagaaaaaaatgacggtacttgactaagaagccc

SEQ ID NO: 2671 - DNA, 490 bp, Unknown
  Ascusbbf_37018, encodes 16S rRNA
agagtttgatcatggctcaggacgaacgctggcggcgcgcctaacacatgcaagtcgaacggagttaagagagcttgctttcttaacttagtggcggacgggtgagtaacacgtgagcaacctgcctttcagtgggggacaacagttggaaacgactgctaataccgcataacgttgcgaaggggcatccctttgcaaccaaagatttatcgctgaaagatgggctcgcgtctgattagatagttggtgaggtaacggcccaccaagtcgacgatcagtagccggactgagaggttgaacggccacattgggactgagacacggcccagactcctacgggaggcagcagtgggggatattggacaatgggggcaaccctgatccagcgacgccgcgtgagggaagaaggttttcggattgtaaacctctgttgacagggaagaaaatgacggtacctgttaagaaagccacggctaactacgtgccagca

SEQ ID NO: 2672 - DNA, 490 bp, Unknown
  Ascusbbf_171130, encodes 16S rRNA
agagtttgatcatggctcaggacgaacgctggcggcgtgcttaacacatgcaagtcgaacgagtgtatgaaggagcttgctcttgattacacgagtggcggacgggtgagtaacgcgtgaataatctgtcctatacagggggataacgcatcgaaagatgtgctaataccgcgtaggaccacggtactgcatggtactgaggtgaaaggagcaatccagtatagggtgagttcgcgtctgattagatagttggtgcggtaacggcgcaccaagtcaacgatcagtagccgacctgagagggtgatcggccacattgggactgagacacggcccagactcctacgggaggcagcagtggggaatattgggcaatgggcgaaagcctgacccagcaacgccgcgtgaaggaagaaggttttcggattgtaaacttctgtcctatgtgaagagcgagagacggtagcataggaggaagccccggctaactacg

SEQ ID NO: 2673 - DNA, 490 bp, Unknown
  Ascusbbf_59196, encodes 16S rRNA
agagtttgatcctggctcaggatgaacgctggcggcgtgcttaacacatgcaagtcgaacggagctttttatgaacaagacttcggtcaagtgaattctaagcttagtggcggacgggtgagtaacgcgtgagcaacctgcctttcagagggggataacgtttggaaacagacgctaataccgcatgacatagttttctcgcatgagaggactatcaaaggagcaatccgctgaaagatgggctcgcgtccgattaggtagttggtgaggtaacggcccaccaagccgacgatcggtagccggactgagaggttgaacggccacattgggactgagacacggcccagactcctacgggaggcagcagtggggaatattgcacaatgggcgaaagcctgatgcagcaacgccgcgtgagggaagacggttttcggattgtaaacctctgtctttggtgaagaagaagtgacattagccgaggaggaagcca

SEQ ID NO: 2674 - DNA, 354 bp, Unknown
  Ascusbbf_363946, encodes 16S rRNA
agagtttgatcctggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataatgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgccagcagccgcggtaat

SEQ ID NO: 2675 - DNA, 490 bp, Unknown
  Ascusbbf_144240, encodes 16S rRNA
agagtttgatcctggctcaggatgaacgctggcggcgtgcttaacacatgcaagtcgaacgaagcgtctcgcccgaagaagcgaagtgcttgcacggagtggattcaattgagacgacttagtggcggacgggtgagtaacgcgtgggtaacctgccgtatgcagggggacaacagttggaaacgactgctaataccgcataagcgcacggctcggcatcgagcagtgtgaaaagatttatcggcatacgatggacccgcgtctgattagctagttggtgaggtaacggcccaccaaggcgacgatcagtagccgacctgagagggtgaccggccacattgggactgagacacggcccaaactcctacgggaggcagcagtggggaatattgcacaatgggcgcaagcctgatgcagcgacgccgcgtgagcgatgaagtatttcggtatgtaaagctctatcagcagggaagataatgacggtacctga

SEQ ID NO: 2676 - DNA, 490 bp, Unknown
  Ascusbbf_114555, encodes 16S rRNA
agagtttgatcatggctcaggatgaacgctagctacaggcttaacacatgcaagtcgaggggcagcatgtatctggcttgccagatatgatggcgaccggcgcacgggtgcgtaacgcgtatccaacctgccgtttacccggggacagcctcgcgaaagcgagattaatacccgatgttgtgcgtattccgcatggtgtgcgcaccaaaggtttttccggtaagcgatggggatgcgtacgattagctggtcggcggggtaacggcccaccgaggcatcgatcgttaggggttctgagaggatggccccccacactgggactgagacacggcccagactcctacgggaggcagcagtgaggaatattggtcaatgggcgtaagcctgaaccagccaagtagcgtgcaggacgactgccttacaggttgtaaactgcttttatgcgggggtaaagtgtcccacgtgtgggatattgcaagtaccgcatgaa

SEQ ID NO: 2677 - DNA, 490 bp, Unknown
  Ascusbbf_708811, encodes 16S rRNA
agagtttgatcctggctcagaacgaacgctggcagcgtggattaggcatgcaagtcgaacgggatccggagggcagcaatgttctccggtgagagtggcggaagggcgaggagcacgtggacaacctgtccagaggacggggaaaacctcgggaaactgaggctaatacccgatgcgccgggaggagggcatccttcctccggcaaagggggcgagagctcccgcctcacgaagggtccgcgcaccatcagcttgttggcggggtgacggcccaccaaggctcacggttagctggtctgagaggatgaccagccgcactgggactgagatactgcccagactcctacgggaggctgcagtcgaggatcattcgcaatgggggaaaccctgacgatgcgacgctgcgtggaggatggaggccttcgggttgtaaactcctgtcatgggggaagaggcggagggacccaacacgtccccgagttgacggtac

SEQ ID NO: 2678 - DNA, 490 bp, Unknown
  Ascusbbf_3503, encodes 16S rRNA
agagtttgatcatggctcaggatgaacgctggcggcgtgcttaacacatgcaagtcgaacgaggcacctttgcagaagttttcggatggaagcggaggcgaccgagtggcggacgggtgagtaacgcgtggggaacctgccccattccgggggataccagttggaaacgactgttaataccgcataagcgcacggaaggacatccttttgtgtgaaaaactgaggtggaatgggatggccccgcgtctgattagccagttggcagggtaacggcctaccaaagcgacgatcagtagccggcctgagagggcgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaagatgacggtacctgcacaagaagccccggct

SEQ ID NO: 2679 - DNA, 490 bp, Unknown
  Ascusbbf_7506, encodes 16S rRNA
agagtttgatcatggctcaggatgaacgctggcggcaggcttaatacatgcaagtcgaacggtaaggtccgaagtggcaacacggaggatacacgagtggcgcacgggtgcgtaacgcgtatgcaacctgcccccgaccgggacaaaacagctggaaacggctgctaatatcccatggtcatgcggaagggcatccttcttcatgtaaagattcattggtcggggatgggcatgcgtattattaggtagttggcggggtaacggcccaccaagccgacgatgattaggggtcctgagagggttaacccccacactggaactgagacacggtccagactcctacgggaggcagcagtagggaatattgggcaatgggagcaatcctgacccagccatgccgcgtgaaggaagacggccctatgggttgtaaacttcttttgccgcagagtaaacccggtcacgagtggtcggttgagagtatgcggcgaat

SEQ ID NO: 2680 - DNA, 490 bp, Unknown
  Ascusbbf_72759, encodes 16S rRNA
agagtttgatcatggctcaggatgaacgctagcggcaggcttaacacatgcaagtcgaggggcagcgcgggtagcaatacctggcggcgaccggcgaaagggtgagtaacgcgtgagcaacatgcccgatactgggggatagtcattagaaatgatgcgtaataccccgtaacacattttcccgcatgggtagatgttgaaagattgattggtatcggattggctcgcgtgccattagctagatggcggggtaacggcccaccatggcgacgatggctaggggttctgagaggaaggtcccccacattggaactgagacacggtccagactcctacgggaggcagcagtgaggaatattggacaatggccggaaggctgatccagccatgccgcgtgcgggaagacggccctatgggttgtaaaccgcttttgcgggggagcaataagagtcacgagtggctcgatgagagtaccctgcgaataagcatc

SEQ ID NO: 2681 - DNA, 490 bp, Unknown
  Ascusbbf_29608, encodes 16S rRNA
agagtttgatcatggctcaggatgaacgctggcggcgtgcctaatacatgcaagtcgaacgctaaccttcgggttagagtggcgaacgggtgagtaacacgtaggtaacctgcccataagacgaggataactactggaaacggtagctaatactggataggatattgaatcgcatgatttaatatttaaagatgcgtttgcatcacttatggatggacctgcggcgcattagctagttggtgaggtaacggcccaccaaggcgacgatgcgtagccggactgagaggttgaacggccacattgggactgagacacggcccagactcctacgggaggcagcagtagggaattttcggcaatggacgcaagtctgaccgagcaacgccgcgtgagtgatgaagttcttcggaacgtaaaattcttttatttggaaaaaacgtatgttgtaggaaatgacaatatagtgatggtaccaaatgaataagccccg

SEQ ID NO: 2682 - DNA, 489 bp, Unknown
  Ascusbbf_102528, encodes 16S rRNA
agagtttgatcatggctcagaacgaacgctggcggcaggcctaacacatgcaagttgaacgggattgacgggtagcttgctatttgtcatgagagtagcgcactggtgagtaacacgtgggaacataccttttagtgggggacaacagggggaaacttctgctaataccgcataaaccctgagggggaaaggagcaattcgctaaaagattggcccgcggaagattaggtagttggtgaggtaaaggcccaccaagcctacgatctatagctggtctgagaggacgaacagccacattggaactgagacacggtccagactcctacgggaggcagcagtgaggaatattgggcaatggaggaaactctgacccagccatgccgcgtgagtgagaaggtcttcggattgtaaagctcttttatacaggaagatgatgacagtactgtaagaaaaagcaccggcaaacttcgtgccagcagccgcggtaat

SEQ ID NO: 2683 - DNA, 490 bp, Unknown
  Ascusbbf_366184, encodes 16S rRNA
agagtttgatcctggctcagggtgaacgctagcggcaggcttaacacatgcaagtcgaggggcagcgggtctagcaatagatgccggcgaccggcgaaagggtgagtaacgcgtgagcaacgtgcccgtctgtgggggatagtcattggaaacgatgcgcaataccccgtaacatatcggatcgcatggtctggtattgaaagattgattgcagacggatcggctcgcgtaccattaggtagacggcggggtaatggcccaccgtgccgacgatggttaggggttctgagaggaaggtcccccacattggaactgagacacggtccagactcctacgggaggcagcagtgaggaatattggacaatggccggaaggctgatccagccatgccgcgtgcgggaagacggccctatgggttgtaaaccgcttttgcgagggagcaataaggtctacgcgtagaccgatgagagtaccttacggataagcatc

SEQ ID NO: 2684 - DNA, 490 bp, Unknown
  Ascusbbf_205657, encodes 16S rRNA
agagtttgatcctggctcaggatgaacgctagcgacaggcttaacacatgcaagtcgaggggcagcggagatgtagcaatacatttgccggcgaccggcgcacgggtgagtaacgcgtatgcaacctacctatcagaggagaataacccggcgaaagtcggactaatactccataaaacaggggtctcgcatgagactatttgttaaagatttatcgctgatagatgggcatgcgttccattagctagttggtgaggtaacggctcaccaaggcaacgatggatcggggttctgagaggaaggtcccccacactggtactgagacacggaccagactcctacgggaggcagcagtgaggaatattggtcaatgggcgcgagcctgaaccagccaagtcgcgtgaaggatgaaggatctatggttcgtaaacttcttttatacgggaataaagtgcagcacgtgtgctgttttgtatgtaccgtaatgaat

SEQ ID NO: 2685 - DNA, 490 bp, Unknown
  Ascusbbf_238854, encodes 16S rRNA
agagtttgatcatggctcaggatgaacgctggcggtgtgcctaatacatgcaagtcgagcgggagaacttgttctctagcggcgaacgggtgagtaacacgttggtaatctacctttcagttggggatacccaggcgaaagcttggctaataccgtaatacgtattaatctgaaatgtttaatataaaaggcccttcggggtcgctgatagatgagcctgcgtctgattagctagttggtgagataatagcccaccaaggcgaggatcagtagccgacctgagagggtgatcggccacaatggaactgagacacggtccatactcctacgggaggcagcagtagggagtcttcgacaatgggggaaaccctgatcgagcaacaccgcgtgaatgatgaaggtcttcggattgtaaaattcttttgttagggagaaatggtcagtataggtaatgatactgatttgatagtacctttcgaataagcaacga

SEQ ID NO: 2686 - DNA, 486 bp, Unknown
  Ascusbbf_1434952, encodes 16S rRNA
agagttgatcctggctcagaacgaacgctggcggcaggcttaacacatgcaagttgagcgggattgattagtagcttgctattgatcatgagagcagcgcactggtgagtaacacgttggaacataccttttgtttggggacaacagttggaaacgactgctaataccgcataagccctaagggggaaagattcattgccgaaagattggcccgcggaagattaggtagtaggtggggtaacggcctacctagccgacgatctatagcttgtctgagaggacgatcagccacattggaacggagacacggtccagactcctacgggaggcagcagggaggaatattgggcaatggaggcaactcggacacagccatgccgcgtgagtgaagaaggttttcggatggtaaagctctgtcagacgggaagaggatgacggtaccgtcagaagaagcaccggctaacttcgtgccagcagccgcggtaa

SEQ ID NO: 2687 - DNA, 490 bp, Unknown
  Ascusbbf_178184, encodes 16S rRNA
agagtttgatcatggctcagaatcaacgctggcggcgtgcctcagacatgcaagtcgaacgattaagacttccttcgggaagtgtataaagtggcgcacgggtgagtaacacgtaagtaatctaccttcgagtggggaataacatcgggaaatcggtgctaataccgcataatgcagcggcacctaatggtgacagttgttaaaggaatttatttcgcttgaagaggagcttgcggcagattagctagttggtaaggtaaaggcttaccaaggctacgatctgtatccggcctgagagggcggtcggacacactgacactgaataacgggtcagactcctacgggaggcagcagtcgggaattttgggcaatgggggaaaccctgacccagcaacgccgcgtgaaggatgaagtatttcggtatgtaaacttcgaaagaataggaagaataaatgacggtactatttataagctccggctaactacgtgc

SEQ ID NO: 2688 - DNA, 490 bp, Unknown
  Ascusbbf_1487805, encodes 16S rRNA
agagtttgatcatggctcagattgaacgctggcggcaggcttaacacatgcaagtcgagcgggggaaggtagcttgctaccggacctagcggcggacgggtgagtaatacttaggaatctgcctattagtgggggacaacgtttcgaaagggacgctaataccgcatacgtcctacgggagaaagcaggggctctttatgaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggcatttttgttgtaaagcactttaagcgaggaggaggctctttaggttaataccctgaatgagtggacgttactcgcagaataagc

SEQ ID NO: 2689 - DNA, 490 bp, Unknown
  Ascusbbf_770294, encodes 16S rRNA
agagtttgatcctggctcaggatgaacgctggcggcgtgcctaacacatgcaagtcgaacggggatctagaggaaaaggtacttgtacctcggaatttagattctagtggcggacgggtgagtaacacgtgagcaacctgccttgatcagggggataacaacgggaaaccgttgctaataccgcataatatgccgctggggcatcccagtggcatcaaaggagtaatccggattgagatgggctcgcgtccgattagttagttggtgaggtaacggctcaccaagactgcgatcggtagccggactgagaggttgaccggccacattgggactgagacacggcccagactcctacgggaggcagcagtggggaatattgggcaatgggggaaaccctgacccagcgacgccgcgtgaaggatgaaggccttcgggttgtaaacttctttgatcggggacgataatgacggtacccgaggaacaagccacg

SEQ ID NO: 2690 - DNA, 490 bp, Unknown
  Ascusbbf_347, encodes 16S rRNA
agagtttgatcatggctcaggatgaacgctggcggcaggcttaatacatgcaagtcgaacggtaaggcctgaagtggcaacacggagggtacacgagtggcgcacgggtgcgtaacgcgtatgcaacctgcccccaaccgggacaaaacagctggaaacggctgctaatatcccatagtcatgaggaggggcatccctctttatgtaaagattcattggttggggatgggcatgcgtattattaggtagttggcggggtaacggcccaccaagccgacgatgattaggggtcctgagagggttatcccccacactggaactgagacacggtccagactcctacgggaggcagcagtagggaatattgggcaatgggagcaatcctgacccagccatgccgcgtgaaggaagacggtcctatggattgtaaacttcttttgccgcagagtaaacggtgccacgtgtggtgctttgagagtatgcggcgaat

SEQ ID NO: 2691 - DNA, 490 bp, Unknown
  Ascusbbf_28526, encodes 16S rRNA
agagtttgatcatggctcaggatgaacgctggcggcgtgcctaacacatgcaagtcgaacggagatcatatggacagaggcttcggccgaaggaagtttgatcttagtggcggacgggtgagtaacgcgtggggaacctgccccataccgggggataacagatagaaatgtctgctaataccgcataagcgcacgaggtcgcatgaccctgtgtgaaaaactccggtggtatgggatggacccgcgttggattagccagttggcggggtaacggcccaccaaagcgacgatccatagccggcctgagagggtgaacggccacattgggactgagacacggcccagactcctacgggaggcagcagtggggaatattgcacaatggggggaaccctgatgcagcgacgccgcgtgaaggaagaagtatctcggtatgtaaacttctatcagcagggaagaaaatgacggtacctgactaagaagccccggc

SEQ ID NO: 2692 - DNA, 490 bp, Unknown
  Ascusbbf_48878, encodes 16S rRNA
agagtttgatcatggctcaggatgaacgctagcgggaggcttaacacatgcaagtcgaggggcagcgcgggtagcaatacctggcggcgaccggcggacgggtgagtaacacgtatgcaacctgccctgcacaggggaatagcccggagaaatccggattaatgccccatggtccactgggtccgcatggatctggtggtaaagattcatcggtgcaggatgggcatgcgttccattagctagttggcggggcaacggcccaccaaggcgacgatggatatggggtctaaaaggatggtcccacacattggcactgagatacgggccaaactcctacgggaggcagcagtgaggaatattggtcaatgggcgagagcctgaaccagccatcccgcgtgcaggatgaaggtcttacagattgtaaactgcttttgcaggggacgaataagggccacgtgtggtccgatgacagtactctgtgaataagcat

SEQ ID NO: 2693 - DNA, 490 bp, Unknown
  Ascusbbf_1808780, encodes 16S rRNA
agagtttgatcatggctcaggatgaacgctggcggcgtgcctaatacatgcaagtcgaacgagggtgcttgcaccctagtggcgaacgggtgagtaacacgtaggtaatctgcccttaagcttgggatacccagaggaaactttggctaataccggataacaacagaggaggcatctcctcagcttgaaaggccctgcaaggggtcacttaaggatgaacctgcggcgcattagctagttggtgagataacagcccaccaaggcgaggatgcgtagccgacctgagagggtgatcggccacattggaactgagacacggtccaaactcctacgggaggcagcagtaaggagtgttcggcaatgggggaaaccctgaccgagcaacgccgcgtgagcgatgacggccctatgggttgtaaagctctgttgtaagggacgaatgactagcttaggaaatgcagctagtttgacggtaccttaccagaaagcc

SEQ ID NO: 2694 - DNA, 490 bp, Unknown
  Ascusbbf_37626, encodes 16S rRNA
agagtttgatcctggctcagagcgaacgctagcggcatgcttaacacatgcaagtcgaacgagggaagttgattgagtagcaatacgatttcaatggaacgagtggcaaacgggtgagtaatatattggaacttgcccagtagtgggggacaacagttggaaacgactgctaataccgcataacgcagagatgcgaaagccgaaaggcgctattggagaggccaatacacgattagctagttggtggggtaaaggcctaccaaggcggtgatcgttagccggtcttagaggacgatcggccacattgggactgagacacggcccagactcctacgggaggcagcagtggggaatattggacaatgggcgaaagcctgatccagcaatgccgcgtgagtgatgaaggcgttatgcgttgtaaaactcttttgcatatgaaaataatgatggtaatatgagaataagcaccgactaactatgtgccagcagc

SEQ ID NO: 2695 - DNA, 490 bp, Unknown
  Ascusbbf_112868, encodes 16S rRNA
agagtttgatcctggctcaggatgaacgctggcggcgcatttaagacatgcaagtcgaacgaagaatttgcaccgaatgaaagatgaagattcatcagattctggatttcaccgtaaattcttagtggcggacgggtgagtaatacgtagataatctgccttctagagggaaataacagagagaaatttctgctaatgtcccataagaccacactatggcatcttagagtgatcaaaggagtaatccgctagaagatgagtctacggctgattagccagttggcagtgtaagagactaccaaagctatgatcagtagccgagctgagaggctggccggccacattgggactgagacacggcccagactcctacgggaggcagcagttgggaatattggacaatggaggaaactctgatccagtgacgccgcgtgaaggaagaaggtcttcggattgtaaacttattttgtcagggaagaattttgactgt

SEQ ID NO: 2696 - DNA, 490 bp, Unknown
  Ascusbbf_23991, encodes 16S rRNA
agagtttgatcatggctcaggatgaacgctggcggcgtgcctaacacatgcaagtcgaacgaagcattaggctttgagattttcggattgagaagccttctgacttagtggcggacgggtgagtaacgcgtgggtaacctgccgtatgcagggggacaacagttggaaacgactgctaataccgcataagcgcacgagatcgcatggttttgtgtgaaaagatttatcggcatacgatggacccgcgtctgattaggtagttggtgaggtaacggcccaccaagcctgcgatcagtagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgcacaagaagccccgg

SEQ ID NO: 2697 - DNA, 490 bp, Unknown
  Ascusbbf_1890154, encodes 16S rRNA
agagtttgatcatggctcagaacgaacgctggcggcgtgcttaacacatgcaagtcgaacggcagcgcggacttcggtctggcggcgagtggcgaacgggtgagtaatatatcggaacgtgcccagtagcgggggataactacgcgaaagcgtggctaataccgcatacgccctacgggggaaagggggggattcttcggaacctctcactattggagcggccgatatcagattagctagttggtggggtaaaggctcaccaaggcgacgatctgtagctggtttgagaggacgaccagccacactgggactgagaaacggcccagactcctacgggaggcagcagtggggaattttggacaatgggggaagccctgatccagccatcccgcgtgtgcgatgaaggccttcgggttgtaaagcacttttggcagggaagaaacggcgccgcctaatacggggcgtcactgacggtacctgcagaataagc

SEQ ID NO: 2698 - DNA, 490 bp, Unknown
  Ascusbbf_20953, encodes 16S rRNA
agagtttgatcatggctcagaacgaacgctggcggcgcgtcttaagcatgcaagtcgagcggtaagttatagcttgctataacctagagcggcggactggtgagtaacgcgtgggtgacgtaccctttggacggggatagcctgtggaaacacagggtaataccggatacggtgtcatgtgtcagaggcatgacaggaaaggttcttttgaaccgccgaaggagcggcccgcgtgctattagttagttggcggggtaacggcccaccaagacgacgatagctacccggcctaagagggtgaacgggcacattgggactgagatacggcccagactcctacgggaggcagcagctaagaatattccgcaatgggggaaaccctgacggagcgacgccgcgtggatgatgaaggccggaaggttgtaaaatccttttgggagcgaggaataatgaaagtgagagaaacgctttcaggtgacggtagcttctg

SEQ ID NO: 2699 - DNA, 490 bp, Unknown
  Ascusbbf_252151, encodes 16S rRNA
agagtttgatcatggctcagaatgaacgctggcggcatggattaggcatgcaagtcgaacggggcccttcggggccgagtggcgaaagggtgagtaacacgtgagcaatctgcccccaaggctggaataagcactggaaacggtgtctaaaaccggatgaggtccgggtccgcatggtcccgcaaccaaatattcataccctggggatgagctcgcggcccattagctagttggcggggtaacggcccaccaaggctgcgacgggtaggtggtctgagaggatggtcacccacactgggactgagacactgcccagactcctacgggaggctgcagtcgagaatcttccgcaatgggcgcaagcctgacggagcgatgccgcgtgagggacgaaggccttcgggtcgtaaacctctgtcaccggggacgaattcatgacggtacccggaaaggaagccacggctaaccacgtgccagcagccgcggtaat

SEQ ID NO: 2700 - DNA, 468 bp, Unknown
  Ascusbbf_210235, encodes 16S rRNA
agagtttgatcctggctcagaacgaacgctggcggcatgcctaacacatgcaagtcgaacgatggcttcggccatagtggcgcacgggtgagtaacacgtgggaacctgcctttcggttcggaataacgtctggaaacggacgctaacaccggatacgtccttcgggagaaagtttacgccgagagaggggcccgcgtcggattaggtagttggtggggtaatggcctaccaagcctgcgatccgtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgcgacgatgatgacggtagcgtgagaagaagccccggctaacttcgtgccagcagccgcggtaat

SEQ ID NO: 2701 - DNA, 490 bp, Unknown
  Ascusbbf_86798, encodes 16S rRNA
agagtttgatcatggctcaggactaacgctggcggcgtgcttaaaacatgcaagtcgaacgggcgattgaggaaagcttgcttttctcgaaagctagtggcggacgggtgagtaacgcgtgaacaatctgcctttcactggggaataacagatagaaatatctgctaataccgcatatgaccacaacgaggcatctcgaaggggtgaaagattttatcggtgaaagatgagttcgcgtaacattagctagttggtgaggtaacggcccaccaaggcaacgatgtttagccggcctgagagggtgaacggccacactggaactgagacacggtccagactcctacgggaggcagcagttaggaatattgggcaatgggggaaaccctgacccagcaacgccgcgtgaaggatgaaggtcctcggattgtaaacttctgttataaaggaataagaaagtgaaggtactttatgagaaagcaccggctaacta

SEQ ID NO: 2702 - DNA, 490 bp, Unknown
  Ascusbbf_234383, encodes 16S rRNA
agagtttgatcatggctcaggatgaacgctggcggcgtgcttaacacatgcaagtcgaacggaacagatcaaccgaaacggaaggtgcttgcaccggaagtttcacctggtatgtttagtggcggacgggtgagtaacgcgtgagcaaccaaccttttgcagtgggataacaattagaaatgattgctaataccgcataagaccacactaccgcatgatagagtgggaaaaactccggtggcaaaagacgggctcgcgtccgattagctggatggtgaggtaacggcccaccatggcgacgatcggtagccggactgagaggtcgaccggccacattgggactgagacacggcccagactcctacgggaggcagcagtggggaatattgcacaatgggggaaaccctgatgcagcgacgccgcgtgagtgaagacgtatttcggtatgtaaagctcttttagcagggaagatgatgacggtacctgcaga

SEQ ID NO: 2703 - DNA, 490 bp, Unknown
  Ascusbbf_192944, encodes 16S rRNA
agagtttgatcatggctcagattgaacgctagcgggatgccttacacatgcaagtcgaacggcagcgggaaagtagcttgctacttttgccggcgagtggcgaacgggtgagtaatgtatcggaacgtgcccagtagcgggggataactacgcgaaagcgtggctaataccgcatacgccctacgggggaaagggggggatcttaggacctctcactattggagcggccgatatcggattagctagttggtggggtaaaggcctaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttgtcagggaagaaaaggtttcggataatacccggaactgatgacggtacctgaaga

SEQ ID NO: 2704 - DNA, 490 bp, Unknown
  Ascusbbf_790143, encodes 16S rRNA
agagtttgatcctggctcaggatgaacgctagcggcaggcttaacacatgcaagtcgaggggcagcataataagtagcaatacctattgatggcgaccggcggatgggtgcgtaacgcgtatgcaacctaccttatacagggggataacctttcgaaagggagactaacaccccatagtattaatttaaggcatcttagattaattaaatatttataggtataagatgggcatgcgtatgattagctagttggtaaggtaacggcttaccaaggctacgatcattaggggttctgagaggaaggtcccccacactggtactgagacacggaccagactcctacgggaggcagcagtgaggaatattggtcaatgggcgcaagcctgaaccagccatgccgcgtgcaggatgacagccttatgggttgtaaactgcttttacataagactaaccgtatatttgcgaatatacctgaatgtattatgagaat

SEQ ID NO: 2705 - DNA, 490 bp, Unknown
  Ascusbbf_1740614, encodes 16S rRNA
agagtttgatcctggctcaggatgaacgctagcggcaggcctaacacatgcaagtcgaggggcagcgggaaggggctcgcccttttgccggcgaccggcgcacgggtgcgcagcgcgtatggaacctgccctttacaggggaacagcccagggaaacttggattaatgccccatggcgccgtttcgcggaatcgcgttacggtcaaagcctccgggcggtaaaggatggccatgcgtcccattagctagttggtgcggtaacggcgcaccaaggccgcgatgggtaggggccctgagagggggatcccccacactggtactgagacacggaccagactcctacgggaggcagcagtgaggaatattggacaatgggcgggagcctgatccagccatgccgcgtgcaggaagaccgccctatgggtcgtaaactgcctttgtacgggaagaacaaggggcacttgtgcccccctgacggtaccgtaagaat

SEQ ID NO: 2706 - DNA, 490 bp, Unknown
  Ascusbbf_131934, encodes 16S rRNA
agagtttgatcatggctcaggacgaacgctggcggcatgcctaacacatgcaagtcgaacggtaaggccccttcgggggtacacgagtggcgaacgggtgagtaacacgtgggtaacctgcccttcactgggggacaaccgagggaaacttcggctaataccgcatgatgtgcaacgtctcaagacgatgtaccaaaactccggtggtgaaggatgggcccgcggcggattagctagttggtggggtaatggcctaccaaggcgacgatccgtagctggtctgagaggacgatcagccacactggaactgagacacggtccagactcctacgggaggcagcagtggggaatcttgcgcaatgggcgaaagcctgacgcagcaatgccgcgtgagggaagacggtcttaggattgtaaacctctttcagcagggacgaaaacagacggtacctgcagaagaagccccggctaactacgtgccagcagccgc

SEQ ID NO: 2707 - DNA, 490 bp, Unknown
  Ascusbbf_49744, encodes 16S rRNA
agagtttgatcatggctcaggacgaacgctggcggcgtgcctaacacatgcaagtcgaacgaagctcctgcgttgattcttcggatgaaacaagggaagacttagtggcggacgggtgagtaacgcgtgagcaacctgcctttcagagggggataacagttggaaacgactgctaataccgcataacgtattgatgtcgcatggcattgataccaaagctgaggcgctgagagatgggctcgcgtccgattagatagttggtggggtaacggcctaccaagtcgacgatcggtagccggactgagaggttgaacggccacattgggactgagacacggcccagactcctacgggaggcagcagtgggggatattgcacaatgggcgaaagcctgatgcagcaacgccgcgtgagggaagacggttttcggattgtaaacctctgtctttggtgaagaaggaagtgacggtagccaaggaggaagccacgg

SEQ ID NO: 2708 - DNA, 490 bp, Unknown
  Ascusbbf_28118, encodes 16S rRNA
agagtttgatcatggctcaggatgaacgctggcggcgtgcttaacacatgcaagtcgaacggagctttttatgaacaagacttcggtcaagtgaattctaagcttagtggcggacgggtgagtaacgcgtgagcaacctgcctttcagagggggataacgtttggaaacagacgctaataccgcataacacggcgatatcgcatggtaatgccgtcaaaggagcaatccgctgagagatgggctcgcgtccgattaggtagttggtgaggtaacggcccaccaagccgacgatcggtagccggactgagaggttgaacggccacattgggactgagacacggcccagactcctacgggaggcagcagtggggaatattgcacaatgggcgaaagcctgatgcagcaacgccgcgtgagggaagacggttttcggattgtaaacctctgtctttggtgaagaagaagtgacattagccgaggaggaagcca

SEQ ID NO: 2709 - DNA, 490 bp, Unknown
  Ascusbbf_209070, encodes 16S rRNA
agagtttgatcatggctcagaacgaacgctggcggcgcgtcttaagcatgcaagtcgagcgggaatacctagcttgctaggtatgagagcggcggactggtgagtaacacgtagataacgcaccctttagacggggatagctgccagaaatggcagataataccggatgtgaacgtatgccgtgaaggtgtacgtggaaaggagcttcggctccgctagaggaacggtctgcggcccatcagctggttggcggggtaaaggcccaccaaggcgatgacgggtatccggcctgagagggtgagcggacacattgggactgagatacggcccagactcctacgggaggcagcagctaagaatattccgcaatgggggaaaccctgacggagcgacgccgcgtggatgatgaaggccggaaggttgtaaaatccttttgaaaccgaggaataagttctgcaggaaatggcaggatggtgactgtaagttttga

SEQ ID NO: 2710 - DNA, 490 bp, Unknown
  Ascusbbf_35927, encodes 16S rRNA
agagtttgatcatggctcaggataaacgctggcggcgtgcttaacacatgcaagtcgaacggagtagttctcccgaggattgatgaagcttgcttctgataaactcatttgagctacttagtggcggacgggtgagtaacgcgtgggtaacctgccctatgcagggggataacagttggaaacgactgttaataccgcataagcgcacagtatcgcatggtacagtgtgaaaaactccggtggcataggatggacccgcgtctgattagctagttggtgaggtaacggcccaccaaggcgacgatcagtagccggcctgagagggtgtacggccacattgggactgagacacggcccaaactcctacgggaggcagcagtggggaatattggacaatgggggaaaccctgatccagcgacgccgcgtgaacgatgaagtatttcggtatgtaaagttctatcagcagggaagataatgacggtacctgac

SEQ ID NO: 2711 - DNA, 490 bp, Unknown
  Ascusbbf_711850, encodes 16S rRNA
agagtttgatcctggctcaggatgaacgctggcggcatgcctaagacatgcaagtcgaacgaagtagcctgttgaagactgagtgcttgcacgaagttggattcagattcctacttagtggcagacgggtgagtaacacgtgggtaacctacctcagagactgggataacaattagaaatgattgctaataccggatgattcatagatagaaaactatttatgctaaaagaagcgtttgcttcactttgagatgggcttgcgttgtattagttagttggtggggtaatggcctaccaagacaacgatgcatatccgagctgagaggctgatcggacacactgggactgagacacggcccagactcctacgggagacagcagttaggaatattcgtcaatgggggaaaccctgaacgagcaatgccgcgtgagtgatgaaggtcttatagattgtaaaactctgttgtaaagaaagaaaccttaagatagg

SEQ ID NO: 2712 - DNA, 472 bp, Unknown
  Ascusbbf_308285, encodes 16S rRNA
agagtttgatcctggctcagagcgaacgctggcggcaggcttaacacatgcaagtcgagcgcgtgtagcaatacacgagcggcagacgggtgagtaacacgtgggaacgtgccttctggttcggaataactcagggaaacttgagctaataccgaataagcccttcgggggaaagatttatcgccggaagatcggcccgcgtaagattagctagttggtgaggtaatggctcaccaaggctacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttagcagggacgataatgacggtacctgcagaaaaagccccggccaacttcgtgccagcagccgcggtaat

SEQ ID NO: 2713 - DNA, 490 bp, Unknown
  Ascusbbf_1324295, encodes 16S rRNA
agagtttgatcctggctcaggatgaacgctagcgacaggcttaacacatgcaagttgaggggcagcgcgacgagagcaatcttgctggcggcgaccggcgcactggtgagtaacacgtatgcaacctgccccctgccggggaataacccagggaaacctggcctaatgccgcataacacccgcggggacatccccgctggttgaaagctccggcggcaggggatgggcatgcgccgcattagcttgttggtggggtgacggcccaccacggcgacgatgcgtaggggttctgagaggaaggtcccccgtactggtactgagaaccggaccagactcctacgggaggcagcagtgaggaatattggtcaatggacgcgagtctgaaccagccaagtcgcgtgagggaagacggccctacgggttgtaaacctcttttgccggggagcaaccgcccgcacgcgtgcgggtctgagcgtacccggagaaaaag

SEQ ID NO: 2714 - DNA, 490 bp, Unknown
  Ascusbbf_2174, encodes 16S rRNA
agagtttgatcatggctcaggatgaacgctagcggcaggcttaacacatgcaagtcgaggggcagcgcgggtagcaatacctggcggcgaccggcgaaagggtgcgtaacgcgtgagcaacttgcccgtatccgggggataagcgctggaaacggcgtctaataccgcataacaacagaagccgcatgacttctgtttgaaaactccggtggatacggatgggctcgcgagacattagcttgttggcggggtaacggcccaccaaggctacgatgtctaggggttctgagaggaaggtcccccacattggaactgagacacggtccaaactcctacgggaggcagcagtgaggaatattggtcaatggccggaaggctgaaccagccatgccgcgtgaaggattaaggccctatgggtcgtaaacttcttttgtggtggagcaataagtgtcacgtgtggcacgatgagagtacatcacgaataagcatc

SEQ ID NO: 2715 - DNA, 490 bp, Unknown
  Ascusbbf_9791, encodes 16S rRNA
agagtttgatcatggctcaggatgaacgctggcggcgtgcctaacacatgcaagtcgaacggacgaggcggagcttgctctgccgagttagtggcggacgggtgagtaacgcgtgagcaacctgcctttcagagggggacaacgttgggaaaccggcgctaataccgcataatgtgcttttgtcgcatggcgaaagtaccaaaggagcaatccgctgaaagatgggctcgcgtctgattagatagttggtgaggtaacggcccaccaagtcgacgatcagtagccggactgagaggttgaacggccacattggaactgagatacggtccagactcctacgggaggcagcagtggggaatattgggcaatgggcgaaagcctgacccagcaacgccgtgtgaaggaagaaggtcttcggattgtaaacttttgtcatgtgggacgataatgacggtaccacaagaggaagtcacgactaactacgtgccag

SEQ ID NO: 2716 - DNA, 490 bp, Unknown
  Ascusbbf_20864, encodes 16S rRNA
agagtttgatcatggctcaggataaacgctggcggcgtgcttaacacatgcaagtcgaacggggttatttcgagtagcttgctacatgaaataacctagtggcggacgggtgagtaacgcgtgggaaacctgcctcgtactgggggataacagttggaaacgactgttaataccgcataagcgcacgatgtcgcatgacatagtgtgaaaaactccggtggtacgagatggtcccgcgtctgattagctagttggtgaggtaacggcccaccaaggcgacgatcagtagccggcctgagagggtgtacggccacattgggactgagacacggcccaaactcctacgggaggcagcagtggggaatattgcacaatgggcgaaagcctgatgcagcgacgccgcgtgagtgatgaagtatctcggtatgtaaagctctatcagcagggaagataatgacggtacctgactaagaagcaccggctaaatacg

SEQ ID NO: 2717 - DNA, 490 bp, Unknown
  Ascusbbf_489399, encodes 16S rRNA
agagtttgatcatggctcaggacgaacgctggcggcgtgcttaacacatgcaagtcgaacgagaatggttgggagcttgcttctggctattcgagtggcggacgggtgagtaacgcgtgagcaacctgtctcacacaggggaataacgcatcgaaagatgtgctaataccgcataggaccacgggaggacatccttctgaggtgaaaggagcaatccggtgtgaggtgggctcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgcaagcctgacccagcaacgccgcgtgaaggaagaaggttttcggatcgtaaacttctgtccttggtgaagagaagaagacggtagctaaggaggaagccccggctaactacg

SEQ ID NO: 2718 - DNA, 490 bp, Unknown
  Ascusbbf_287603, encodes 16S rRNA
agagtttgatcatggctcagaacgaacgctggcggcgcgtcttaagcatgcaagtcgggcgggattccccagcttgctggggatgagagcggcggactggtgagtaacgcgtgggcgacgcgccccgtggaccgggatagcctgtggaaacacagggtaataccgggcgagctcccccgcgccggaggcgggggaggaaaggagccgaggctccgccacgggagcggcccgcgtcccatcagctggatggcggtgcaagggaccaccatggctatgacgggtacccggcctcagagggcgaccgggcacattgggactgagatacggcccagactcctacgggaggcagcagctaagaatattccgcaatggggggaaccctgacggagcgacgccgcgtggacgaggaaggccggaaggttgtaaagtccttttcgcgccgaggaaggagccggggagggaatgccccggcggtgactgtaggcgggga

SEQ ID NO: 2719 - DNA, 490 bp, Unknown
  Ascusbbf_212323, encodes 16S rRNA
agagtttgatcctggctcaggatgaacgctggcggcgtgcttaacacatgcaagtcgaacgattaaagccccttcgggggtgtatagagtggcgaacgggtgagtaacacgtgagcaacctaccttctgttctgggataacttgaggaaactcaagctaataccggatattccgtctgctccgcatggtgcggatgggaaagcgcatacgacagaagatgggctcgcgtcccattagctagttggtagggtaatggcctaccaaggcgatgatgggtagccgggttgagagaccgaccggccacattgggactgagacacggcccaaactcctacgggaggcagcagtggggaattttgcgcaatgggcgaaagcctgacgcagcaacgccgcgtgcgggatgaaggccttcgggttgtaaaccgctttcagtagggaagattatgacggtacctacagaagaagctccggctaactacgtgccagcagc

SEQ ID NO: 2720 - DNA, 490 bp, Unknown
  Ascusbbf_1897320, encodes 16S rRNA
agagtttgatcatggctcaggatgaacgctagcggcaggcttaacacatgcaagtcgaacgagaaagcaccttcgggtgtaagtagagtggcgaacgggtgagtaacacgtgagcaacctgcctttcactttggaataactcagagaaatttgtgctaataccaaatactccgtatctttcgcatgattaatacgggaaagcttttgcggtgaaagatgggctcgcggcccattagatagttggtggggtgacggcctaccaagtcgacgatgggtagccgggttgagagaccgaccggccacattggaactgagacacggcccagactcctacgggaggcagcagtggggaattttgcgcaatgggggaaaccctgacgcagcaacgccgcgtgcgggatgaaggccttcgggttgtaaaccgctttcagtagggaagaaaatgacggtacctacagaagaagctccggctaactacgtgccagcagcc

SEQ ID NO: 2721 - DNA, 472 bp, Unknown
  Ascusbbf_1341268, encodes 16S rRNA
agagtttgatcctggctcagagcgaacgctggcggcaggcttaacacatgcaagtcgcacgaaggggtcggcctgagtggcggacgggtgaggaacgcggaggaagcgatccaggggtgggggagaactctgggaaactggagcgaagaccgcaggatacctgagggtcaaaggcgcaagtcgcctgtggaggagcctgcgttcgatgagcttgttggtggggtaatggcctaccaaggcgatgatcgatagctggtctgagaggaggatcagccacactgggactgagacacggcccagactcctacgggcggcagccgtggggactcttggccactgggggcctccctgctcccgcgctgccgcgtgtgtgaagacggttttcggcttgtacagcactttcggcggggacgatgatgaccgtacccgcagaagacgccccggctaacttcgtgccagcagccgcggtaat

SEQ ID NO: 2722 - DNA, 490 bp, Unknown
  Ascusbbf_58941, encodes 16S rRNA
agagtttgatcctggctcaggatgaacgctagctacaggcctaacacatgcaagtcgaggggcagcatggagaaagcttgctttctctgatggcgaccggcgaatgggtgagtcacgcgtgtccaacctgccccccgcccggggatagcccttggaaatgaggattaagacccgatatgtggcgcctccgcatggcggcgccatgaagcaggcaggggatggggacgcgtcggattagctggacggcggggcaaaggcccaccgtggcgacgatccgcaggggttctgagaggaaggtcccccacactggcactgagacacgggccagactcctacgggaggcagcagtgaggaatattggtcaatggccgcgaggctgaaccagccaagtagcgtgcaggacgacggccctacgggttgtaaactgctttttcgggaggataaaggacgtcacgtgtggcgttttgcaggtatcccgtgaataaggacc

SEQ ID NO: 2723 - DNA, 490 bp, Unknown
  Ascusbbf_20959, encodes 16S rRNA
agagtttgatcatggctcaggatgaacgctagcggcaggcttaacacatgcaagtcgaggggcagcgggagtagcaatacttgccggcgaccggcggaagggtgcgtaacgcgtgagcaacttgcccgtatctgggggataagcgatggaaacgtcgtctaataccgcgtaacaactgaggccgcatgaccttagtttgaaagcttcggcggatacggataggctcgcgagacattagctagttggagtggtaacggcacaccaaggcgacgatgtctaggggttctgagaggaaggtcccccacattggaactgagacacggtccaaactcctacgggaggcagcagtgaggaatattggtcaatggccggaaggctgaaccagccatgccgcgtgcaggattaaggccctatgggtcgtaaactgcttttgtggtggagcaataaggcgtacgcgtacgccgatgagagtacatcacgaataagcatc

SEQ ID NO: 2724 - DNA, 490 bp, Unknown
  Ascusbbf_49736, encodes 16S rRNA
agagtttgatcctggctcaggattaacgctggcggcatgcctaatacatgcaagtcgaatggggagcttgcttcccatggcgaacgggtgagtaatacgtaggtaacctacctttaggacgaggataacctttggaaacgaaggataatactggatagtatagatttccgcatggagatatatttaaagatttatcacctagagaggggcctgcggtgcattagctagttggcgggataaaagcccaccaaggcgatgatgcatagccggactgagaggttgtacggccacaatggaactgagaacggtccatactcctacgggaggcagcagtagggaattttcggcaatgggcggaagcctgaccgagcaatgccgcgtgaatgatgaagtatttcggtatgtaaagttcttttatctaggaagaaaaaacaaattgacggtactagatgaataagctccggctaactacgtgccagcagccgcggta

SEQ ID NO: 2725 - DNA, 490 bp, Unknown
  Ascusbbf_205742, encodes 16S rRNA
agagtttgatcatggctcaggatgaacgctagcggcaggcttaacacatgcaagtcgaggggcagcgggctgtagcaatacggtgccggcgaccggcggacgggtgcgtaacgcgtatgcaacctgcccggcacaggggaatagcccggcgaaagccggagtaatgccccatggttccagcatcccgcatggggagctggataaacccgcgagggggtgccggatgggcatgcgtggcattaggcagttggcggggtaacggcccaccaaaccgacgatgcctaggggtcctgagagggaggtcccccacattggaactgagacacggtccaaactcctacgggaggcagcagtgaggaatattggtcaatggaggcaactctgaaccagccatgccgcgtgcaggaagacggccttatgggttgtaaactgcttttgttcgggacgagcatgaatacgagtattcaagtgacggtaccggaagaataag

SEQ ID NO: 2726 - DNA, 490 bp, Unknown
  Ascusbbf_25029, encodes 16S rRNA
agagtttgatcatggctcaggacgaacgctggcggcgtgcctaacacatgcaagtcgaacggagattaagatttcggttttaatctgagtggcgaacgggtgagtaacgcgtgagcaacctgcccttcagagggggataaccgctggaaacagcagctaataccgcataagaccacagcccggcatcggggaggggtcaaaggagcaatccgctgaaggaggggctcgcgtcccattagatagttggcgggataacagcccaccaagtcgacgatgggtagccgagctgagaggctgatcggccacactggaactgagacacggtccagactcctacgggaggcagcagtggggaatattgggcaatgggcgcaagcctgacccagcaacgccgcgtgagggaagaaggctttcgggttgtaaacctctgtccttggtgacgaagaagtgacggtagccaaggaggaagccccggctaactacgtgccag

SEQ ID NO: 2727 - DNA, 490 bp, Unknown
  Ascusbbf_134097, encodes 16S rRNA
agagtttgatcctggctcaggacgaacgctggcggcgtgcctaacacatgcaagtcgaacggactgattcccttcggggatgaaagttagtggcggacgggtgagtaacgcgtgagcaacctgcctttcagaggggaataacgtttggaaacagacgctaataccgcataacgcataggtgtcgcatggcatttatgccaaaggagcaatccgctgaaagatgggctcgcgtccgattagatagttggtggggtaacggcctaccaagtcgacgatcggtagccggactgagaggttgaacggccacattgggactgagacacggcccagactcctacgggaggcagcagtgggggatattgcacaatgggcgcaagcctgatgcagcaacgccgcgtgagggaagacggttttcggattgtaaacctctgtctttggtgacgaagaaatgacggtagccgaggaggaagccacggctaactacgtgcca

SEQ ID NO: 2728 - DNA, 490 bp, Unknown
  Ascusbbf_700317, encodes 16S rRNA
agagtttgatcatggctcaggacgaacgctggcggcacgcttaacacatgcaagtcgaacggagttattgagagcttgcttttaataacttagtggcggacgggtgagtaacacgtgagcaatctgcctttcagagggggatagcagttggaaacgactgataataccgcataatatagtaggatcgcatgatttaactatcaaagatttatcgctgaaagatgagctcgcgtctgattagatagttggtgaggtaacggctcaccaagtcgacgatcagtagccggactgagaggttgaacggccacattgggactgagacacggcccagactcctacgggaggcagcagtggggaatattgcacaatgggcgcaagcctgatgcagcgatgccgcgtgagggaagaaggttttaggattgtaaacctctgtcttcagggacgataatgacggtacctgaggaggaagctccggctaactacgtgccag

SEQ ID NO: 2729 - DNA, 490 bp, Unknown
  Ascusbbf_110970, encodes 16S rRNA
agagtttgatcctggctcaggatgaacgctagcggcaggcttaacacatgcaagtcgaggggcagcacgtcttcggatggtggcgaccggcgcacgggtgagtaacgcgtatgcaatctaccttttacaggggcatagcccggggaaacccggattaatatcctatagtaccaagatatagcattatactttggttaaagcttcggcggtaaaagatgagcatgcgtcctattagctagatggtaaggtaacggcttaccatggctatgataggtaggggtcctgagagggagaccccccacactggtactgagacacggaccagactcctacgggaggcagcagtgaggaatattggacaatgggcgagagcctgatccagccatgccgcgtgcaggaagacggccctatgggttgtaaactgcttttacagaggaagaaacaccccctcgtgagggggcttgacggtactctgcgaataaggatcggc

SEQ ID NO: 2730 - DNA, 490 bp, Unknown
  Ascusbbf_497791, encodes 16S rRNA
agagtttgatcatggctcaggacgaacgctggcggcgtgcctaacacatgcaagtcgagcgaggacgaggggcttcggtcccgagttcgagcggcggacgggtgagtaacgcgtgaacaatctgtcccatacagggggataccacttggaaacaggtgctaataccgcataagaccacgcagccgcatggctaaggggtaaaagggataccggtatggggtgagttcgcgtccgattagatagttggtgaggtaacggcccaccaagtcaacgatcggtagccgacctgagagggtgatcggccacattggaactgagagacggtccaaactcctacgggaggcagcagtgggaatattgggcaatgggcgaaagcctgacccagcaacgccgcgtgagggaagaaggttttcggattgtaaacctctatcgtagaggacgaagagaatgacggtactctacaaggaagccccggctaactacgtgccag

SEQ ID NO: 2731 - DNA, 490 bp, Unknown
  Ascusbbf_119736, encodes 16S rRNA
agagtttgatcctggctcaggatgaacgctggcggcgtgcttaacacatgcaagtcgaacggagtatgttaaccgaagtcttcggacttcacctgatatacttagtggcggacgggtgagtaacgcgtgagcaaccaacctcatacagggggataacaattagaaatgattgctaataccccataagaccacagcaccgcatgatgcagtgagaaaaactccggtggtatgagacgggctcgcgttcgattagcttgatggtgaggtaacggcccaccatggcgacgatcgatagccggactgagaggtcgaccggccacattgggactgagacacggcccagactcctacgggaggcagcagtggggaatattgcacaatgggggaaaccctgatgcagcgacgccgcgtgagtgaagaagtatttcggtatgtaaagctcttttagcagggaagaagatgacggtacctgcagaaaaagccccggcta

SEQ ID NO: 2732 - DNA, 490 bp, Unknown
  Ascusbbf_160534, encodes 16S rRNA
agagtttgatcctggctcaggatgaacgctggcggcgtgcctaacacatgcaagtcgaacgatgaagccggcttcggccgggtatgaagtggcgaacgggtgagtaacacgtgaccaacctgccccgcgccccgggatagcctcgagaaatcgggattaacaccggatactccgcgggccccgcatggggccggcgggaaagctttgcggcgcgggatggggtcgcggcccattaggtagcaggcggggtgacggcccacctggccgacgatgggtagccgggttgagagaccgaccggccacattgggactgagatacggcccagactcctacgggaggcagcagtggggaatattgcgcaatgggcgcaagcctgacgcagcaacgccgcgtgcgggaagaaggccctcgggttgtaaaccgctttcagcagggaagatcgtgacggtacctgcagaagaagccccggctaactacgtgccagcagcc

SEQ ID NO: 2733 - DNA, 490 bp, Unknown
  Ascusbbf_679237, encodes 16S rRNA
agagtttgatcctggctcaggatgaacgctagcggaaggcctaacacatgcaagccgagcgggatttatttattagcttgctaataaataatgagagcggcgtacgggtgcggaacacgtgtgcaacctgcctttatctgggggatagccattcgaaaggatgattaatgccccataatatattgaatggcatcatttgatattgaaagctccggcggatagagatgggcacgcgcaagattagatagttggtgaggtaacggctcaccaagtcaatgatctttaggggtcctgagagggagatcccccacactgggactgagacacggcccagactcctacgggaggcagcagtgaggaatattggacaatgggtggaagcctgatccagccattccgcgtgcaggaagacggtcctatggattgtaaactgcttttatatagggataaacctactctcgtgagagtagctgaaggtactatatgaata

SEQ ID NO: 2734 - DNA, 490 bp, Unknown
  Ascusbbf_313244, encodes 16S rRNA
agagtttgatcatggctcaggatcaacgctggcggcgtgcctaatgcatgcaagtcgaacggggtctccttcgggggactcacgtggcggacgggtgaggaacacgtggccaatctgcccaccggcagggggtagcccgcggaaacgcggggtaattccgtatacgctcaggatccgagtggggatgctgaggaaagggtcttcggactcgccggtggaggaggctgcgaccgattagctggttggtggggtaacggcctaccaaggcgatgatcggtagctggtctgagaggatgatcagccacacggggactgagacacggccccgactcctacgggaggcagcagcaaggaattttccgcaatgggcgaaagcctgacggagcaacgccgcgtgcgggatgacgcttttcggagtgtaaaccgctgttcgtggggacgaagcactgacggtacccacggaggaaggcccggctaactacgtgccagc

SEQ ID NO: 2735 - DNA, 490 bp, Unknown
  Ascusbbf_980139, encodes 16S rRNA
agagtttgatcatggctcaggacgaacgctggcggcgtgcttaatacatgcaagtcgaacggagatattccgccgatggagatttcggtcgaagtcatggagtatcttagtggcgaacgggtgagtaacgcgtgaacagcctgactcaaagagggggataacaacgggaaactgttgctaataccgcataagaccacagtgtcgcatggcacaggggtcaaagatttatcgctttgagaggggttcgcgtcccattaggtagttggaggggtaacggcccaccaagccgacgatgggtagccgagctgggaggctgatcggccacactggaactgagacacggtccagactcctacgggaggcagcagtagggaatattgggcaatgggcgcaagcctgacccagcaacgccgcgtgagggaagaaggttttcggattgtaaacctctgtcctatgtgacgaaggaagtgacggtagcataggaggaagc

SEQ ID NO: 2736 - DNA, 490 bp, Unknown
  Ascusbbf_1717350, encodes 16S rRNA
agagtttgatcctggctcaggatgaacgctggcggcgtgcctaacacatgcaagtcgaacgaagcacttctcccgttgaagcagaatagcttgctaggaagtggaaacatttgaagtgacttagtggcggacgggtgagtaacgcgtgggtaacctgccctgtactgggggacaacagttggaaacggctgctaataccgcataagcgcacgatgtcgcatggcattgtgtgaaaaactccggtggtacaggatggacccgcgtctgattagctagttggtggggtaacggcctaccaaggcgacgatcagtagccggcctgagagggtgaacggccacattgggactgagacacggcccagactcctacgggaggcagcagtggggaatattgcacaatgggcgcaagcctgatgcagcgacgccgcgtgagtgatgaagtatttcggtatgtaaagctctatcagcagggaagaaaatgacggtacct

SEQ ID NO: 2737 - DNA, 490 bp, Unknown
  Ascusbbf_152575, encodes 16S rRNA
agagtttgatcctggctcaggatgaacgctagctacaggcttaacacatgcaagtcgaggggcagcatggtattagcttgctaataccgatggcgaccggcggatgggtgcgtaacgcgtatccaacctgcctgtgtcccgggcatagcccgtggaaacgcggattaactcccgatggtgcagacgtgccgcatggcgtgtctgccaaatgcgaaggacacagatggggatgcgtaccattaggtagtcggcggggtaacggcccaccgagccatcgatggttaggggttctgagaggaaggtcccccacactggtactgagacacggaccagactcctacgggaggcagcagtgaggaatattggtcaatggccgagaggctgaaccagccaagtagcgtgcaggatgacggccctacgggttgtaaactgcttttatgcggggataaagattcgcacgtgtgcgaagttgcaggtaccgcatgaataa

SEQ ID NO: 2738 - DNA, 490 bp, Unknown
  Ascusbbf_139966, encodes 16S rRNA
agagtttgatcatggctcaggatgaacgctggcggcgtgcctaacacatgcaagtcgaacggagatttttcaccaaaacggaagttagcttgctaaccgaagttttaccgagagatcttagtggcggacgggtgagtaacgcgtgaggaacctgcctttcagagggggataacgtcttgaaaaggacgctaataccgcataacatatctttgcggcatcacagagatatcaaaggagcaatccgctgaaagatggcctcgcgtccgattagccagttggcggggtaacggcccaccaaagcgacgatcggtagccggactgagaggttgaacggccacattgggactgagacacggcccagactcctacgggaggcagcagtggggaatattgcacaatgggcgaaagcctgatgcagcaacgccgcgtgagggaagaaggttttcggattgtaaacctctgtcccctgtgacgaagacagtgacggtag

SEQ ID NO: 2739 - DNA, 490 bp, Unknown
  Ascusbbf_87107, encodes 16S rRNA
agagtttgatcatggctcaggatgaacgctggcggcgtgcctaatacatgcaagtcgagcgagacggagaagatgaagcttcggtagattcctctcccgaaagcggcggacgggtgagtaacgcgtaggcaacctgccccttgcacagggatagccattggaaacgatgattaatacctgataacgcgcatatgatgcatatcacatgtgccaaagattcatcggcaagggatgggcctgcgtctgattagctggttggtgaggtaacggcccaccaaggcgacgatcagtagccgacctgagagggtgatcggccacattggaactgagacacggtccaaactcctacgggaggcagcagtagggaattttgcacaatgggcgcaagcctgatgcagcaacgccgcgtgaaggatgaaggccttcgggttgtaaacttctgttcttagggaagaagaaagtgacggtacctaaggagcaagccccggct

SEQ ID NO: 2740 - DNA, 490 bp, Unknown
  Ascusbbf_192477, encodes 16S rRNA
agagtttgatcatggctcaggatgaacgctggcggcgtgcttaacacatgcaagtcgaacggagtattcctccctggaaccgatgtagcttgctacggaagttccttttggaatacttagtggcggacgggtgagtaacgcgtgagtaacctgcccttcagtggggaataacatcgagaaatcggtgctaataccgcataacgtcagaggaccgcatgatcttctgaccaaaggatttattcgctgaaggatggactcgcgtccgattagctagttggtgaggtaacggcccaccaaggcgacgatcggtagccgaactgagaggttgatcggccacattgggactgagacacggcccagactcctacgggaggcagcagtggggaatattgggcaatgggcgaaagcctgacccagcaacgccgcgtgaaggatgaaggtcttcggattgtaaacttctttgatcagggacgaaattttgacggtacct

SEQ ID NO: 2741 - DNA, 490 bp, Unknown
  Ascusbbf_1541142, encodes 16S rRNA
agagtttgatcctggctcaggatgaacgctggcggcatgcctaagacatgcaagtcgtacgaggtggcccattgaaaaatgcgtgcttgcacaaatttggatttggattttccacctagtggcgcaagggtgagtaacacgtaggttatctgccttcgagactgggataacaattggaaacgattgctaataccggatgatatatagttggatacgtccttctatattaaaaggagcctttaaagcttcacttgaagatgagcctgcggcgtattagctagttggtgaggtaatggctcaccaaggcaacgatgcgtagccgaactgagaggttgatcggccacattgggactgagacacggcccaaactcctacgggagacagcagttaggaatattcgtcaatgggggcaaccctgaacgagcaatgccgcgtgagtgatgacggtcctttggattgtaaaactctgttgtttggaaagaacgaccta

SEQ ID NO: 2742 - DNA, 490 bp, Unknown
  Ascusbbf_1872059, encodes 16S rRNA
agagtttgatcatggctcaggacgaacgctggcggcgtgcctaatacatgcaagtcgagcggaccgaacgagagcttgctcttgtttggtcagcggcggacgggtgagtaacacgtgggcaacctgcccgcaagaccgggataactccgggaaaccggagctaataccggataacaccaaagaccgcatggtctttggttgaaaggcggcttcggctgtcacttgcggatgggcccgcggcgcattagctagttggtggggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggccttcgggtcgtaaagctctgttgtgagggacgaaggagcgccgtttgaataaggcggcgcggtgacggtac

SEQ ID NO: 2743 - DNA, 490 bp, Unknown
  Ascusbbf_1535443, encodes 16S rRNA
agagtttgatcatggctcaggatgaacgctggcggcgtgcttcacacatgcaagtcgaacggaaaggcatcttcgggtgtactcgagtggcgaacgggtgagtaacacgtgagtaatctgcctttagctttgggataagcctcggaaacggggtctaatactggatatgacttgctcctgcatgggggtgggtggaaagtttttcggctagagatgggctcgcggtctatcagcttgttggtggggtaatggctcaccaaggctttgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgcgagtgacggtacctgcagaagaagcgccggctaactacgtgccagcag

SEQ ID NO: 2744 - DNA, 490 bp, Unknown
  Ascusbbf_371679, encodes 16S rRNA
agagtttgatcctggctcaggatcaacgctggcggcgtgcctaatgcatgcaagtcgaacggggtcatcttcggatggcttacgtggcggacgggtgaggaacacgtgggtaacctgcccagtggtgggggctagccttcggaaacggagggtaattccgcataaggtctttggtcgagtgggatcgaagacgaaagccgcaaggcgccgctggaggggcccgcgtccgattagctagatggtggggtaacggctcaccatggcgatgatcggtagctggtttgagaggatgatcagccacacggggactgagacacggccccgactcctacgggaggcagcagcaaggaattttccgcaatgggcgaaagcctgacggagcaacgccgcgtgcgggatgacgcttttcggagtgtaaaccgctgttcgtggggacgaagcactgacggtacccacggaggaaggcccggctaactacgtgccagcagcc

SEQ ID NO: 2745 - DNA, 490 bp, Unknown
  Ascusbbf_1592556, encodes 16S rRNA
agagtttgatcctggctcaggatgaatgctggcggcgtgcctaatacatgcaagtcgagcggtaacagggggtctcaccgtttccttgacactcctggcctttgagcaggaggttgaattcgagggaacagtgagaccctgctgacgagcggcggacggctgagtaacgcgtgggaacggaccccaaactgagggataactagtcgaaagattagctaataccgcatgtgatcttcggattaaaggatttatccggtttgggactggcctgcgtacgattagatagttggtagggtaatggcctatcaagtcgacgatcgttagatggtttgagaagatgatcatccagactgggactgagacacggcccagactcctacgggaggcagcagtagggaatctttcacaatgggcgaaagcctgatggagcaacgccgcgtgcaggatgacggccttcgggttgtaaactgcttttataagcgagaaatat

SEQ ID NO: 2746 - DNA, 490 bp, Unknown
  Ascusbbf_14971, encodes 16S rRNA
agagtttgatcatggctcaggacgaacgctggcggcgtgcctaacacatgcaagtcgaacgaagcttgatgaatgaattcttcggaatgatttctgatatgacttagtggcggacgggtgagtaacgcgtgagcaacctgcctttcagagggggatagcgtttggaaacgaacgataataccgcataacatcattttactgcatggtagaatgatcaaaggagtaatccgctgaaagatgggctcgcgtctgattagatagttggtggggtaacggcccaccaagtcgacgatcagtagccggactgagaggttgaacggccacattgggactgagacacggcccagactcctacgggaggcagcagtggggaatattgcacaatgggggaaaccctgatgcagcaacgccgcgtgagggaagacggttttcggattgtaaacctttgtctttggtgaagaagaagtgacggtagccaaggaggaagcca

SEQ ID NO: 2747 - DNA, 490 bp, Unknown
  Ascusbbf_282027, encodes 16S rRNA
agagtttgatcctggctcaggatgaacgctggcggcatgcctaagacatgcaagtcgaacgaagtggcccaacaaagactgcgtacttgtacaaggttggcgatggatttccacttagtggcagacgggtgagtaacacgtaagtaatctaccctcgagtttggaataatgtctggaaacggacactaataccggataattcatatttagataactagatatgctaaaaggagcgtttgcttcgcttgaggatgagcttgcggcgtattaactagttggtgaggtaatggctcaccaaggtgacgatgcgtagccgaactgagaggttgatcggccacattgggactgagacacggcccaaactcctacgggaggcagcagttaggaatattcgtcaatgggggaaaccctgaacgagcaatgccgcgtgagtgatgacggtctttatgattgtaaaactctgttgtaaggaacgaacccttaggatagg

SEQ ID NO: 2748 - DNA, 490 bp, Unknown
  Ascusbbf_1570261, encodes 16S rRNA
agagtttgatcatggctcaggatgaacgctagcggcaggcctaatacatgcaagtcggacgggatccatcggcgggcttgcccaatgatggtgagagtggcgcacgggtgcgtaacgcgtgagcaacctgcccctgtcaggggtatagcctctcgaaagagagattaagaccgcatatgataccgttccggcatcggatcgatatgaaatattcataggacagggatgggctcgcgtgacattagctggttggtggggtaacggcccaccaaggcgacgatgtctaggggctctgagaggggaatcccccacactggtactgagacacggaccagactcctacgggaggcagcagtaaggaatattggtcaatgggcggaagcctgaaccagccatgccgcgtgcgggacgaaggccctacgggtcgtaaactgcttttgtacgggaacaaccgcagttacgcgtaactgtctgagtgtaccgtaagaat

SEQ ID NO: 2749 - DNA, 490 bp, Unknown
  Ascusbbf_1794449, encodes 16S rRNA
agagtttgatcatggctcaggacgaacgctggcggcgtgcctaatacatgcaagtcgaggggcagcgggttgtagcaatacaatgccgacgaccggcgaaagggtgagtaacgcgtgagcaacatgcccgatactggaggatagtcgatggaaacgtcgcgtaatactccgtaacaacagagatcgcatggtctttgtttaatagatttatcggtatcggattggctcgcgtaccattagctagttggcggggtaacggcccaccaaggcgacgatggttaggggttctgagaggaaggtcccccacattggaactgagacacggtccagactcctacgggaggcagcagtgaggaatattggtcaatggccgagaggctgaaccagccatgccgcgtgcgggaggacggccctatgggttgtaaaccgcttttgttggggagcaataaggagcacgagtgcttcgatgagagtacccagcgaataagca

SEQ ID NO: 2750 - DNA, 490 bp, Unknown
  Ascusbbf_1702796, encodes 16S rRNA
agagtttgatcatggctcaggatgaacgctggcggcgtgcttaacacatgcaagtcgaacgaagctctttgaacggaggattcgtctgaagtgatgagatgacttagtggcggacgggtgagtaacgcgtgggtaacctgccgtatgcagggggacaacagttggaaacgactgctaataccgcataagcgcacgtgaccgcatggtcgagtgtgaaaagatttatcggcatacgatggacccgcgtctgagtagatagttggtgaggtaacggctcaccaagtcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtaccagactaagaagccccggc

SEQ ID NO: 2751 - DNA, 490 bp, Unknown
  Ascusbbf_1176295, encodes 16S rRNA
agagtttgatcctggctcaggatgaacgccggcggtgtgcctaatacatgcaagtcgagcgcactggcccaacagaaatgacgtgcttgcactgatttgacgttggattcccagtgagcggcggacgggtgagtaacacgtgggcaacctgccccaaagcgggggataacatttggaaacaggtgctaataccgcataacttggaaaaccacatggttttccaataaaagatggtttcggctatcactttgggatgggcccgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaaactctgttgttggagaagaacgtgcgtaagag

SEQ ID NO: 2752 - DNA, 490 bp, Unknown
  Ascusbbf_631299, encodes 16S rRNA
agagtttgatcatggctcaggatgaacgctagcgggaggcctaacacatgcaagccgagcggtagagtctcttcggagacttgagagcggcgcacgggtgcggaacacgtgtgcaacctgcctttatctgggggatagcctttcgaaaggaagattaataccccataatatactggatggcatcatctggtattgaaaactccggtggatagagatgggcacgcgcaagattagatagttggtgaggtaacggctcaccaagtcagcgatctttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtatagggataaacctagatacgtgtatctagctgaaggtactatacgaataagcaccggct

SEQ ID NO: 2753 - DNA, 490 bp, Unknown
  Ascusbbf_281462, encodes 16S rRNA
agagtttgatcatggctcaggacgaacgctggcggcgtgcttaacacatgcaagtcgaacgagaatttggcggactgaacttacgggagagggaagccgaagggaagtggcgaacgggtgagtaacacgtgagcaacctgccttacacaaagggatagccactggaaacggtgattaataccatatgagaccacaaactcgcatgagaaaggggttaaagaaattcggtgtaagatgggctcgcgtctgattagctagttggaagggtaaaggcctaccaaggcgacgatcagtagccggtctgagaggatgaacggccacactggaactgagacacggtccagactcctacgggaggcagcagtggggaatattgcacaatgggggaaaccctgatgcagcgacgccgcgtgagcgaagaaggttttcgaatcgtaaagctctgtcctatgagaagataatgacggtatcataggaggaagccccggct

SEQ ID NO: 2754 - DNA, 490 bp, Unknown
  Ascusbbf_1577816, encodes 16S rRNA
agagtttgatcatggctcaggatgaacgctggcggcgtgcctaatacatgcaagtcgaacggagtcggtttggaaagtccttcgggactggaattatcgacttagtggcggacgggtgagtaacgcgtgagcaatctgcctttgagagggggataacagccggaaacggctgctaataccgcatgaagcatttggaccgcatgatctggatgccaaagattttatcgctcaaagatgagctcgcgtcccattagctggttggcggggtaacggcccaccaaggcgacgatgggtagccggactgagaggttgaacggccacattgggactgagacacggcccagactcctacgggaggcagcagtagggaatattgcgcaatgggggcaaccctgacgcagcaacgccgcgtgattgatgaaggtcttcggattgtaaaaatctttaatcagggacgaaaaacgacggtacctgaagaataagctccggc

SEQ ID NO: 2755 - DNA, 490 bp, Unknown
  Ascusbbf_1884640, encodes 16S rRNA
agagtttgatcatggctcaggatgaacgctggcggcgtgcttaacacatgcaagtcgaacgaggaataggatgaagttttcggatggattcttattccgagtggcggacgggtgagtaacgcgtgggtaacctgccctgtacagggggataacagttggaaacgactgttaataccgcataagaccacagtgccgcatggcacaagggtaaaaactccggtggtacaggatggacccgcgtccaattagatagttggtgaggtaacggcccaccaagtcgacgattggtagccgatctgagaggacgaacggccacattgggactgagacacggcccagactcctacgggaggcagcagtggggaatattgggcaatgggcgcaagcctgacccagcaacgccgcgtgaaggatgaaggttttcggattgtaaacttcttttaagtgggacgatgatgacggtaccacttgaataagccccggctaacta

SEQ ID NO: 2756 - DNA, 490 bp, Unknown
  Ascusbbf_529778, encodes 16S rRNA
agagtttgatcatggctcaggatgaacactggcggcgtgcctaacacatgcaagtcgaacgaagccctttgagtggggatttcggttgaagcgaggaggtgactgagtggcggacgggtgagtaacgcgtggagaacctggcccatacagggggatagcggctggaaacggccggtaaaaccgcataagcgcacaagcagggcatcctgtggtgtgaaaatctattgaggtatgggatggatccgcgtccgattagccagtaggcggggtaacggcccacctaagcaacgatcggtagccggcctgagagggcggacggccacattgggactgagacacggcccagactcctacgggaggcagcagtgggggatattgcacaatgggggaaaccctgatgcagcgacgccgcgtgggtgaagaagtatttcggtacgtaaagccctatcgacagggaagaaagaagacggtacctgagtaagaagccccg

SEQ ID NO: 2757 - DNA, 490 bp, Unknown
  Ascusbbf_1423769, encodes 16S rRNA
agagtttgatcctggctcaggacgaacgctggcggcgtgcctaacacatgcaagtcgaacggggctataccgaatgaagtcttcggatggaataagtatagcttagtggcggacgggtgagtaacgcgtgagcaacctgccttcaggagggggacaacagctggaaacggctgctaataccgcatgacatatatttgcggcatcgcagatatatcaaagatttatcgcctgaagatgggctcgcgtctgattagatagttggtgaggtaacggctcaccaagtcgacgatcagtagccggactgagtggttgaacggccacattgggactgagatacggcccagactcctacgggaggcagcagtgaggagtattgcgcaatgggggcaaccctgacgcagcaacgccgcgtgaaggaagacggttttcggattgtaaacttcttttgtcaaggacgataatgacggtacttgacgaataagccacggct

SEQ ID NO: 2758 - DNA, 490 bp, Unknown
  Ascusbbf_1537382, encodes 16S rRNA
agagtttgatcatggctcagaatgaacgctggcggcatggattaggcatgcaagtcgaacgagctcccttcggggagaaagtggcgaaagggtgagtaacacgtgagcaacctgcctccggatccggaataatccagggaaacttggtctaaaaccggatgaagaccacagaccgcatggtttatggttaaaatatttatagtccggagaggggctcgcggcccattagcttgttggcggggtaatggcccaccaaggctatgacgggtaggtggtctgagaggatggtcacccacactgggactgagacactgcccagactcctacgggaggctgcagtcgagaatcttccgcaatgggcgcaagcctgacggagcgatgccgcgtgagggatgacggccttcgggttgtaaacctctgtcatccgggacgaaaacaatgacggtaccggaaaaggaagccacggctaaccacgtgccagcagccgcgg

SEQ ID NO: 2759 - DNA, 490 bp, Unknown
  Ascusbbf_1746, encodes 16S rRNA
agagtttgatcatggctcagaacgaacgctggcggcgcgttttaagcatgcaagtcgagcggtaagccggagcaatccggcctagagcggcggacgggtgagtaacacgtggataatctggcctacagttcgggatagcctggtgaaagccaggataataccggatacgacggttgagtcaaaagagacagccgggaaaggagctaaggcttcgctgaaggatgagtccgcgtcccattagcttgatggtgaggtaaaggcccaccatggcgatgatgggtagccggcctaagagggtgaacggccacattgggactgagatacggcccagactcctacgggaggcagcagctaagaatcttccgcaatggtcgaaagactgacggagcgacgccgcgtgaatgatgaaggccgtgaggttgtaaagttcttttctggagggagaataaggcatgtagggaatgacatgccgatgacgtgaatccaggaa

SEQ ID NO: 2760 - DNA, 490 bp, Unknown
  Ascusbbf_8837, encodes 16S rRNA
agagtttgatcatggctcaggatgaacgctggcggcgtgcctaacacattcaagtcgaacgagccgtagcaatacggcgagtggcggacgggtgagtaacgcgtaagcaatctgcctttgtgtgcggaataacaaccggaaacagttgctaataccgcatgacgcagcgagaccgcatgatcttgctgccaaagatttatcgcacgaagatgagcttgcgtccgattagatagttggcggggcaacggcccaccaagtcgacgatcggtagccggactgagaggttgaacggccacattggaactgagatacggtccagactcctacgggaggcagcagtggggaatattgggcaatggacgaaagtctgacccagcgacgccgcgtgagggaagaaggtcttcggattgtaaaccttagtcaacagggacgaagcaagtgacggtacctgtggaggaagccacggctaactacgtgccagcagccgcgg

SEQ ID NO: 2761 - DNA, 490 bp, Unknown
  Ascusbbf_23650, encodes 16S rRNA
agagtttgatcctggctcagagtgaacgctggcggcgtggctaagacatgcaagttgagcgagaatatgcctttgggcatagggaagcggcaaacgggtgagtaacacgtaagtaacctacccttaagactgggatagccctgtgaaagtgggggtaataccggatggagactataactgcatggttatagatcgaaaggtttgtaaaggcgcttaaggaggggcttgcggcctatcagctagttggaggtgtaaaggacccccaaggcgaagacgggtagccggtctgagaggacggacggccacattggaactgagacacggtccaaacatctacggatggcagcagtttcgaattattcacaatgggcgaaagcctgatggtgcgacgtcgcgtggaggaagaaggtcttcggattgtaaactcctgtcattagggagcaaaggctagtggagagctagagttgagttaacctaaagaggaagcagt

SEQ ID NO: 2762 - DNA, 490 bp, Unknown
  Ascusbbf_19488, encodes 16S rRNA
agagtttgatcatggctcagaataaacgctggcggcgtgtcttaagcatgcaagtcgaacggcaaggtaccttcgggtaccctagagtggcggactggtgagtaacacgtaggtgacgtaccttttggacggggatagcccgtagaaatacgggataataccggataaggttgcacgggttggagccgtgcaaggaaaggcgctacggcgtcgccgaaagaacggcctgcgacctatcagcttgttggtgaggtaaaggcccaccaaggcaatgacaggtatccggcctgagagggtgatcggacacattgggactgagatacggcccagactcctacgggaggcagcagctaagaatattccgcaatggacgaaagtctgacggagcaacgccgcgtggatgatgaaggccggaaggttgtaaaatccttttataattgaggaataagccgggtagggaatgacctggtggtgactgtagattatgaat

SEQ ID NO: 2763 - DNA, 490 bp, Unknown
  Ascusbbf_249242, encodes 16S rRNA
agagtttgatcatggctcaggatgaacgctggcggcgtgcctaacacatgcaagtcgaacggagcatagacgctgtgagaagaatcagcttgctgaggaagcgaacttgtttatgcttagtggcggacgggtgagtaacgcgtggataacctggctcacacagggggatagcagttggaaacgactgataataccgcataagcgcacggcatcgcatgatgcagtgtgaaaagatttatcggtgtgagatggatccgcgtctgattagccagttggcggggtaacggcccaccaaagcgacgatcagtagccggcctgagagggcggacggccacattgggactgagacacggcccagactcctacgggaggcagcagtgggggatattgcacaatggagggaactctgatgcagcgacgccgcgtgggtgaagaagtatttcggtatgtaaagccctatcagcagggaagataatgacggtacctgact

SEQ ID NO: 2764 - DNA, 490 bp, Unknown
  Ascusbbf_721803, encodes 16S rRNA
agagtttgatcctggctcaggatgaacgctggcggcgtgcctaacacatgcaagtcgaacggagcatagacgctgacgagagaagtagcttgctatagatcaaatcttgtttatgcttagtggcggacgggtgagtaacgtgtggataacctggtccatccagggggatagcagctggaaacggctgataataccgcataagcgcacattaccgcatggtagagtgtgaaaagaattatcgggatggaatggatccgcatctgattagccagttggcggggtagaagcccaccaaagcgacgatcagtagccggcctgagagggcggacggccacattgggactgagacacggcccagactcctacgggaggcagcagtgggggatattgcacaatggggggaaccctgatgcagcgacgccgcgtgggtgaagaagtatttcggtatgtaaagccctatcagcagggaagataatgacggtacctgagt

SEQ ID NO: 2765 - DNA, 490 bp, Unknown
  Ascusbbf_242631, encodes 16S rRNA
agagtttgatcatggctcaggatgaacgctagcggcaggcctaacacatgcaagtcgaggggtagaaatagcttgctattttgagaccggcgcacgggtgcgtaacgcgtatggaatctaccttttactaagggatagcccgaagaaattcggattaataccttatggttttatagattggcatcaatttataaataaagatttatcggtaagagatgatcatgcgtcccattagctagttggtatggtaacggcataccaaggcaatgatgggtaggggtcctgagagggagatcccccacactggtactgagacacggaccagactcctacgggaggcagcagtgaggaatattggtcaatggacggaagtctgaaccagccatgccgcgtgcaggaagaatgtcctatggattgtaaactgcttttatacgggaagaaacgcttatttgcgaataggtttgacggtaccgtaagaataaggatcggc

SEQ ID NO: 2766 - DNA, 490 bp, Unknown
  Ascusbbf_407247, encodes 16S rRNA
agagtttgatcatggctcaggatgaacgctagcggcaggcttaacacatgcaagtcgaggggcagcgggtctagcaatagatgccggcgaccggcgaaagggtgagtaacgcgtgagcaacgtgcccgtatgtgggggatagtcgatggaaacgtcgcgtaataccccgtaacacacggaaccgcatggttccatgttgaaagatttgattgcatacggatcggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggaagaatgccctatgggttgtaaaccgcttttgcgggggagcaataagggtcacgtgtggcccgatgagagtaccctgcgaataagcat

SEQ ID NO: 2767 - DNA, 490 bp, Unknown
  Ascusbbf_1412488, encodes 16S rRNA
agagtttgatcatggctcaggatgaacgctggcggcgtgcttaacacatgcaagtcgaacggagtttaagaaggaagcttgctttcattttaaacttagtggcggacgggtgagtaacgcgtgaggaacctgcccttgagtggggaacaacaactggaaacggttgctaataccgcataatgtcggagtaccgcatgatattccgaccaaaggatttattcgcttaaggatggcctcgcgtccgattaggcagttggtgaggtaacggcccaccaaacctacgatcggtagccgaactgagaggttgatcggccacattgggactgagacacggcccagactcctacgggaggcagcagtggggaatattgggcaatgggcgaaagcctgacccagcaacgccgcgtgaaggatgacggtcttcggattgtaaacttctttaattggggaagaacaaaatgacctacccaaataataagtcacggctaac

SEQ ID NO: 2768 - DNA, 490 bp, Unknown
  Ascusbbf_100105, encodes 16S rRNA
agagtttgatcatggctcaggatgaacgctggcggcgtgcttaatacatgcaagtcgaacggagatgtccacctgatgaagcagagtgcttgcacaaagcagattctaccggatatcttagtggcggacgggtgagtaacgcgtgggtaacctgcctcatactggggaataacagccagaaatggctgctaataccgcataagcgcacagtaccgcatggtacagtgtgaaaagattttatcggtatgagatggacccgcgtctgattagctagttggcggggtaacggcccaccaaggctgcgatcagtagccgacttgagagagtgatcggccacattgggactgagacacggcccagactcctacgggaggcagcagtagggaatattgcacaatgggggaaaccctgatgcagcgacgccgcgtgagtgatgaagtatttcggtatgtaaagctctatcagcagggaagataatgacggtacctga

SEQ ID NO: 2769 - DNA, 490 bp, Unknown
  Ascusbbf_185315, encodes 16S rRNA
agagtttgatcatggctcaggattaacgctggcggcatgcctaatacatgcaagtcgaacgagcagcgatgctagtggcgaacgggtgagtaacacgtagggaacctaccctttagacgaggataactactggaaacggtagctaaaactggatagtatattagaaggcatcttcggatatttaaaggtcctgtaagggaacactaaaggatggccctgcggaacattagctagttggcggggtaacggcccaccaaggcgacgatgtttagctgtgctgagaggcaaaacagccacactgggactgagacacggcccagactcctacgggaggcagcagtagggaattttcggcaatgggggaaaccctgaccgagcaatgccgcgtgaatgaagaaattcttcggaatgtaaaattctgttattagggacgaaaggtatataaaggaaatggtatataattgacggtacctaattagaaagccccggc

SEQ ID NO: 2770 - DNA, 490 bp, Unknown
  Ascusbbf_117566, encodes 16S rRNA
agagtttgatcatggctcaggatgaacgctggcggcgtgcttaacacatgcaagtcgaacggagagcttttgacagaggattcgtccaatggataaagtttcttagtggcggacgggtgagtaacgcgtgaggaacctgccttggagtggggaataacacagagaaatttgtgctaataccgcataatgcattttagctgcatggctgagatgccaaagatttattgctctgagatggcctcgcgtctgattagatagttggcggggtaacggcccaccaagtcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttatcagggacgataatgacggtacctgatgaataagccacggct

SEQ ID NO: 2771 - DNA, 490 bp, Unknown
  Ascusbbf_1739128, encodes 16S rRNA
agagtttgatcatggctcaggacgaacgctggcggcatgcctaatacatgcaagtcgagcgaatgacgaagaagcttgcttcttctgatttagcggcggacgggtgagtaacacgtgggcaacctgccctgtagattgggataactccgggaaaccggggctaataccgaataatccatttcctcacatggggagatgttaaaagacggtttcggctgtcactacaggatgggcccgcggcgcattagctaattggtgaggtaacggctcaccaaggcgacgatgcgtagccgacctgagagggtgatcggccacactgggacttagacacggcccagactcctacgggaggcagcagtagggaatcttccacaatggacgaaagtctgatggagcaatgccgcgtgagtgaagaaggttttcggatcgtaaaactctgttgtgagggaagaacaagtatgagagtaactgctcgtaccttgacggtacc

SEQ ID NO: 2772 - DNA, 490 bp, Unknown
  Ascusbbf_280121, encodes 16S rRNA
agagtttgatcatggctcaggatgaacgctggcggcgtgcttaacacatgcaagtcgaacggagataagcgctgatgaagcttcggcagaatcttgcttatcttagtggcggacgggtgagtaacgcgtgggtaacctacctgcaacagggggataacgattggaaacgatcgctaataccgcataacccgctagagtcgcatgactcagacggaaaagatttatcggttgcagatggacccgcgtctgattagctagttggtggggtaacggcctaccaaggcgacgatcagtagccgaactgagaggttgaccggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagaaaatgacggtacctgactaagaagccccggct

SEQ ID NO: 2773 - DNA, 490 bp, Unknown
  Ascusbbf_128904, encodes 16S rRNA
agagtttgatcctggctcaggacgaacgctggcggcatgcctaacacatgcaagtcgaacggagatattgagagcttgcttttgatatcttagtggcggacgggtgagtaacgcgtgagcaacctgcctttcagtggggaataatacttcgaaagaggtactaataccgcataacgtattgagatcgcatggttttgataccaaagatttatcgctgagagatgggctcgcgtccgattagctggttggtggggtaacggctcaccaaggcgacgatcggtagccggactgagaggttgaacggccacattgggactgagacacggcccagactcctacgggaggcagcagtgggggatattgcgcaatgggggaaaccctgacgcagcaatgccgcgtgaaggacgaaggtcttcggattgtaaacttcttttgtcagggacgataatgacggtacctgacgaataagctccggctaactacgtgccag

SEQ ID NO: 2774 - DNA, 490 bp, Unknown
  Ascusbbf_19768, encodes 16S rRNA
agagtttgatcatggctcaggatgaacgctggcggcgtgcttaacacatgcaagtcgaacggagatatcggcttcggctgatatctcagtggcggacgggtgagtaacgcgtgggtaacctgccttacaccgggggacaacagttggaaacgactgctaataccgcataagaccacggagccgcatggccctggggtaaaagatttatcgatgtaagatggacccgcgtctgattagccagttggcggggtaacggcccaccaaagctacgatcagtagccgacctgagagggtgatcggccacattgggactgagacacggcccaaactcctacgggaggcagcagtggggaatattgggcaatgggcgcaagcctgacccagcgacgccgcgtgagtgaagaagtatttcggtatgtaaagctctatcagcagggaagacaatgacggtacctgactaagaagcaccggctaaatacgtgccagcagc

SEQ ID NO: 2775 - DNA, 490 bp, Unknown
  Ascusbbf_43667, encodes 16S rRNA
agagtttgatcctggctcaggatgaacgctggcggcgcgcctaacacatgcaagtcgaacggcgaagtcccttcggggacggaacagtggcggacgggtgagtaacgcgtgagtaacctgcccttacgagcggaatagcgtcgggaaactgacggtaataccgcatgaagcttgaccccggcatcggggagaagccaaagatttatcgcgtaaggatggactcgcgtcccattagatagttggcggggcaacggcccaccaagtcagcgatgggtagccggactgagaggttgaacggccacattggaactgagagacggtccagactcctacgggaggcagcagtggggaatattgggcaatgggcgaaagcctgacccagcgacgccgcgtgagcgaagaaggtcttcggattgtaaagctctgtgtacagggacgaagaatgacggtacctgtatagaaagccacggctaactacgtgccagcagcc

SEQ ID NO: 2776 - DNA, 490 bp, Unknown
  Ascusbbf_197879, encodes 16S rRNA
agagtttgatcatggctcagaacgaacgctggcggcgcgtcttaagcatgcaagtcgagcgggattgtccagcttgctggacatgagagcggcggactggcgaggagcgcgtgggcgacgcgccccccggaccggaacagcccgtggaaacacggggtaatgccggatggcatgcctctcttggaggggaggcatcaaaggggcttcggccccgccgggggagcggcccgcgtcccatcagctagttggcggggaaaaggcccaccaaggctacgacgggtgtccggcctgagagggcgatcggacgcattgggactgagatacggcccagactcctacgggaggcagcagctaagaatattccgcaatgggcgaaagcctgacggagcgacgccgcgtggacgatggaggccggaaggttgtaaagtccttttgggagggaagaagaagccggggaggaaacgccccggcggcgacggtacctcgcgaa

SEQ ID NO: 2777 - DNA, 490 bp, Unknown
  Ascusbbf_96316, encodes 16S rRNA
agagtttgatcatggctcaggacgaacgctggcggcgtgcttaacacatgcaagtcgagcggagacatgcgaacggaaggcttcggccggaaggttgcatgttttagcggcggacgggtgagtaacgcgtgaacaatctgtccttcacagggggataagacagcgaaagttgttctaataccgcatgggaccacgacagggcatcctgaaggggtgaaaggagcaatccggtgaagggtgagttcgcgtccgattagatagttggtgaggtaacggcccaccaagtcaacgatcggtagccgacctgagagggtgatcggccacattgggactgagacacggcccagactcctacgggaggcagcagtgggaatattgggcaatgggggaaaccctgacccagcaacgccgcgtggaggaagaaggttttcggattgtaaactcctgtcctcatcgaagaggaagagacggtaggtgaggaggaagcccc

SEQ ID NO: 2778 - DNA, 490 bp, Unknown
  Ascusbbf_166334, encodes 16S rRNA
agagtttgatcatggctcaggatgaacgctagcggcaggcttaacacatgcaagtcgaggggcagcgcggaggtagcaatacttctggcggcgaccggcgcaagggtgcgtaacgcgtgagcaacatacccgtatcagggggataagcgatggaaacgtcgtctaataccgcataacaacgagagggacatccctcatgtttgaaagatacgtcggatacggattggctcgcgagacattagctagtcggcggggtaacggcccaccgaggcaacgatgtctaggggttctgagaggaaggtcccccacattggaactgagacacggtccaaactcctacgggaggcagcagtgaggaatattggacaatggccgaaaggctgatccagccatgccgcgtgaaggcagacggtcctatggattgtaaacttcttttgtacgggagcaataagggcgtcgtgacgtccgatgagagtaccgtacgaataag

SEQ ID NO: 2779 - DNA, 490 bp, Unknown
  Ascusbbf_599048, encodes 16S rRNA
agagtttgatcatggctcaggatgaacgctggcggcgtgcctaatacatgcaagtcgaacggagtatcttcggatacttagtggcgaacgggtgagtaatacttgaacaacctgcccctttgactgggataaccgtctgaaaagacagctaataccggataggtaatattgaggcatctcgatattattaaagatgggttacatcacattgggatgggttcaagtcgcattagctagttggtgaggtaacggcccaccaaggccacgatgcgtagccgatctgagaggatgaacggccacattgggactgagacacggcccagactcctacgggaggcagcagtagggaattttcggcaatgggcgaaagcctgaccgagcaacgccgcgtgaacgatgaaggtctttggattgtaaagttctgttacgagggaagaacatctggtatagggaatgatatcagactgacggtacctcgccagaaagccac

SEQ ID NO: 2780 - DNA, 490 bp, Unknown
  Ascusbbf_407434, encodes 16S rRNA
agagtttgatcatggctcaggatgaacgctggcggcgtgcctaatacatgcaagtcgaacggagcacttcggtgcttagtggcgaacgggtgagtaacacataaacaatctacccttaagtctgggataacggttggaaacgaccgctaataccggataggtaaaaccgaggcatcttggatttattaaagctgggctacagcgctaaaggatgagtttatgtcgcattagctagttggcggggtaacggcccaccaaggcgatgatgcgtagccggtctgagaggatgaacggccacattgggactgagacacggcccagactcctacgggaggcagcagtagggaattttcggcaatgggcgaaagcctgaccgagcaacgccgcgtgaacgatgaaggtctttggattgtaaagttctgttacgagggaagaatggcttatatagggaatgatataagcagagacggtacctcgccagaaagccacg

SEQ ID NO: 2781 - DNA, 490 bp, Unknown
  Ascusbbf_620834, encodes 16S rRNA
agagtttgatcatggctcaggatgaacgctagcggcaggcctaacacatgcaagtcgaggggcatcgcgggtgtgagcaatcactcccggcggcgaccggcggatgggtgagtaacgcgtatccaacctgccccatgcccgggcacagcccctggaaacggggagtgactcccgatggcgcgctttggccgcatggctgttgcgctaaatttcgaggcatgggatgggggtgcgtccgattaggtagttggcggggcaacggcccaccaagcctacgatcggtaggggttctgagaggaaggtcccccacattgggactgagacacggcccaaactcctacgggaggcagcagtgaggaatattggtcaatgggcggaagcctgaaccagccaagtagcgtggaggatgacggccctacgggttgtaaactcctttagcgcggggataacacgccgcacgtgtggggcgctgcaggtaccgcgagaataa

SEQ ID NO: 2782 - DNA, 490 bp, Unknown
  Ascusbbf_44038, encodes 16S rRNA
agagtttgatcatggctcaggacgaacgctggcggcgtgcttcatacatgcaagtcgaacgataaggcgccttcgggcgtacataagtggcggacgggtgagtaaaatgtagagaatctgccctagagcgggggacaacggttggaaacgaccgctaataccccatatgagcgtagttgagatactattcttgaaaactccggtgctctgggatgagtctgcatctgattagctagttgggggtgtaatggaccaccaaggcgatgatcagtagctggtttgagaggatgatcagccacaatgggactgagacacggcccatactcctacgggaggcagcagtagggaattttgcgcaatgggggaaaccctgacgcagcaacgccgcgtgaccgatgaagcccttcggggtgtaaaggtctgtcagtggggacgaaaaatgacggtacccacagaggaagcaccggctaactccgtgccagcagccgcg

SEQ ID NO: 2783 - DNA, 490 bp, Unknown
  Ascusbbf_1891142, encodes 16S rRNA
agagtttgatcctggctcaggatgaacgctggcggcgtgcctaacacatgcaagtcgaacggagttatgagagagatttcctcggattgacatcttataacttagtggcggacgggtgagtaacgcgtggataacctgccttgcacagggggatagcagttggaaacgactgataataccgcataagaccacagtaccgcatggcacagtggtaaaagatttatcggtgcaagatggatccgcgtctgattagccagttggcggggtaacggcccaccaaagcgacgatcagtagccggcctgagagggcggacggccacattgggactgagacacggcccagactcctacgggaggcagcagtgggggatattgcacaatgggcgcaagcctgatgcagcgacgccgcgtgagtgaagaagtatttcggtatgtaaagctctatcagcagggaagaaaggcccttcggggagatgacggtacctgacta

SEQ ID NO: 2784 - DNA, 490 bp, Unknown
  Ascusbbf_57404, encodes 16S rRNA
agagtttgatcctggctcaggatgaacgctagctacaggcttaacacatgcaagtcgaggggcagcatgcggattgcttgcaatccgcgatggcgaccggcgcacgggtgagtaacgcgtatccaaccttccctacacttcggcataacccggcgaaagtcggactaattccgaatggtctcctttgacggcatcagaagcggagtaaagatttatcggtgtaggatggggatgcgtccgattagctggttggtgtggtaacggctcaccaaggctacgatcggtaggggttctgagaggaaggtcccccacactggaactgagacacggtccagactcctacgggaggcagcagtgaggaatattggtcaatgggcggaagcctgaaccagccaagtagcgtgcaggatgacggccctatgggttgtaaactgcttttatgcgggaataatgtcggacacgcgtgtctgcttgcatgtaccgcatgaat

SEQ ID NO: 2785 - DNA, 472 bp, Unknown
  Ascusbbf_1894953, encodes 16S rRNA
agagtttgatcatggctcagagcgaacgctggcggcaggcttaacacatgcaagtcgagcgggcgtagcaatacgtcagcggcagacgggtgagtaacacgtgggaacgtgccctttggttcggaacaacacagggaaacttgtgctaataccggataagcccttacggggaaagatttatcgccaaaggatcggcccgcgtctgattagcttgttggtgaggtaatggctcaccaaggctacgatcagtagctggtctgagaggatgatcagccacactgggactgaggcacggcccagactcctacgggaggcagcagtggggaatattggacaatgggcgcaagcctgatccagccatgccgcgtgagtgatgaaggccctagggttgtaaagctctttcggcggggaagataatgacggtacccgcataagaagccccggctaacttcgtgccagcagccgcggtaat

SEQ ID NO: 2786 - DNA, 490 bp, Unknown
  Ascusbbf_1341149, encodes 16S rRNA
agagtttgatcatggctcaggatgaacgctggcggcgtgcctaatacatgcaagtcgaacgagggtgcttgcaccctagtggcgaacgggtgagtaacacgtaggtaacctgcccttaagcttgggatacccagaggaaactttggctaataccggataacaacagaggaggcatctcttcagtttgaaaggccctttacggggtcacttaaggatgaacctgcggcgcattagctagttggtgagataacagcccaccaaggcgaggatgcgtagccgacctgagagggtgatcggccaaagtgcaactgagacacggtccaaactcatacgggaggcagaagtaaggagttttcggcaaggggggaaaccctgaccgagaaacgccgcgtgagtgatgacggccctatgggttgtaaagctctgttgtaagggacgaatgactaggttaggaaatgaacttagtttgacggtaccttaccagaaagca

SEQ ID NO: 2787 - DNA, 490 bp, Unknown
  Ascusbbf_2139, encodes 16S rRNA
agagtttgatcatggctcaggatgaacgctagctacaggcttaacacatgcaagtcgagcggaactgcttcggcagtttagcggcagacgggtgagtaacacgtatccaacctttcccttactcgggcatagcctctggaaacggagagtaattcccgatgtgatgtacagttcgcatgttttgcacatcaaagattcatcggtaaggggtggggatgcgttccattaggtagtaggcggggtaacggcccacctagccgatgatggataggggttctgagaggaaggtcccccacattggaactgcgacacggtccaaactcctacgggaggcagcagtgaggaatattggtcaatggacgcaagtctgaaccagccaagtagcgtgcaggatgacggccctatgggttgtaaactgcttttctgcgggaataacgttgagctcgtgagctcaagtgcatgtaccgcaggaataaggatcggctaactc

SEQ ID NO: 2788 - DNA, 490 bp, Unknown
  Ascusbbf_79774, encodes 16S rRNA
agagtttgatcctggctcaggattaacgctggcggcgtgcataacacattcaagtcgaacggacgaagcccttcggggcctagttagtggcggacgggtgagtaacgcgtgagcaacctgcccttatgtgggggataacgaccggaaacggtcgctaataccgcatgacccgatagtaccgcatggtacagtcggcaaagatttattgcataaggatgggctcgcgtctgattaggcagttggtgaggcaacggctcaccaaaccgacgatcagtagccggactgagaggttgaacggccacattggaactgagatacggtccagactcctacgggaggcagcagtggggaatattgggcaatggacgaaagtctgacccagcgacgccgcgtgagggaagaaggtcttcggattgtaaaccttaaacaacagggacgaagcagtgacggtacctgttaggaagccacggctaactacgtgccagcagcc

SEQ ID NO: 2789 - DNA, 490 bp, Unknown
  Ascusbbf_299304, encodes 16S rRNA
agagtttgatcctggctcagaatgaacgctggcggcatggattaggcatgcaagtcgaacggggcgcagcgatgcgcccagtggcgaaagggtgagtagcacgtgaagaacctgcccccggatccggaacaagcgctggaaacggcgtctgatacgggatgtggacgccccccgcatggggggcgctctaaagattcatcgtccggggagggcttcgcgtcccattagctggttggcggggtaacggcccaccaaggctgcgacgggtaggtggtctgagaggatggtcacccacactgggactgagacactgcccagactcctacgggaggctgcagtcgagaatcttccgcaatgggggcaaccctgacggagcgatgccgcgtgagggaagtaggccttcgggtcgtgaacctctgtcacccgggacgaaggaagtgacggtaccgggggaggaagccatggctaactacgtgccagcagccgcggt

SEQ ID NO: 2790 - DNA, 490 bp, Unknown
  Ascusbbf_332738, encodes 16S rRNA
agagtttgatcatggctcaggatgaacgctagcggcaggcttaacacatgcaagtcgaggggcagcgagatgtagtaatacattgtcggcgaccggcgcacgggtgcgtaacgcgtatgcaacctaccatatacaggggaataacctttcgaaagggagactaataccccatagtattacaataaggcatcttattttaattaaagatttattggtatatgatgggcatgcgtgccattagctagttggagaggtaacggctcaccaaggctacgatggctaggggttctgagaggaagatcccccacactggtactgagacacggaccagactcctacgggaggcagcagtgaggaatattggtcaatgggcggaagcctgaaccagccatgccgcgtgcaggaagacggccctacgggttgtaaactgcttttatgtgaggataaacctagatttgcgaatctagctgaaggtatcacatgaataagg

SEQ ID NO: 2791 - DNA, 490 bp, Unknown
  Ascusbbf_211819, encodes 16S rRNA
agagtttgatcctggctcaggacgaacgctggcggtatgcttaacacatgcaagtcgaacgagaagctttttaatgatccttcgggtgaactaagaagtggaaagtggcgaacgggtgagtaacgcgtgggtaacctgcctcatggaaaggaatagcctcgggaaactgggagtaaagccttatattattgagttgtcgcatggcaattcgatgaaaactccggtgccatgagatggacccgcgtcccattagctagttggtgagataacagcccaccaaggcaacgatgggtaaccggtctgagagggcgaacggtcacactggaactgagacacggtccagactcctacgggaggcagcagtggggaatattgcgcaatgggggaaaccctgacgcagcaataccgcgtgagtgaagaaggttttcggatcgtaaaactcttttattggggaagaagaagtgacggtacccaatgaagaagtcccggc

SEQ ID NO: 2792 - DNA, 490 bp, Unknown
  Ascusbbf_39039, encodes 16S rRNA
agagtttgatcatggctcagaacgaacgctggcggcgcgttttaagcatgcaagtcgagcggtaagccggagcaatccggcctagagcggcggacgggtgagtaacacgtggataatctggcctacagtttgggatagcctggtgaaagccaggataataccggatacgacggtttggtcacaagaccgaatcgggaaaggggctaaggcctcgctgaaggatgagtccgcgtcccattagctagatggtgaggtaaaggcccaccatggcgatgatgggtagccggcctaagagggtgaacggccacattgggactgagatacggcccagactcctacgggaggcagcagctaagaatcttccgcaatggtcgaaagactgacggagcgacgccgcgtgaatgatgaaggccgtgaggttgtaaagttcttttctggagggagaataagtgatgtagggaatgacatcatgatgacgtgaatccaggaa

SEQ ID NO: 2793 - DNA, 490 bp, Unknown
  Ascusbbf_6606, encodes 16S rRNA
agagtttgatcatggctcaggataaacgctggcggcgtgcattatgcatgcaagtcgaacgggactcgcaagagtctagtggcaaacgggtgagtaacacataggtaacctgtccacgagtggggaataactcgccgaaaggcggactaataccgcatacgatggcttctcacaagagaggtcatgaaagcagcaatgcgctggtggaggggcctgtgaccgattagtttgttggtggggtaacggcctaccaagactgtgaccggtagctggtctgagaggatggtcagccacattgggactgagacacggcccaaactcctacgggaggcagcagcaaggaattttgcgcaatgggcgaaagcctgacgcagcaacgccgcgtgaaggatgaaggccttcgggttgtaaacttcttttataagggaagaatgatgacggtaccttatgaataagcttcggctaactacgtgccagcagccgcggtaat

SEQ ID NO: 2794 - DNA, 490 bp, Unknown
  Ascusbbf_79618, encodes 16S rRNA
agagtttgatcatggctcaggacgaacgctggcggcgtgcttaacacatgcaagtcgaacgagaatgcaggagagcttgcttgaatgtattcgagtggcggacgggtgagtaacgcgtgaataatctgtcccatacagggggataacgcatcgaaagatgtgctaataccgcgtaggaccacgaggtcgcatggccttggggtgaaaggagcaatccagtatggggtgagttcgcgtctgattagatagttggtgaggtaacggctcaccaagtcaacgatcagtagccgacctgagagggtgatcggccacattgggactgagacacggcccagactcctacgggaggcagcagtggggaatattgggcaatgggcgaaagcctgacccagcaacgccgcgtgaaggaagaaggttttcggattgtaaacttctgtcctatgtgaagagatagagacggtagcataggaggaagccccggctaactacg

SEQ ID NO: 2795 - DNA, 490 bp, Unknown
  Ascusbbf_31747, encodes 16S rRNA
agagtttgatcatggctcagattgaacgctggcggcaggcctaacacatgcaagtcgagcgcgaaagttcttcggaatgagtaaagcggcgaacgggtgagtaacgcgtgggaatctgcccagtagtgggggataacgttccgaaaggaacgctaataccgcatacgccctacgggggaaagggggggatcttcggacctctcgctattggatgagcctgcgtcggattagctagttggtggggtaagggcctaccaaggcgacgatccgtaactggtctgagaggatgatcagtcacactggaactgagacacggtccagactcctacgggaggcagcagtggggaatattggacaatgggggcaaccctgatccagccatgccgcgtgtgtgaagaaggccttagggttgtaaagcactttcagtggggagaaaggtggctcacctaatacgtgagttaattgatgttacccacagaagaagcaccgg

SEQ ID NO: 2796 - DNA, 490 bp, Unknown
  Ascusbbf_91272, encodes 16S rRNA
agagtttgatcctggctcaggataaacgctggcggcgtgcttaacacatgcaagtcgaacggagtggttctcccgagaagtgatgaagcttgcttcagaatgactcatttgaatcacttagtggcggacgggtgagtaacgcgtgggtaacctgccctatactgggggatagcagttggaaacgactgataataccgcataagcacacagcatcgcatgttgcagtgtgaaaaactccggtggtataggatggacccgcgtctgattagctagttggtgaggtaacggcccaccaaggcgacgatcagtagccggcctgagagggtgtacggccacattgggactgagacacggcccaaactcctacgggaggcagcagtggggaatattggacaatgggggcaaccctgatccagcgacgccgcgtgagcgaagaagtatttcggtatgtaaagctctatcagcagggaagataatgacggtacctgac

SEQ ID NO: 2797 - DNA, 490 bp, Unknown
  Ascusbbf_195251, encodes 16S rRNA
agagtttgatcatggctcaggatgaacgctagcggcaggcttaacacatgcaagtcgaggggcagcgggtctagcaatagatgccggcgaccggcgaaagggtgagtaacgcgtgagcaacatgcccggagcagggggataggcactggaaacggtgtgtaatatcccgtaacatattccatcgcatggtgggatattgaaagattaatcggctccggattggctcgcgtaccattaggtagttggcggggtaacggcccaccaagccgacgatggttaggggttctgagaggaaggtcccccacattggaactgagacacggtccagactcctacgggaggcagcagtgaggaatattggacaatggccgggaggctgatccagccatgccgcgtgagggaggacggccctatgggttgtaaacctcttttgtcggggagcaataagtattacgtgtaatacgatgagagtacctggcgaataagcatc

SEQ ID NO: 2798 - DNA, 490 bp, Unknown
  Ascusbbf_82374, encodes 16S rRNA
agagtttgatcatggctcaggatgaacgctggcggcgcgcataacacatgcaagtcgaacggagtcacgttgaaacctagtgatatgtgacttagtggcggacgggtgagtaacgcgtgggtaacctacctgatattgggggacaacagttagaaatgactgctaataccgcatacgacattcggagggcatcctctgaatgggaaaggaattatccgataccagatggacccgcgtctgattagctagttggtgaggtaacggcccaccaaggcgacgatcagtagccgaactgagaggttgaccggccacattgggactgagacacggcccaaactcctacgggaggcagcagtggggaatattgcacaatggggggaaccctgatgcagcgacgccgcgtgagtgatgaagtatttcggtatgtaaagctctatcgatggggaagaaaatgacggtacccaagtaagaagccccggctaactacgtg

SEQ ID NO: 2799 - DNA, 490 bp, Unknown
  Ascusbbf_638681, encodes 16S rRNA
agagtttgatcatggctcaggattaacgctagcggtatgcctaatatatgcaagtcgagcgggagcagcaatgctctagcggcaaacgggtgagtaatacgtatctaatctaccctttagaagggacaacagatcgaaagatttgctaataccttataggacatagattcacatgaaactatgtttaaagttccgttcggaacgctttaggatgagggtgcggcttatcagatagttggtgaggtaatggcccaccaagtcaatgacgagtagctatgctgagaggtaaaatagccacaaggggactgagacacggcccctactcctacgggaggcagcagtagggaatttttcacaatgggcgaaagcctgatggagcaataccgcgtgaatgatgaaggtcttcggattgtaaaattcttttataagggacgaatgatgtgaacaggaaatggttcgcaagtgactgtaccttttgaataagtaacgg

SEQ ID NO: 2800 - DNA, 490 bp, Unknown
  Ascusbbf_230145, encodes 16S rRNA
agagtttgatcctggctcaggatgaacgctggcggcgtgcttaacacatgcaagtcgaacggaggaccctggaaggagttttcggacaacagaaggggtaccttagtggcggacgggtgagtaacgcgtgaggaacctgccttggagaggggaataacacagagaaatttgtgctaataccgcatgaagcagctgggtcgcatggccctggctgccaaagatttatcgctctgagatggcctcgcgtctgattagcttgttggcggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttatgcaggacgaagtaagtgacggtactgcatgaataagctcc

SEQ ID NO: 2801 - DNA, 490 bp, Unknown
  Ascusbbf_408315, encodes 16S rRNA
agagtttgatcctggctcaggatgaacgctagctacaggcttaacacatgcaagtcgcggggcagcatggggtttgcttgcaaaccccgatggcgaccggcgcacgggtgagtaacgcgtatccaacctgccccatagcagggaatagcccggcgaaagtcggattaatgccctatgttgtccgaggcggacatctaactcggaccaaaggtacgccgctatgggatggggatgcgtaggattaggcaggcggcggggcgacggcccaccgcgccgacgatccttaggggttctgagaggaaggtcccccacactggtactgagacacggaccagactcctacgggaggcagcagtgaggaatattggtcaatgggcgagagcctgaaccagccaagtagcgtgcaggatgacggccctacgggttgtaaactgcttttacgcggggataaagcgcgggacgtgtcccgccttgcaggtaccgcgtgaat

SEQ ID NO: 2802 - DNA, 490 bp, Unknown
  Ascusbbf_1887856, encodes 16S rRNA
agagtttgatcatggctcaggatgaacgctggcggcgcgtcttaagcatgcaagtcgagcgggaaccgggggcttgcccccggcgagagcggcggactggcgaggagcgcgtgggcgacgcgccccccggactggaacagcccgtggaaacacggggtaatgccggatggcatgcctttcttggaggggaggcatcaaaggggcttcggccccgccgggggagcggcccgcgtcccatcagcttgttggcggggaaaaggcccaccaaggctacgacgggtgtccggcctgagagggcgatcggacgcattgggactgagatacggcccagactcctacgggaggcagcagctaagaatattccgcaatgggcgaaagcctgacggagcgacgccgcgtgcgcgatggaggccggaaggttgtaaagcgcttttgggagggaggaagaagccggggaggaaacgccccggcggcgacggtacctcgcgaa

SEQ ID NO: 2803 - DNA, 490 bp, Unknown
  Ascusbbf_1563185, encodes 16S rRNA
agagtttgatcatggctcaggatgaacgctggcggcgtgcttaacacatgcaagtcgagcgaagcacttcacccgaagaagagaaccagcttgctggtgatcggactcaatcgaagtgactgagcggcggacgggtgagtaacgcgtggagaacctgcctttatccgggggataacagttagaaatgactgctaataccgcataagcgcacaccaaggcatcttggagtgtaaaaaactccggtggatagagatggctccgcgttggattagccagttggcggggtaacggcccaccaaagcgacgatccatagccggcctgagagggcgaccggccacattgggactgagacacggcccaaactcctacgggaggcagcagtggggaatattgcacaatgggggaaaccctgatgcagcgacgccgcgtgaacgaagaagtatttcggtatgtaaagttctatcagcagggaagaaaatgacggtacct

SEQ ID NO: 2804 - DNA, 490 bp, Unknown
  Ascusbbf_128213, encodes 16S rRNA
agagtttgatcctggctcaggatgaacgctagctacaggcttaacacatgcaagtcgaggggcagcatgaacttagcttgctaagtttgatggcgaccggcgcacgggtgagtaacgcgtatccaacctacccttcagtaggggacagcccggcgaaagtcggattaataccctatgttatccgttgaggacatctgatgtggatgaaagatttatcgctgagggatggggatgcgtctgattaggtggatggcggggtaacggcccaccatgccttcgatcagtaggggttctgagaggaaggtcccccacattggaactgagacacggtccaaactcctacgggaggcagcagtgaggaatattggtcaatgggcgtgagcctgaaccagccaagtagcgtgagggatgacggccctacgggttgtaaacctcttttgcgggggaataacaggcttcacgagttggagttttgcatgtaccccgagaa

SEQ ID NO: 2805 - DNA, 490 bp, Unknown
  Ascusbbf_44201, encodes 16S rRNA
agagtttgatcatggctcaggataaacgctggcggcgcacataagacatgcaagtcgaacgaactcaacctattcttttagattaggagcggttagtggcggactggtgagtaatgtataagtaacctgcctattagaggggaacaacagttggaaacgactgctaataccgcatatgccatagagatcacatgatttcagtgggaaaggagcaatccgctaatagatggacttatatctgattagctagttggtgtggtaacggcataccaaggcgacgatcagtagccggactgagaggttaaacggccacattgggactgagatacggcccagactcctacgggaggcagcagtcgggaatattgcgcaatggaggaaactctgacgcagtgacgccgcgtgcaggaagaaggctttcgagttgtaaactgctttagacagggaagaagaagtgacagtacctgtagaataagctccggctaactac

SEQ ID NO: 2806 - DNA, 490 bp, Unknown
  Ascusbbf_37750, encodes 16S rRNA
agagtttgatcctggctcaggacgaacgctggcggcgtgcttcaaacatgcaagtcgaacgagagacgagggagcttgctcctgaggatctagtggcggacgggtgagtaacgcgtgaacaatctggcttacacagggggataacacttagaaatgagtgctaataccgcatatgaccacggcctggcatcgggcaggggtgaaaggagagatccggtgaaagatgagtttgcgtttcattagctagttggtgaaggtaacggcccaccaaggcgacgatgaatagccgatctgagaggatgaacggccacactggaattgagagacggtccagactcctacgggaggcagcagttaggaatattgggcaatggagggaactctgacccagcaacgccgcgtgaaggaagaaggttttcggattgtaaacttctgatctgtgggaagaagaagatgacggtaccacaggagaaagccacggctaactacg

SEQ ID NO: 2807 - DNA, 490 bp, Unknown
  Ascusbbf_175656, encodes 16S rRNA
agagtttgatcctggctcaggatgaacgctggcggcgtgcctaacacatgcaagtcgaacgaggttatcttacttggagattcgtcgaagagttttttaaccgagtggcggatgggtgagtaacgcgtggagaacctgcccttatcagggggataacaactggaaacggttgacaataccgcatacgctcgtaggttcgcatgaacttacgaggaaagatttatcggataaggatggctccgcgtcggattagccagttggcggggtaacggcccaccaaagcgacgatccgtagccggcctgagagggcgaccggccacattgggactgagacacggcccagactcctacgggaggcagcagtgggggatattgcacaatggggggaaccctgatgcagcgacgccgcgtggaggaagaagtatttcggtatgtaaactcctatcagcagggaagaaaatgacggtacctgactaagaagccccggcta

SEQ ID NO: 2808 - DNA, 490 bp, Unknown
  Ascusbbf_165931, encodes 16S rRNA
agagtttgatcctggctcaggacgaacgctggcggcgtgcttaaaacatgcaagtcgaacggagttgtttgttagcactaaggtatttcagataagatactttagtgctaataaatagcttagtggcggacgggtgagtaacacatgagcaacctgcctttcacagggggataacacttagaaataggtgctaataccgcataagaccacgacagggcatcctgatggggtcaaaggagcaatccggtggaagaggggcttgtgactcattagttagttggtagggtaacggcctaccaagaccgcgatgagtagccgatctgagaggatgaacggccacattggaactgagatacggtccagactcctacgggaggcagcagttaggaatattgggcaatgggcgaaagcctgacccagcaacgccgcgtgaaggaagaaggttttcggattgtaaacttctgatctaagggaaaaagagagtgatggt

SEQ ID NO: 2809 - DNA, 490 bp, Unknown
  Ascusbbf_158086, encodes 16S rRNA
agagtttgatcatggctcaggattaacgctggcggcgtgcataacacattcaagtcgaacggagtattgctttcgggtgatactcagtggcggacgggtgagtaacgcgtgagcaatctgccccttattgcgggataacagagagaaatttctgctaatacggcataacgcatcggtatcgcatggtacgggtgccaaagatttatcgatgagggatgagctcgcgtccgattagatagttggtgacggtaacggcgcaccaagtctgcgatcggtagccggactgagaggttgaacggccacattgggactgagacacggcccagactcctacgggaggcagcagtggggaatattggacaatgggggaaaccctgatccagcgacgccgcgtgaaggaagaaggccttcgggttgtaaacttcagtcagcagggaagaacaaatgacggtacctgcaggggaagccacggctaactacgtgccagcag

SEQ ID NO: 2810 - DNA, 490 bp, Unknown
  Ascusbbf_87363, encodes 16S rRNA
agagtttgatcatggctcaggatgaacgctggcggcgtgcctaatacatgcaagtcgaacgaagtacttcggtacttagtggcgaacgggtgagtaacgcgtgaacaacctacccctttgactgggataccgtcttgaaaaggacgttaataccggataggtaaccttgaggcatctcaaagttattaaaggtgggctacaccacattgggatgggttcacgttgcattagctagttggtgaggtaacggcccaccaaggcgatgatgcatagccggtctgagaggatgaacggccacattgggactgagacacggcccagactcctacgggaggcagcagtagggaattttcggcaatgggcgaaagcctgaccgagcaacgccgcgtgaacgatgaaggtctttggattgtaaagttctgttacgagggaagaagaatcagcatagggaatgatgctgaagtgacggtacctcgccagaaagccacgg

SEQ ID NO: 2811 - DNA, 490 bp, Unknown
  Ascusbbf_161783, encodes 16S rRNA
agagtttgatcatggctcaggatgaacgctggcggcgtgcctaatacatgcaagtcgaacggagcacttcggtgcttagtggcgaacgggtgagtaacacataaacaatctaccctgaagactgggataacggttggaaacgaccgctaataccggataggtaactctgaggcatcttagagttattaaagttgggttacaacactgcaggatgagtttatgtcgcattagctggttggcggggtaacggcccaccaaggcgatgatgcgtagccggtctgagaggatgaacggccacattgggactgagacacggcccagactcctacgggaggcagcagtagggaattttcggcaatgggcgaaagcctgaccgagcaacgccgcgtgaacgatgaaggtctttggattgtaaagttctgttacgagggaagaatggctggtatagggaatgatatcagcagagacggtacctcgccagaaagccacg

SEQ ID NO: 2812 - DNA, 490 bp, Unknown
  Ascusbbf_862493, encodes 16S rRNA
agagtttgatcctggctcaagacgaacgctggcggcgtgcctaacacatgcaagtcgagcggggattacttagtggagagcttcggcaggaagctgagtaattctagcggcggacgggtgagtaacgcgtgaacaatctgtcccggacagggggataacacttggaaacaggtgctaataccgcatgagaccacaacgtcacatggcgaaggggtcaaaggagaaatccggtccggggtgagttcgcgtctgattagctagttggcggggtaatggcccaccaaggcgacgatcagtagccgacctgagagggtgatcggccacattggaactgagacacggtccaaactcctacgggaggcagcagtggggaatattgggcaatgggcgaaagcctgacccagcaacgccgcgtgagggaagaaggttttcggattgtaaacctctgtccttggtgacgaaggaagtgacggtagccaaggaggaagcc

SEQ ID NO: 2813 - DNA, 490 bp, Unknown
  Ascusbbf_965116, encodes 16S rRNA
agagtttgatcctggctcagaacgaacgctggcggcatgcctaacacatgcaagtcggacgtgagtgtccttcgggacacttaagtggcgcacgggtgagtaatgcataggaacatacctctgggtggggaataacgtcgggaaaccggcgctaataccgcatgacctcgaaacaggaaaggtggcctctatttataagctaccgccgagagagtggcctatgtcccattagctagttggcggggtaatagcccaccaaggctacgatgggtagctggtctgagaggatgatcagccacactggaactgagatacggtccagactcctacgggaggcagcagtggggaatattgcacaatgggcgaaagcctgatgcagcaatgccgcgtgagtgaagaaggccttagggttgtaaagctctttcgactgggaagaagtgttttatggctaatatccatagaatgtgacggtaccagcagaagaagcacc

SEQ ID NO: 2814 - DNA, 490 bp, Unknown
  Ascusbbf_767413, encodes 16S rRNA
agagtttgatcctggctcaggatgaacgctagcggcaggcctaacacatgcaagtcgaggggcagcgcggtgcagcaatgcactggcggcgaccggcgcacgggtgcgtaacgcgtatgcaacccacccgcaacaggggtataacggagggaaacttccactaatcccccatatagccgtcatcccgcatggggaggcggcgaaagcttcggcggttgcggacaggcatgcgtgacattacctagttggcggggcaacggcccaccaaggctgcgatgtctaggggagctgagaggctaatcccccacactggtactgagacacggaccagactcctacgggaggcagcagtgaggaatattggtcaatggtcggaagactgaaccagccatgccgcgtggaggaagaaggccctatgggttgtaaacttcttttagccgggagtaataaggggggtgcgccccccgatgagagtaccggcggaataagc

SEQ ID NO: 2815 - DNA, 490 bp, Unknown
  Ascusbbf_9135, encodes 16S rRNA
agagtttgatcctggctcaggataaacgctggcggcgcacataagacatgcaagtcgaacggaagtcgtaattaaagaagaacaaagatttatcagagtgaatttttaactacaatggctttagtggcggactggtgagtaatgtataagtaacctgcctatcagaggggaacaacagttggaaacgactgctaataccgcatatgccataatggagacatcttcaaagtgggaaaggagcaatccgctgatagatgggcttatatctgattagctagttggtggggtaacggcctaccaaggcgacgatcagtagccgaactgagaggttagacggccacattgggactgagatacggcccagactcctacgggaggcagcagtcgggaatattgcgcaatggaggaaactctgacgcagtgacgccgcgtgcaggaagaaggttttcggattgtaaactgctttagacaggaaagaaaaaagacagta

SEQ ID NO: 2816 - DNA, 490 bp, Unknown
  Ascusbbf_5270, encodes 16S rRNA
agagtttgatcatggctcaggacgaacgctggcggcgtgcttaacacatgcaagtcgaacgaggcttagggaagagcttgctcggaactaagccgagtggcggacgggtgagtaacgcgtgagcaacctgtctcacacaggggaataacgcatcgaaagatgtgctaataccgcgtaggaccacgaaggggcatccctttgaggtgaaaggagcaatccggtgtgaggtgggctcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgcaagcctgacccagcaacgccgcgtgaaggaagaaggttttcggatcgtaaacttctgtccttggtgaagatagtgacggtagccaaggaggaagccccggctaactacg

SEQ ID NO: 2817 - DNA, 490 bp, Unknown
  Ascusbbf_48112, encodes 16S rRNA
agagtttgatcctggctcaggatgaacgctggcggcaggcttaatacatgcaagtcgaacggtaaggccgagcgtagcaatacgtgaggtacacgagtggcgcacgggtgcgtaacgcgtatgcaacctgcccccgaccgggacaaaacgtcgagaaattggcgctaatatcccatgtggacaccggatggcatcttccggtgtctaaagattcattggtcggggatgggcatgcgtatcattagctggttggcggggtaacggcccaccaaggcgacgatgattaggggttctgagaggatggtcccccacactggaactgagacacggtccagactcctacgggaggcagcagtagggaatattgggcaatggaagcaattctgacccagccatgccgcgtgcaggaagacggccctatgggttgtaaactgctttttccgcggagtaaccgccgggacgtgtcccggcctgagagtacgcggggaat

SEQ ID NO: 2818 - DNA, 490 bp, Unknown
  Ascusbbf_53555, encodes 16S rRNA
agagtttgatcatggctcaggatgaacgctagctacaggcttaacacatgcaagtcgaggggcagcatgatcaaagcttgctttgattgatggcgaccggcgcacgggtgcgtaacgcgtatccaacctgccgtgtactccgggatagccctctgaaaggaggattaataccggatgtggtcgggtgaagacatctttactcgattaaagattttatcggtacaccgatggggatgcgtacgattaggtagtcggcggggtaacggcccaccgagccaacgatcgttaggggttctgagaggaaggtcccccacataggaactgagacacggtcctaactcctacgggaggcagcagtgaggaatattggtcaatgggcgagagcctgaaccagccaagtagcgtgaaggacgactgccctatgggttgtaaacttcttttataggggaataaagtgcggcacgtgtgccgttttgtatgtaccctatga

SEQ ID NO: 2819 - DNA, 490 bp, Unknown
  Ascusbbf_35758, encodes 16S rRNA
agagtttgatcatggctcaggatgaacgctagctacaggcttaacacatgcaagtcgaggggcagcatgagagtagcttgctacttttgatggcgaccggcgaatgggtgagtaacgcgtatccaacctgccgcacacccgggaatagcccttggaaatgaggattaagtcccgatatgcatggtagtcgcatgactactgtgtgaacccaggtatgcgatggggatgcgtccgattagcttgccggcggggtaacggcccaccggggcatcgatcggtaggggttctgagaggaaggtcccccacactggtactgagacacggaccagactcctacgggaggcagcagtgaggaatattggtcaatggacgagagtctgaaccagccaagtagcgtgcaggatgacggccctatgggttgtaaactgctttttccggggaataacatgtgccacgtgtggcactttgcatgtacccggtgaataaggac

SEQ ID NO: 2820 - DNA, 490 bp, Unknown
  Ascusbbf_1235066, encodes 16S rRNA
agagtttgatcctggctcaggatgaacgctggcggcgtgcttaacacatgcaagtcgaacgaagcactgaaagcttgcttttggtgacttagtggcggacgggtgagtaacgcgtgggtaacctgcctcacacagggggataacagttggaaacgaccgctaataccgcataacccgctagggccgcatggcccggacggaaagatttatcggtgtgagatggacccgcgtctgattagatagttggcagggtaacggcctaccaagtcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagca

SEQ ID NO: 2821 - DNA, 490 bp, Unknown
  Ascusbbf_136510, encodes 16S rRNA
agagtttgatcctggctcaggacgaacgctggcggcgtgcctaacacatgcaagtcgaacggagttgaattgaatgaagttttcggatggaattcgatttaacttagtggcggacgggtgagtaacgcgtgagtaacctgccgatgagagggggataacgttctgaaaagaacgctaataccgcatgacatatcgaagccgcatgactttgatatcaaaggagcaatccgctcatcgatggactcgcgtccgattagctagttggcggggtaacggcccaccaaggcgacgatcggtagccggactgagaggttgaacggccacattgggactgagacacggcccagactcctacgggaggcagcagtgggggatattgcgcaatggggggaaccctgacgcagcaacgccgcgtgaaggatgaaggtcttcggattgtaaacttcttttgttaaggacgaagaaagtgacggtacttaacgaataagct

SEQ ID NO: 2822 - DNA, 490 bp, Unknown
  Ascusbbf_120217, encodes 16S rRNA
agagtttgatcatggctcaggatgaacgctagcggcaggcttaacacatgcaagtcgaggggcagcgcggagtagcaatactctggcggcgaccggcgcacgggtgcgtaacgcgtatgcaacctgcctgtaacagggggataacccggagaaatttggactaataccgcatattgccgcgggtcagcattggtttgcggcgaaaggagcgatccggttacagatgggcatgcgtgacattaggtagttggcggggcaacggcccaccaagccgacgatgtctaggggaactgagaggttagtcccccacactggtactgagacacggaccagactcctacgggaggcagcagtgaggaatattggtcaatggacggaagtctgaaccagccatgccgcgtgcgggaggaaggccctacgggttgtaaaccgcttttacgggggagcaataagcgccgtgcgcggcgtgatgagagtaccccgggaataa

SEQ ID NO: 2823 - DNA, 490 bp, Unknown
  Ascusbbf_86027, encodes 16S rRNA
agagtttgatcctggctcaggacgaacgctggcggcgcgcctaacacatgcaagtcgaacgggatttttaattaagattcttcggatgattgattataaatctagtggcggacgggtgagtaacgcgtgagtaacctgcctttcagagggggataacgtttggaaacgaacgctaataccgcataagattgtagtatcgcatggtacagcaatcaaaggagcaatccgctgaaagatggactcgcgtccaattagctagttggtgaggtaacggcccaccaaggcgacgattggtagccggactgagaggttgaacggccacattgggactgagacacggcccagactcctacgggaggcagcagtggggaatattgcacaatgggggaaaccctgatgcagcgacgccgcgtgagggaagaaggttttcggattgtaaacctctgtccttggtgaagaagatgactgtagccaaggaggaagccacggc

SEQ ID NO: 2824 - DNA, 490 bp, Unknown
  Ascusbbf_163756, encodes 16S rRNA
agagtttgatcctggctcaggatgaacgctagcggcaggcctaacacatgcaagtcgaggggcagcgcggtgtggcaacacactggcggcgaccggcggatgggtgcgtaacgcgtatgcaacctgcctccgagagggggataacccgtggaaacgcggactaataccccgtatgcgcacgacgccgcatgacgttgtgcggaaagattgattgctcggagatgggcatgcgtggcattaggtagttggcggggcaacggcccaccaagccatcgatgcctaggggagctgagaggctaatcccccacactggtactgagacacggaccagactcctacgggaggcagcagtgaggaatattggtcaatggagggaactctgaaccagccatgccgcgtgagggaagacggccctatgggttgtaaacctcttttagccgggagcaataagggtcccgcggggcccgacgagagtaccggcggaataagc

SEQ ID NO: 2825 - DNA, 490 bp, Unknown
  Ascusbbf_199087, encodes 16S rRNA
agagtttgatcctggctcaggatgaacgctggcggcatgcctaagacatgcaagtcgaacgagatggcccaatgaaggttgagtgcttgcacaagactggatttggatttccatctagtggcagacgggtgagtaacacgtgggtgacctaccttttcgttggggataacagttggaaacgattgctaataccgaataagatatatgagtcaattatatattgaaaggagcctttaaagcttcgcgattagatgggcctgcggcgtattaacttgttggcggggtaatggcccaccaaggtgacgatgcgtagccgaactgagaggttgatcggccacactgggactgagacacggcccagactcctacgggagacagcagttaggaatattcgtcaatggaggaaactctgaacgagcaatgccgcgtgagtgatgaaggtctttggattgtaaaactctgttgtatagaaaaaattactaggttagga

SEQ ID NO: 2826 - DNA, 490 bp, Unknown
  Ascusbbf_203849, encodes 16S rRNA
agagtttgatcctggctcaggatgaacgctagcggcaggcttaacacatgcaagtcgaggggcagcgcggggtagcaataccctggcggcgaccggcgcacgggtgcgtaacgcgtatgcaacctgcccgtaacaggggtataacggggagaaatccccactaatcccccatattgtcctgatgccgcatggcgttaggacgaaagccttggtggttacggacgggcatgcgtgacattaggtagttggcggggcaacggcccaccaagccgacgatgtctaggggagctgagaggcaggacccccacactggtactgagacacggaccagactcctacgggaggcagcagtgaggaatattggtcaatgggcggaagcctgaaccagccatgccgcgtggaggaagacggccctatgggttgtaaactccttttgccgcagagtaataagggccgtgcgcggcctgatgagagtatgcggcgaataagc

SEQ ID NO: 2827 - DNA, 466 bp, Unknown
  Ascusbbf_559411, encodes 16S rRNA
agagtttgatcatggctcagaacgaacgctggcggcaggcttaacacatgcaagtcgaacgccccgcaaggggagtggcagacgggtgagtaacgcgtgggaatctacccaattcttcggaacaacacatggaaacgtgtgctaataccgaatgagcccttcgggggaaagatttatcggaattggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggtcttaggattgtaaagctctttcaccggtgaagataatgacggtaaccggagaagaaccccggctaacttcgtgccagcagccgcggtat

SEQ ID NO: 2828 - DNA, 490 bp, Unknown
  Ascusbbf_124587, encodes 16S rRNA
agagtttgatcctggctcaggatgaacgctggcggcgtgcctaacacatgcaagtcgaacggttaacccgccttcgggcggtcataaagtggcgaacgggtgagtaacacgtgaccaacctgccccgcgctccgggacagcctcgcgaaagcgggattaataccggatgcaccgcacctttcgcatgatcggtgcgggaaagctccggcggcgcgggatggggtcgcggcccatcaggtagacggtcgggtagaggccgaccgtgcctacgacgggtagccgggttgagagaccgaccggccacattgggactgagatacggcccagactcctacgggaggcagcagtggggaatattgcgcaatgggggaaaccctgacgcagcaacgccgcgtgcgggatgacggccctcgggttgtaaaccgctttcagcagggaagacatcgacggtacctgcagaagaagccccggctaactacgtgccagcagc

SEQ ID NO: 2829 - DNA, 490 bp, Unknown
  Ascusbbf_637926, encodes 16S rRNA
agagtttgatcctggctcaggatgaacgctagctacaggcttaacacatgcaagtcgaggggcagcgctggggttgcttgcaacccctggcggcgaccggcggatgggtgagtaacgcgtatccaacctgcccctgtcccggggacagcccttagaaatgaggattaacccccgatggcgtgcgtggcccgcatgggtcttgcactaaatgcgaaggacggggatggggatgcgttccattaggcagcaggcggggtaacggcccacctggccgacgatggataggggttctgagaggaaggtcccccacactggtactgagacacggaccagactcctacgggaggcagcagtgaggaatattggtcaatgggcggaagcctgaaccagccaagtagcgtgcgggatgaaggccctacgggttgtaaaccgcttttgcgcgcggataaagagggggactggtcccccgttgcaggtagcgcgcgaataa

SEQ ID NO: 2830 - DNA, 490 bp, Unknown
  Ascusbbf_1868565, encodes 16S rRNA
agagtttgatcatggctcaggacgaacgctggcggcgtgcttaacacatgcaagtcgagcggtaaggcccttcggggtacacgagcggcgaacgggtgagtaacacgtgagtaatctgcccttcacttcgggataaccaccggaaacggtggctaataccggatatgacttctcttcgcatgttgagaggtggaaagttctggcggtggaggatgtgctcgcggcctatcagcttgttggtgaggtaatggctcaccaaggcttcgacgggtagccggcctgagagggtgaccggccacactgggactgagacacggcccagactcctacgggaggcagcagtggggaatattggacaatgggcgaaagcctgatctagcaacgccgcgtgagggatgactgccttcgggttgtaaacctctttcagtaccgacgaagcgcaagtgacggtaggtacagaagaagcaccggccaactacgtgccagcagc

SEQ ID NO: 2831 - DNA, 490 bp, Unknown
  Ascusbbf_739788, encodes 16S rRNA
agagtttgatcatggctcaggatgaacgctggcggcgtgcttaacacatgcaagttgaacagacgaggcggagcttgctctgccgagttagtggcagacgggtgagtaacgcgtgagcaacctgcctttcagagggggacaacgttgggaaaccggcgctaataccgcataatatgcttttgccgcatgacagaagtatcaaaggagcaatccgctgaaagatgggctcgcgtctgattagatagttggtgaggtaacggcccaccaagtcgacgatcagtagccggactgagaggttgaacggccacattggaactgagatacggtccagactcctacgggaggcagcagtggggaatattgggcaatgggcgcaagcctgacccagcaacgccgtgtgaaggaagaaggtcttcggattgtaaacttttgtcttatgggacgatcatgacggtaccataggaggaagtcacgactaactacgtgccag

SEQ ID NO: 2832 - DNA, 490 bp, Unknown
  Ascusbbf_207952, encodes 16S rRNA
agagtttgatcatggctcaggatgaacgctagcggcaggcttaacacatgcaagtcgaggggcagcacgagtgtttacacttggtggcgaccggcgcaagggtgcgtaacgcgtgagcaacatgcccgtatcagggggataatccagggaaacttggtctaataccgcataataaatcttgaaggcatcttcatggattttaaaatttcgatggatacggattggctcgcgtgacattagctagatggtaaggtaacggcttaccatggcaatgatgtctaggggttctgagaggaaggtcccccacactggaactgagacacggtccagactcctacgggaggcagcagtgaggaatattggacaatggatggaaatctgatccagccatgccgcgtgcaggaagacggtcctatggattgtaaactgcttttatatgggagcaataagaactacgtgtagttcgatgagagtaccatatgaataagca

SEQ ID NO: 2833 - DNA, 490 bp, Unknown
  Ascusbbf_234125, encodes 16S rRNA
agagtttgatcatggctcaggacgaacgctggtggcgtgcttaacacatgcaagtcgaacgatgaagcccagcttgctgggtggattagtggcgaacgggtgagtaatacgtgagcaacgtgcccaagacactgggataacctagcgaaagccaggctaataccggatatgagagaacggggcatcctgttttttggaaagattttttggtcttggatcggctcacggcctatcagtttgttggtgaggtaacggctcaccaagactacgacaggtagccggcctgagagggtgatcggccacactgggactgagacacggcccagactcctacgggaggcagcagtggggaatattgcacaatgggcgaaagcctgatgcagcaacgccacgtgggggacgaaggccttcgggttgtaaacctcttttagcgggaaataagggaaactgaaggtacccgcagaaaaagcaccggctaactacgtgccag

SEQ ID NO: 2834 - DNA, 490 bp, Unknown
  Ascusbbf_612933, encodes 16S rRNA
agagtttgatcctggctcaggattaacgctggcggcgtgcctaacacatgcaagtcgaacgaaatatcttcggatatttagtggcgaacgggtgagtaatgtacaggtaatgtacctccgtactgcgaataacaagctgaaaagtttgctaatacggaatagtttcatcgaggggcatcccttgatgaataaagatttatcgtgcggagatcagcctgtatcctattagttagttggtggggtaatggcctaccaagacgacgatgggtaactggtctgagaggatgagcagtcacattggaactgagatacggtccaaactcctacgggaggcagcagtgaggaattttgcgcaatggggggaaccctgacgcagcaacgccgcgtgagtgatgacggctttcgggttgtaaagctctgtcgtgtatggcgagtagggacggtaatacacaaggaagcctcggctaactacgtgccagcagccgcggta

SEQ ID NO: 2835 - DNA, 490 bp, Unknown
  Ascusbbf_67925, encodes 16S rRNA
agagtttgatcctggctcaggatgaacgctggcggcgtgcctaatacatgcaagtcgaacgaaactacttcggtagtttagtggcgaacgggtgagtaacacatgaacaacctaccctgacgacagggataacagtttgaaaagactgctaatacctgataggtgaagagggggcatctccatttcattaaagttgggctacaacacgacaggatgggttcatgtcgcattagctagttggcggggtaacggcccaccaaggcgatgatgcgtagccgatctgagaggatgaccggccacattgggactgagacacggcccagactcctacgggaggcagcagtagggaattttcggcaatgggcggaagcctgaccgagcaacgccgcgtgaacgaagacggtctttggattgtaaagttctgttacgagggaagaataacacgtatagggaatgatatgtgcgtgacggtacctcgccagaaagccac

SEQ ID NO: 2836 - DNA, 490 bp, Unknown
  Ascusbbf_717449, encodes 16S rRNA
agagtttgatcctggctcaggatgaacgctagcggcaggcctaatacatgcaagtcggacggtatcccgttttcggacgggagagagtggcgcacgggtgcgtaacgcgtatgcaacctgccctatactgtgggatagcccggggaaacccggattaataccgcatgttaccggttacgggcatccgtatccggtcaaagatttatcggtataggatgggcatgcgtaggattagctagttggcggtgtaacggaccaccaaggcgatgatccttaggggttctgagaggaaggtcccccacactggcactgagatacgggccagactcctacgggaggcagcagtagggaatattgggcaatgggcgggagcctgacccagccatgccgcgtgcaggaagacggcgttctgcgttgtaaactgcttttatacgggaagaaaaggcccatgcgtgggacattgccggtaccgtatgaataagcaccggct

SEQ ID NO: 2837 - DNA, 490 bp, Unknown
  Ascusbbf_238538, encodes 16S rRNA
agagtttgatcctggctcaggatgaacgctggcggcaggcttaatacatgcaagtcgaacggtaaggccgagtgcagcaatgcacgaggtacacgagtggcgcacgggtgcgtaacgcgtatgcaacctgcccttcaccgggacaaaacagctggaaacggctgctaatatcccatggttacgagaggtggcatcaccattcgtataaagattcattggtgagggatgggcatgcgtattattaggtagttggcggggtaacggcccaccaagccgacgatgattaggggttctgagaggattaacccccacactggaactgagacacggtccagactcctacgggaggcagcagtagggaatattgggcaatggaggcaactctgacccagccatgccgcgtgaaggaagacggccctatgggttgtaaacttcttttgtcgcagagtaaagtcggtcacgcgtggccgtttgagagtatgcgacgaat

SEQ ID NO: 2838 - DNA, 490 bp, Unknown
  Ascusbbf_8890, encodes 16S rRNA
agagtttgatcatggctcaggatgaacgctagcggcaggcttaacacatgcaagtcgaggggcagcgagggtagcaatacctgtcggcgaccggcggaagggtgcgtaacgcgtgagcaacttgcccgtatctgggggatagtcattggaaacgatgcgtaataccccataacaacagaggctgcatgacctttgtttgaaagcgattagtggatacggataggctcgcgagacattagctagttggtggggtaacggcccaccaaggcgacgatgtctaggggttctgagaggaaggtcccccacattggaactgagacacggtccaaactcctacgggaggcagcagtgaggaatattggtcaatggccggaaggctgaaccagccatgccgcgtgcaggaataaggccctatgggtcgtaaactgcttttgtggtggagcaataagacgtacgcgtacgtcgatgagagtacatcacgaataagcat

SEQ ID NO: 2839 - DNA, 490 bp, Unknown
  Ascusbbf_85756, encodes 16S rRNA
agagtttgatcatggctcaggatgaacgctagctacaggcttaacacatgcaagtcgaggggcagcacgtgggtagcaataccctgggtggcgaccggcgcacgggtgagtaacgcgtatccaacctggcccatagtagggaacagcccggcgaaagtcggattaatgccctatgttttcctcagtgagcattttatgaggaacaaagacttgtcgctatgggatggggatgcgtccgattaggcagcaggcggggcaacggcccacctggccttcgatcggtaggggttctgagaggaaggtcccccacactggtactgagacacggaccagactcctacgggaggcagcagtgaggaatattggtcaatgggcgtaggcctgaaccagccaagtagcgtgcgggacgacggccctatgggttgtaaaccgcttttgcacgggaataaagtgggggacgtgtccccttttgcatgtaccgtgagaataa

SEQ ID NO: 2840 - DNA, 490 bp, Unknown
  Ascusbbf_510440, encodes 16S rRNA
agagtttgatcctggctcaggatgaacgctagctacaggcttaacacatgcaagtcgagcggaacttcttcggaagtttagcggcagacgggtgagtaacacgtatccaacctttcccttactcgggtatagcctcgggaaactgagagtaatccccgatgaagtgtacgaggagcattttttgcacaccaaagattaatcggtgaggggtggggatgcgttccattaggtagtaggcggggcaacggcccacctagccgatgatggataggggttctgagaggaaggtcccccacattggaactgcgaaacggtccaaactcctacgggaggcagcagtgaggaatattggtcaatggacgagagtctgaaccagccaagtagcgtgcaggatgacggccctatgggttgtaaactgcttttgtgcgggaataacgttgtgctcgtgagcgcaagtgcatgtaccgtacgaataaggatcggctaactc

SEQ ID NO: 2841 - DNA, 490 bp, Unknown
  Ascusbbf_18608, encodes 16S rRNA
agagtttgatcatggctcaggatgaacgctagcggcaggcttaacacatgcaagtcgaggggcagcgaggagtagcaatactttgtcggcgaccggcagacgggtgcgtaacgcgtatgcaacctacccatcacaggggtatagcccggcgaaagccggaataatcccccatggttccacaatttcgcatgttattgtggataaacgggtgaccgggtgatggatgggcatgcgtggcattaggcagttggcggggtaacggcccaccaaaccgacgatgcctaggggtcctgagagggaggtcccccacattggaactgagacacggtccaaactcctacgggaggcagcagtgaggaatattggtcaatgggcgagagcctgaaccagccatgccgcgtgcaggaagacggccttatgggttgtaaactgcttttattggggacgagcatgactacgtgtagtcaaatgacggtacccgatgaataag

SEQ ID NO: 2842 - DNA, 490 bp, Unknown
  Ascusbbf_156715, encodes 16S rRNA
agagtttgatcatggctcaggacgaacgctggcggcgtgcctaacacatgcaagtcgaacgaagcatctggagctgatttcttcggaatgacgcaccttatgactgagtggcggacgggtgagtaacacgtgagcaacctgcccttcggtgaggaatagcagctggaaacggctggtaatacctcatgacatagtccattcgcatgtttggactatcaaagatttatcgccgatggatgggctcgcgtccgattaggtagttggtgaggtaacggcccaccaagccgacgatcggtagccggactgagaggttgatcggccacattgggactgagacacggcccagactcctacgggaggcagcagtgggggatattgcacaatgggcgcaagcctgatgcagcaacgccgcgtgcgggaagacggccttcgggttgtaaaccgctgtccttagtgaagaacacaatgacggtagctatggaggaagcca

SEQ ID NO: 2843 - DNA, 490 bp, Unknown
  Ascusbbf_130009, encodes 16S rRNA
agagtttgatcctggctcaggatgaacgctggcggcgtgcttaacacatgcaagtcgaacgaagcatccctcccgaagaagcggaagtgcttgcacagaagtggattcatttgggatgacttagtggcggacgggtgagtaacgcgtgggcaacctgccctatagagggggacaacagttagaaatgactgctaataccgcatagtaatgcagatccgcatgcttctgcattgaaagcttttgcgctataggatgggcccgcgtttgattagctagttggtgaggtaacggcccaccaaggcgacgatcaatagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcaggaaagataatgacggtacct

SEQ ID NO: 2844 - DNA, 490 bp, Unknown
  Ascusbbf_549989, encodes 16S rRNA
agagtttgatcatggctcagattgaacgctggcggcaggcctaatacatgcaagtcgaacggcagcgggggcttcggcccgccggcgagtggcgaacgggtgagtaatgcatcggaacgtacccagtcgtgggggataacgcagcgaaagctgtgctaataccgcatacgtcctgagggagaaagcgggggaccttcgggcctcgcgcgattggagcggccgatgtcggattagctagttggtggggtaaaggctcaccaaggcgacgatccgtagctggtctgagaggatgatcagccacactgggactgagacacggcccagactcctacgggaggcagcagtggggaattttggacaatgggggcaaccctgatccagccatgccgcgtgagtgaagaaggccttcgggttgtaaagctctttcagtcgggaagaaacggagcgctctaacatagcgctctactgacggtaccgacagaagaagcac

SEQ ID NO: 2845 - DNA, 490 bp, Unknown
  Ascusbbf_47706, encodes 16S rRNA
agagtttgatcatggctcaggatgaacgctggcggcgtgcctaacacatgcaagtcgagcgagaaattgcagattgaaacttcggtcgaaagaagcgatggacagcggcggacgggtgagtaacgcgtaggtaacctaccttgagctgagggatagcctagggaaacctggattaataccacataatgcggatgagtcacatggctcatcagccaaagatttatcggcccaagatggacctgcgtctgattagatagttggtgaggtaacggcccaccaagtcgacgatcagtagccgatctgagaggataatcggccacattggaactgagacacggtccaaactcctacgggaggcagcagtggggaatattgcacaatgggcgcaagcctgatgcagcaacgccgcgtgagcgaagaaggtcttcggatcgtaaagctctgtccttggggaagaagaaagtgacggtacccgaggaggaagccccgg

SEQ ID NO: 2846 - DNA, 490 bp, Unknown
  Ascusbbf_221533, encodes 16S rRNA
agagtttgatcatggctcaggatgaacgctggcggcgtgcttaacacatgcaagtcgaacggagatataattaggaagttttcggatggaatgaatatatcttagtggcggacgggtgagtaacacgtaaacaatctgccttcgagagcgggacaacagatagaaatatttgctaataccgcataagaccacaggtacgcatgtactaggggtcaaagggagcaatccgctcggagatgagtttgcggactattagctagttggtgaggtaatggcccaccaaggcagagatggttagccgacctgagagggtgatcggccacactggaactgagacacggtccagactcctacgggaggcagcagtgaggaatattgggcaatggagggaactctgacccagcaacgccgcgtgaaggaagaaggttttcggattgtaaacttctgttatggaggaaaaaggaagtgatggtactccatgagcaagcta

SEQ ID NO: 2847 - DNA, 489 bp, Unknown
  Ascusbbf_172279, encodes 16S rRNA
agagtttgatcatggctcaggacgaacgctggcggcgtgcctaacacatgcaagtcgagcgaggtatttatacctagcggcggacgggtgagtaacacgtgggtaacctacctcagagaggggaatagccttccgaaaggaagattaataccgcataatatacacatttagcattatgagtgtatcaaaggagaaatccgctttgagatgggcccgcggcgcattagctagttggggaggtaacggctccccaaggcgacgatgcgtagccgacctgagagggtgatcggccacattggaactgagacacggtccagactcctacgggaggcagcagtggggaatattgcacaatggggggaaccctgatgcagcaacgccgcgtgaatgacgaaggctttcgggtcgtaaagttctttgatgggggatgacaatgacagtaccccaaaaacaagccacggctaactacgtgccagcagccgcggtaat

SEQ ID NO: 2848 - DNA, 490 bp, Unknown
  Ascusbbf_354817, encodes 16S rRNA
agagtttgatcctggctcagaacgaacgctggcggcgtgcttaatacatgcaagtcgaacgtgattttcgtagcaatacgggatgaaagtggcgaacgggtgagtaacacgtaagtaatctgccttcaagtttgggataaccctgccaacgcggggctaataccggatgtggtcctgctgactcatgtgagcgggattaaaggtcgcaagaccgcttggagatgagcttgcggcccattagcttgttggtgaggtaacggctcaccaaggcagggatgggtagccggcctgagagggtgtacggccacattgggactgagatacggcccagactcctacgggaggcagcagtagggaattttgcgcaatggacggaagtctgacgcagcaacgccgcgtgaaggatgactgccttcgggttgtaaacttctgttggatgggaaaaaaagcccttacgggaattgatggtaccattcgagtaagcaccggc

SEQ ID NO: 2849 - DNA, 490 bp, Unknown
  Ascusbbf_631499, encodes 16S rRNA
agagtttgatcatggctcaggataaacgctggcggcgcacataagacatgcaagtcgaacggaccaaatacattgtttacattgtaagaggttagtggcggactggtgagtaacacgtaagcaacctgcctattagaggggaataacactgaggaatcagtgctaataccgcataagctagtagtaccgcatggtacagctagaaaaggagtaatccgctaatagatgggcttgcggctgattagctagttggtgtggtaaaggcataccaaggcaacgatcagtagccggactgagaggttgaacggccacattgggactgagatacggcccagactcctacgggaggcagcagtcgggaatattgcgcaatggagggaactctgacgcagtgacgccgcgtataggaagaaggttttcggattgtaaactattgtcgttagggaagaaaaggacagtacctaaggaggaagccccggctaactatgtg

SEQ ID NO: 2850 - DNA, 490 bp, Unknown
  Ascusbbf_149878, encodes 16S rRNA
agagtttgatcctggctcaggatgaacgctggcggcgtgcataacacattcaagtcgaacgaagcaccggcgaggaagtcttcggatggaattgcccttgacttagtggcggacgggtgagtaacgcgtgagcaaccttcctgtttgtgagggataacacagggaaacttgtgctaataccgcatgacgcatgggaatcgcatggtttcgatgccaaagatttattgcagacagatgggctcgcgtctgattagatagttggcagggtaacggcctaccaagtcgacgatcagtagccggactgagaggttgaacggccacattggaactgagagacggtccagactcctacgggaggcagcagtggggaatattgggcaatgggcgaaagcctgacccagcgacgccgcgtgagggaagaaggtcttcggattgtaaacctctttcagcaaggaagaagaaagtgacggtacttgcagaagaagccacg

SEQ ID NO: 2851 - DNA, 490 bp, Unknown
  Ascusbbf_1372237, encodes 16S rRNA
agagtttgatcatggctcaggatgaacgctagcggcaggcttaacacatgcaagtcgaggggcagcgcggggtagcaatactctggcggcgaccggcggaagggtgcgtaacgcgtgagcaacttgcccgtcactggaggataggcactggaaacggtgtgtaatactccataacataagaattcgcatgagtttttattgaaagattcattggtgacggatgggctcgcgagacattggctggtcggcggggtaacggcccaccgaggctacgatgtctaggggttctgagaggaaggtcccacgaactggaactgagaaacggtccagacgcctacgggaggcagcagtgaggaagattgggcaatgggcggaagcctgaaccagccatgccgcgtgaaggaataaggccctatgggtcgtaaacttcttttctgtgagggcaagaaggagcacgagtggtccgatgagagtatcaggggaataagca

SEQ ID NO: 2852 - DNA, 490 bp, Unknown
  Ascusbbf_1244159, encodes 16S rRNA
agagtttgatcctggctcagattgaacgctggcggcatgcttaacacatgcaagtcgaacggcagcacggattagtttactaattgggtggcgagtggcgaacgggtgagtaacgcgtaggaatataccttagagagggggacaacttggggaaactcaagctaataccgcatattatcttaggataaaagctggggaccgtaaggcctggcgctttaagaatagcctgcgtacgattagctagttggtggggtaaaggcctaccaaggcgacgatcgttagctggtctgagaggatgatcagccacactggaactgagacacggtccagactcctacgggaggcagcagtggggaatattggacaatggggggaaccctgatccagcaatgccgcgtgtgtgaagaaggcctgagggttgtaaagcactttcagtagggaggaggtatattgggttaagagctagatatacggacgttacctacagaag

SEQ ID NO: 2853 - DNA, 490 bp, Unknown
  Ascusbbf_10029, encodes 16S rRNA
agagtttgatcctggctcaggacgaacgctggcggcgtgcttaacacatgcaagtcgaacgagaggacaagagaagcttgcttcttttggaatcgagtggcaaacgggtgagtaacacgtaaacaacctgccttcaggatggggacaacagacggaaacgactgctaataccgaatacgcttggaagaccgcatgatcttccaaggaaagggtggcctctacctgtaagctatcgcctgaagaggggtttgcgtctgattaggcagttggtgaggtaacggcccaccaaacctacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaagctctgtgatcggggacgaacggtccgtaagctaataccttat

SEQ ID NO: 2854 - DNA, 490 bp, Unknown
  Ascusbbf_8450, encodes 16S rRNA
agagtttgatcctggctcaggatgaacgctagcggcaggcttaacacatgcaagtcgaggggcagcgcggggtagcaatatcctggcggcgaccggcggaagggtgcgtaacgcgtgagcaacttgcccgtcactggaggataggcactggaaacggtgtgtaatactccataacataagttttcgcatgaagatttattgaaagattcattggtgacggatgggctcgcgagacattagctagtcggcggggtaacggcccaccgaggctacgatgtctaggggttctgagaggaaggtcccccacactggaactgagacacggtccagactcctacgggaggcagcagtgaggaatattggtcaatgggcggaagcctgaaccagccatgccgcgtgaaggaataaggccctatgggtcgtaaacttcttttccttgggggcaataaggatcacgtgtggtccgatgagagtaccaggggaataagca

SEQ ID NO: 2855 - DNA, 490 bp, Unknown
  Ascusbbf_22451, encodes 16S rRNA
agagtttgatcctggctcagattgaacgctggcggcatgctttacacatgcaagtcgaacggcagcgggggcttcggcctgccggcgagtggcgaacgggtgagtaatgcatcggaacgtgcccatgtcgtgggggataactacgcgaaagcgtggctaataccgcatacgccctgagggggaaagcgggggatctttcgggacctcgcgcgattggagcggccgatgtcggattagctagttggtggggtaaaggctcaccaaggcgacgatccgtagctggtctgagaggatgatcagccacactgggactgagacacggcccagactcctacgggaggcagcagtggggaattttggacaatgggcgcaagcctgatccagccatgccgcgtgagtgaagaaggccttcgggttgtaaagctctttcggccgggaagaaatcgcattctctaatataggatgtggatgacggtaccggactaagaag

SEQ ID NO: 2856 - DNA, 490 bp, Unknown
  Ascusbbf_537567, encodes 16S rRNA
agagtttgatcctggctcaggacgaacgctggcggcgtgcctaatacatgcaagtcgaacggacaagtaaaagcttgctcttatgagttagtggcgcacgggtgagtaatgtatagttaatctgccccttagtggaggacaacagttagaaatgactgctaatactccatactccttcttaacataagttaagtcgggaaagtttttcgctaagggatgagactatattgtatcagctagttggtaaggtaatggcttaccaaggctatgacgcataactggtctgagaggatgatcagtcacactggaactgagacacggtctagactcctacgggaggcagcagtagggaatattgctcaatgggggaaaccctgaagcagcaacgccgcgtggaggatgacacttttcggagcgtaaactccttttgttagggaagaacactgacggtacctaacgaataagcaccggctaactccgtgccagcagc

SEQ ID NO: 2857 - DNA, 490 bp, Unknown
  Ascusbbf_34842, encodes 16S rRNA
agagtttgatcatggctcagaacgaacgctggcggcgtgcctaacacatgcaagtcgagcgcgcgaggcacttcggtgccgagtgagcggcgcacgggtgaggaacacgtgggtaatgtgccctagaatccggaataacatttcgaaaggagtgctaatgccgggcgaggccacggtcactgcggtgacagcggcagaaggcagggatcagcaatgacctgtcgttttaggagcagctcgcggcccatcagctagttggcggggtaagggcccaccaaggcaacgacgggtagctggtctgagaggacgatcagccacactggaactgagacacggtccagactcctacgggaggcagcagtggggaattttgcgcaatgggcgaaagcctgacgcagcaacgccgcgtgagtgatgaaggtcttcggatcgtaaagctctttcgacaggaaggaaagggtttgggtcaattacccagactttgacagta

SEQ ID NO: 2858 - DNA, 490 bp, Unknown
  Ascusbbf_18694, encodes 16S rRNA
agagtttgatcatggctcaggatgaacgctagcggcaggcttaacacatgcaagtcgaggggcatcgcgggtagcaatacctggcggcgaccggcgaaagggtgagtaacgcgtgagcaacatgcccgtcacagggggatagtcattggaaacgatgcgtaataccccgtaacatataggatcgcatggttttatattgaaagatttatcggtgacggattggctcgcgtgccattagctagttggcggggtaacggcccaccaaggcgacgatggctaggggttctgagaggaaggtcccccacattggaactgagacacggtccagactcctacgggaggcagcagtgaggaatattggtcaatggccgagaggctgaaccagccatgccgcgtgcgggaggacggccctatgggttgtaaaccgcttttgttggggagcaataatcgctacgtgtagcgagacgagagtacccagcgaataagcatc

SEQ ID NO: 2859 - DNA, 490 bp, Unknown
  Ascusbbf_13340, encodes 16S rRNA
agagtttgatcatggctcaggacgaacgctggcggcatgcctaacacatgcaagtcgaacggagttgaggagcttgctcttcaacttagtggcggacgggtgagtaacgcgtgagcaacctgcctttaagtggggaataatgtactgaaaaggacactaataccgcataatgtatataggccgcatgacctgtataccaaagatttatcgcttaaagatgggctcgcgtccgattagccagttggtggggtaacggcctaccaaagcgacgatcggtagccggactgagaggttgaacggccacattgggactgagacacggcccagactcctacgggaggcagcagtgggggatattgcgcaatgggggaaaccctgacgcagcaatgccgcgtgaaggatgaaggtcttcggattgtaaacttcttttgtcagggacgaaagatgacggtacctgacgaataagctccggctaactacgtgccagcag

SEQ ID NO: 2860 - DNA, 490 bp, Unknown
  Ascusbbf_11815, encodes 16S rRNA
agagtttgatcatggctcaggatgaacgctggcggcgtgcctaatacatgcaagtcgaacggagaaaatgagtagcttgctacgagttttcttagtggcggacgggtgagtaacgcatgaacaatctacctacgagagggggataacacttagaaataggtgctaataccgcataagaccacaacccggcatcgggaaggggtaaaaggagaaatccgcttgtagatgagtttgtgtatcattagatagttggtggggtaacggcctaccaagtcgacgatggttagccggcctgagagggtgaacggccacactggaactgagatacggtccagactcctacgggaggcagcagtaaggaatattgggcaatgagcgaaagcttgacccagcaacgccgcgtgaaggaagaaggttctcggattgtaaacttctaaaattggggaaaaagaaagtgatggtacccaaagataagtcacggcaaactatg

SEQ ID NO: 2861 - DNA, 490 bp, Unknown
  Ascusbbf_36875, encodes 16S rRNA
agagtttgatcatggctcaggacgaacgctggcggcatgcctaacacatgcaagtcgaacggagttggaaggagcttgctcttttcaacttagtggcggacgggtgagtaacgcgtgagcaacctgcctttcagtggggaataatgttttgaaaagaacactaataccgcataatgtattgaaaccgcatgattttgataccaaaggatttattcgctgagagatgggctcgcgtccgattagccagttggtggggtaacggcctaccaaagcgacgatcggtagccggactgagaggttgaacggccacattgggactgagacacggcccagactcctacgggaggcagcagtgggggatattgcgcaatgggggaaaccctgacgcagcaatgccgcgtgaaggatgaaggttttcggattgtaaacttcttttgtcagggacgaaaactgacggtacctgacgaataagctccggctaactacgtgc

SEQ ID NO: 2862 - DNA, 490 bp, Unknown
  Ascusbbf_13589, encodes 16S rRNA
agagtttgatcatggctcaggacgaacgctggcggcgcgcctaacacatgcaagtcgaacggagcgtaattttgaattcttcggaaggattaattattgcttagtggcggacgggtgagtaacacgtgagcaatctgccttacagatggggacaacgtttagaaatggacgctaatacccaatgaaatatgggttccgcatggagtttatatcaaagggattcgcaagaatttgctgtaagatgagctcgcgtctgattatgatagttggcggggtaatggcccaccaagtctacgatcagtagccgaactgagaggttgatcggccacattgggactgagacacggcccagactcctacgggaggcagcagtgagggatattgcacaatgggggaaaccctgatgcagcgacgtcgcgtgagggaagaaggtttttggattgtaaacctctgtctttggagaagataatgacggtatccaaagaggaag

SEQ ID NO: 2863 - DNA, 490 bp, Unknown
  Ascusbbf_16561, encodes 16S rRNA
agagtttgatcatggctcaggacgaacgctggcggcatgcctaacacatgcaagtcgaacggagttaagagagcttgctttcttaacttagtggcggacgggtgagtaacgcgtgagcaacctgcctctcagtggggaataatgttctgaaaagagcactaataccgcataacatatatttgtcgcatggcagatatatcaaagatttatcgctgagagatgggctcgcgtccgattagccagttggtggggtaacggcctaccaaagctacgatcggtagccggactgagaggttgaacggccacattgggactgagacacggcccagactcctacgggaggcagcagtgggggatattgcgcaatgggggaaaccctgacgcagcaatgccgcgtgaaggatgaaggtcttcggattgtaaacttcttttgtcagggacgaaaatgacggtacctgacgaataagctccggctaactacgtgccagca

SEQ ID NO: 2864 - DNA, 490 bp, Unknown
  Ascusbbf_62769, encodes 16S rRNA
agagtttgatcatggctcaggatgaacgctggcggcgtgcctaacacatgcaagtcgagcggagataagttgaagcctagcgattcttatcttagcggcggatgggtgagtaacacgtgggtaacctgccctgtactggggaataacagctggaaacggctgttaatgccgcatatgcgcacggagccgcatgactccgggcggaaagatttatcggtacaggatgggcccgcgccggattaactagttggcggggtaacggcccaccaaggtgatgatccgtagccgacctgagagggtgaccggccacattgggactgagacacggcccaaactcctacgggaggcagcagtgggggatattgcacaatgggggaaaccctgatgcagcgacgccgcgtgaaggatgacgtatttcggtatgtaaacttctatcagcggggaagaagatgacggtacccgactaagaagccccggctaactacgtgcc

SEQ ID NO: 2865 - DNA, 490 bp, Unknown
  Ascusbbf_64076, encodes 16S rRNA
agagtttgatcatggctcaggacgaacgctggcggcgtgcctaacacatgcaagtcgagcggggatgtccggaacgaagcttcggcggagggaaggacattcgagcggcggacgggtgagtaacgcgtgagcaatctgtccctgacagggggataacacttggaaacaggtgctaataccgcataagaccacgagacgacatcgtcttggggtaaaaggagagatccggtgaggggtgagctcgcgtccgattagctggttggtgaggtaacggcccaccaaggcgacgatcggtagccgacctgagagggtgatcggccacattggaactgagacacggtccaaactcctacgggaggcagcagtgggaatattgggcaatgggcgaaagcctgacccagcaacgccgcgtgagggaagaaggttttcggattgtaaacctctgtccttggtgacgaaggaagtgacggtagccaaggaggaagccccg

SEQ ID NO: 2866 - DNA, 490 bp, Unknown
  Ascusbbf_28044, encodes 16S rRNA
agagtttgatcatggctcaggacgaacgctggcggcatgcctaacacatgcaagtcgaacgaagttaagaagcttgctttttaacttagtggcggacgggtgagtaacgcgtgagcaacctgcctctaagtggggaataatgtactgaaaaggacactaataccgcataacatattggaagcgcatgattctgatatcaaagatttatcgcttagagatgggctcgcgtccgattagctagttggagaggtaacggctccccaaggcgacgatcggtagccggactgagaggttgaacggccacattgggactgagacacggcccagactcctacgggaggcagcagtgggggatattgcgcaatgggggaaaccctgacgcagcaatgccgcgtgaaggacgaaggtcttcggattgtaaacttcttttgtcagggacgaaaatgacggtacctgacgaataagctccggctaactacgtgccagcagc

SEQ ID NO: 2867 - DNA, 490 bp, Unknown
  Ascusbbf_53766, encodes 16S rRNA
agagtttgatcatggctcaggatgaacgctggcggcgtgcttaacacatgcaagtcgaacgaagcactgggagcggatcttttcggagagaagcgacctttgactgagtggcggacgggtgagtaacgcgtgggcaacctgcccttgaccgggggacaacagccggaaacagctgctaataccgcataagcgcacaggatcgcatggtccggtgtgaaaaactccggtggtcaaggatgggcccgcgttggattaggtagttggtgcggtaacggcgcaccaagccgacgatccatagccgacctgagagggtgaccggccacattgggactgagacacggcccagactcctacgggaggcagcagtggggaatattgcacaatgggggaaaccctgatgcagcgacgccgcgtgagtgaagaagtatttcggtatgtaaagctctatcagcagggaagaaaatgacggtacctgcacaagaagccccgg

SEQ ID NO: 2868 - DNA, 490 bp, Unknown
  Ascusbbf_97123, encodes 16S rRNA
agagtttgatcctggctcaggatgaacgctagcggcaggcctaatacatgcaagtcggacgggatctaaatctaagcttgcttagatttagtgagagtggcgcacgggtgcgtaacgcgtgagcaacctacccatatcagggggatagcccggagaaatccggattaacaccgcatgacacaacgactcggcatcgagatgttgttaaatatttataggatatggatgggctcgcgtgacattagctagttggtaaggtaacggcttaccaaggctacgatgtctaggggctctgagaggagaatcccccacactggtactgagacacggaccagactcctacgggaggcagcagtaaggaatattggtcaatggagggaactctgaaccagccatgccgcgtgcaggatgactgccctatgggttgtaaactgcttttgtccaggaataaccaccactacgtgtagtggcttgaatgtactggaagaat

SEQ ID NO: 2869 - DNA, 490 bp, Unknown
  Ascusbbf_26798, encodes 16S rRNA
agagtttgatcatggctcaggatgaacgctagcggcaggcttaacacatgcaagtcgaggggtaacggggcgtagcaatacgctgccgacgaccggcgcacgggtgcgtaacgcgtatgcaacctacctgtaacagggggataacgggatgaaaatcccactaataccccatatagttagagattcgcatgtttctctaacgaaagcttcggtggttacggatgggcatgcgtgacattagctagttggcggggcaacggcccaccaaggcgacgatgtctaggggagctgagaggcttatcccccacactggtactgagacacggaccagactcctacgggaggcagcagtgaggaatattggtcaatggacggaagtctgaaccagccatgccgcgtggaggaagaaggtcctatgggttgtaaactccttttacgccggagtaataagagccttgcgaggctcgatgagagtacggcgggaataagc

SEQ ID NO: 2870 - DNA, 490 bp, Unknown
  Ascusbbf_41277, encodes 16S rRNA
agagtttgatcatggctcaggacgaacgctggcggcgtgcctaacacatgcaagtcgaacgggcttaaggagcttgctccttaagttagtggcggacgggtgagtaacgcgtgagcaacctgcctttcagagggggataacgtttggaaacgaacgctaataccgcataacgtgcgaaagtcgcatggcttttgtaccaaaggagtaacatccgctgaaagatgggctcgcgtccgattagacagttggcggggtaacggcccaccaaatctacgatcggtagccggactgagaggttgaacggccacattgggactgagacacggcccagactcctgcgggaggcagcagtgagggatattgcacaatgggcgcaagcctgatgcagcaacgccgcgtgaaggaagacggttttcggattgtaaacttctgttcttggtgaagataatgactttagccaaggagaaagccacggctaactacgtgccag

SEQ ID NO: 2871 - DNA, 490 bp, Unknown
  Ascusbbf_69525, encodes 16S rRNA
agagtttgatcatggctcaggacgaacgctggcggcgtgcctaacacatgcaagtcgaacggagatactcctaattgagatttcggttgagagagggaatatcttagtggcggacgggtgagtaacgcgtgagtaacctgcccataagagggggataacgttctgaaaaggacgctaataccgcataacatatatttttcgcatgaaaggtatatcaaaggaggaatccgcttatggatggactcgcgtccgattagctagttggcgggataacagcccaccaaggcgacgatcggtagccggactgagaggttgaacggccacattgggactgagacacggcccagactcctacgggaggcagcagtgggggatattgcgcaatgggggaaaccctgacgcagcaacgccgcgtgaatgacgaaggtcttcggattgtaaagttcttttgttgaggaagaaaaatgacggtactcaacgaataagctcc

SEQ ID NO: 2872 - DNA, 490 bp, Unknown
  Ascusbbf_149345, encodes 16S rRNA
agagtttgatcatggctcaggatgaacgctggcggcgtgcctaacacatgcaagtcgagcggagatatagagagattcttcggatactttctttatcttagcggcggatgggtgagtaacacgtgggtaacctgccctgcacagggggataacagctggaaacggctgttaataccgcatatgcacacgctgccgcatggcagagggtggaaagatttatcggtgcaggatgggcccgcgtcggattaactagttggcagggtaacggcctaccaaggttatgatccgtagccgacctgagagggtgaccggccacattgggactgagacacggcccaaactcctacgggaggcagcagtgggggatattgcacaatgggcggaagcctgatgcagcgacgccgcgtgaaggaagaagtatttcggtatgtaaacttctatcagcggggaagaagatgacggtacccgactaagaagccccggctaacta

SEQ ID NO: 2873 - DNA, 490 bp, Unknown
  Ascusbbf_119024, encodes 16S rRNA
agagtttgatcatggctcagagcgaacgttagcggcgggcttaacacatgcaagtcgaacgcgaaagtccttcgggatgagtagagtggcgcacgggtgagtaacacgtaggcaatcttccctcgagtgggggacaactacccgaaagggtagctaataccgcataagaccacggcggctccggccgctgcgggaaaagctggcctctacttgtaagctagcgcttgaggatgaacctgcgcaccatcagctagttggtggggtaatggcccaccaaggcgaagacggttagctggtctgagaggatgatcagccacactggcactgaaacacgggccagactcctacgggaggcagcagtggggaatattggacaatgggcgcaagcctgatccagctacgccgcgtgagtgatgaaggccttcgggttgtaaagctctgtggggagggacgaaaaaggtggggactaataagcctcgcccttgacggt

SEQ ID NO: 2874 - DNA, 490 bp, Unknown
  Ascusbbf_54410, encodes 16S rRNA
agagtttgatcatggctcaggatgaacgctggcggcgtgcttaacacatgcaagtcgaacggagtcacatgaaacctagtgattgtgacttagtggcggacgggtgagtaacgcgtgggtaacctgccgtatgcagggggacaacagagggaaacttctgctaataccgcataagcgcacgggatcgcatgatccagtgtgaaaagatttatcggcatacgatggacccgcgtccgattagctagttggtgaggtaacggcccaccaaggcgacgatcggtagccggcctgagagggtgaacggccacattgggactgagacacggcccaaactcctacgggaggcagcagtggggaatattgcacaatgggggaaaccctgatgcagcgacgccgcgtgagtgatgaagtatttcggtacgtaaagctctatcagcaggaaagaaaatgacggtacctgactaagaagccccggctaactacgtgccag

SEQ ID NO: 2875 - DNA, 490 bp, Unknown
  Ascusbbf_143589, encodes 16S rRNA
agagtttgatcatggctcaggatgaacgctggcggcgtgcttaacacatgcaagtcgaacgaggttcatttttacgatccccttcgggggtgacgagtttgaaccgagtggcggacgggtgagtaacgcgtgggtaacctgccccatacagggggataacagttggaaacgactgacaataccgcataagcgcacagggaggcatcttctggtgtgaaaaattccggtggtatgggatgggcccgcgtctgattagctagttggcagggtaacggcctaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgatgaagtatttcggtatgtaaagctctatcagcagggaagaaaaatgacggtacctgactaagaagccccg

SEQ ID NO: 2876 - DNA, 490 bp, Unknown
  Ascusbbf_215642, encodes 16S rRNA
agagtttgatcatggctcaggacgaacgctggcggcgtgcctaacacatgcaagtcgaacggagatattgcagatgaagatttcggttggattcagtaatattttagtggcggacgggtgagtaacgcgtgagtaacctgccgatgagagtggaataacgttctgaaaagaacgctaataccgcataacatatatttgccgcatgacagatatatcaaagattttatcgctcattgatggactcgcgtccgattagccagttggcggggtaacggcccaccaaagcgacgatcggtagccggactgagaggttgaacggccacattgggactgagacacggcccagactcctacgggaggcagcagtgggggatattgcgcaatgggggaaaccctgacgcagcaacgccgcgtgaaggaagacggttttcggattgtaaacttcttttgttaaggacgaagaaagtgacggtacttaacgaataagctc

SEQ ID NO: 2877 - DNA, 490 bp, Unknown
  Ascusbbf_73346, encodes 16S rRNA
agagtttgatcatggctcaggatgaacgctggcggcgtgcttaacacattcaagtcgtacggacaaaaggacttcggtcctcgagttagtggcggacgggtgagtaacgcgtgagcaatctgccttcgagtgtggaataacagacggaaacggctgctaataccgcataacgtatatttgccgcatgacagatataccaaagatttatcgctcgaagatgagctcgcgtcccattagacagttggtgaggtaacggcccaccaaatctacgatgggtagccggactgagaggtcgaacggccacattggaactgagaaacggtccagactcctacgggaggcagcagtggggaatattgggcaatgggcgaaagcctgacccagcgacgccgcgtgaaggaagaaggtcttcggattgtaaactttagtcgacagggaagaaacaaatgacggtacctgtagaggaagccacgactaactacgtgccagc

SEQ ID NO: 2878 - DNA, 490 bp, Unknown
  Ascusbbf_83395, encodes 16S rRNA
agagtttgatcatggctcaggatgaacgctggcggcgtgcctaacacatgcaagtcgaacgggcttcatagtgacagagacttcggttgaaggaattatgaagttagtggcggacgggtgagtaacgcgtggagaacctgccctgtacagggggataacacctggaaacaggtgctaaaaccgcataagcgcacggtaccgcatggtacagtgtgaaaaactccggtggtacaggatggctccgcgttggattagccagttggcggggtaacggcccaccaaagcgacgatccatagccggcctgagagggtggacggccacattgggactgagacacggcccagactcctacgggaggcagcagtggggaatattgcacaatggggggaaccctgatgcagcgacgccgcgtgaaggaagaagtatctcggtatgtaaacttctatcagcagggaagaagatgacggtacctgcagaagaagccccggc

SEQ ID NO: 2879 - DNA, 490 bp, Unknown
  Ascusbbf_848570, encodes 16S rRNA
agatttgatcatggctcaggatgaacgctggcggcgcgcctaacacatgcaagtcgaacgaagcactttaccggatcccttcggggtgaaagttttgtgacttagtggcggacgggtgagtaacgcgtggggaacctgccctgtacagggggataacagttagaaatgactgctaataccgcataagcgcacactgaggcatctcagagtgtgaaaagccgagacggtacaggagggccccgcgtctgattagctggttggtggggtaacggcctaccaaggcgacgatcagtagccgaactgagaggttgatcggccacattgggactgagacacggcccagactcctacgggaggcagcagtgggggattttgcacaatggggggaaccctgatgcagcgacgccgcgtgagtgaagaagtatttcgatacgtaaagctctatcagcagggaagaaaatgacggtacctgactaagaagccccggcta

SEQ ID NO: 2880 - DNA, 490 bp, Unknown
  Ascusbbf_84919, encodes 16S rRNA
agagtttgatcatggctcaggatgaacgctggcggcgtgcctaatacatgcaagtcgaacgagagtgcttgcactcgagtggcgaacgggtgagtaacacgtaggtaacctgcctcacagtttgggatacccagaggaaactttggctaataccggataattggttggaaggcatcttccgactctaaaaggggcctttaaagcctcgctgagagatggacctgcggcgcattagctagttggtgagataacagcccaccaaggcgaggatgcgtagccgacctgagagggtgaacggccacactggaactgagacacggtccagactcctacgggaggcagcagtagggagttttcggcaatgggggaaaccctgaccgagcaacgccgcgtgagtgatgaaggtcttcggattgtaaagctctgttgtaggggaagaacgatatgatgaggaaatgcttcatatttgacggtaccttattagaaagcc

SEQ ID NO: 2881 - DNA, 490 bp, Unknown
  Ascusbbf_85253, encodes 16S rRNA
agagtttgatcatggctcaggatgaacgctggcggcgtgcttaacacatgcaagtcgaacgaatttctttcagaacgcggcttcggccaagggacggaagaagtgagtggcggacgggtgagtaacgcgtgggtaacctgcctcacattgggggataccagtcggaaacgactgctaataccgcataagaccacggcaccgcatggtgctgaggccaaaactccggtgatgtgagatggacccgcgtctgattaggcagttggcggggtaacggcccaccaaaccgacgatcagtagccgacctgagagggtgatcggccacattgggactgagacacggcccaaactcctacgggaggcagcagtggggaatattgcacaatgggggaaaccctgatgcagcgacgccgcgtgagtgatgaagtatttcggtacgtaaagctctatcagcaggaacgataatgacggtacctgactaagaagcaccggc

SEQ ID NO: 2882 - DNA, 490 bp, Unknown
  Ascusbbf_258446, encodes 16S rRNA
agagtttgatcctggctcaggacgaacgctggcggcacgcttaacacatgcaagtcgaacggtgaagtaacttcggttatggatcagtggcggacgggtgagtaacacgtgagcaatctgcctttaagtggggaataacgattggaaacgatcggtaataccgcataatatatcattttcgcatgagagagatatcaaagatttatcgcttaaagatgagctcgcgtctgattagatagttggtgaggtaacggctcaccaagtcgacgatcagtagccggactgagaggttgaacggccacattgggactgagacacggcccagactcctacgggaggcagcagtggggaatattgcacaatggaggaaactctgatgcagcgatgccgcgtgagggaagaaggttttcggattgtaaacctctgttgacagggacgataatgacggtacctgttcagaaagctccggctaactacgtgccagcagccg

SEQ ID NO: 2883 - DNA, 490 bp, Unknown
  Ascusbbf_100836, encodes 16S rRNA
agagtttgatcatggctcaggatgaacgctggcggcgtgcataacacattcaagtcgaacggagttttgcaggaaagaggcttcggccaatggagagcaagacttagtggcggacgggtgagtaacgcgtgagcaacctgcctatacgagggggacaacagttggaaacgactgctaataccgcataaaatatattaagggcatccttgatatatcaaagagatatcgcgtatagatgggctcgcgtccgattagatagttggtgaggtaacggcccaccaagtcaacgatcggtagccggactgagaggttgaacggccacattggaactgagagacggtccagactcctacgggaggcagcagtggggaatattgggcaatgggcgaaagcctgacccagcgacgccgcgtgagtgaagaaggtcttcggattgtaaagcttagttatcggggaagaaggaagtgacggtacccgaagagaaagccac

SEQ ID NO: 2884 - DNA, 490 bp, Unknown
  Ascusbbf_161416, encodes 16S rRNA
agagtttgatcatggctcagaacgaacgctggcggcgcgtcttaagcatgcaagtcgaacggcaaggcaggagcttgctcctgccctagagtggcggactggtgagtaacgcgtagatgacgaaccctttggacggggatagccgttagaaataacgggtaataccggatacggtcggttatgttagaggtaaccgaggaaagagagctacggctctgccggaggatcggtctgcgacccatcagctagttggcggggtaaaggcccaccaaggcgatgacgggtatccggcctaagagggtgaacggacacattgggactgagatacggcccagactcctacgggaggcagcagctaagaatattccgcaatgggcgaaagcctgacggagcgacgccgcgtggacgatgaaggccggaaggttgtaaagtcctttagtctgtgaggaataagcggtggagggaatgccactgcggtgactgtagcaga

SEQ ID NO: 2885 - DNA, 490 bp, Unknown
  Ascusbbf_131633, encodes 16S rRNA
agagtttgatcatggctcaggataaacgctggcggcgcgcataacacatgcaagtcgagcgaggggagtgacttcggtcatgagcctagcggcggacgggtgagtacaatatgaacaacctgccttacagagggggatagccagaagaaattctgattaataccgcatatactgagattgtcacatggtgatttcaggaaagcctgaaggggcgctgtaagaggggtttgtatccgattagctagttggagtggtaacggcacaccaaggcgacgatcggtagctgattcgagaggatagacagccacattgggactgagatacggcccagactcctacgggaggcagcagtggggaatattgcgcaatggagggaactctgacgcagcgacgccgtgtaaaggatgaaggccttcgggttgtaaacttatatcgattatgaaaagataggatggtaataaagtaagaagccccggctaactacgtgcca

SEQ ID NO: 2886 - DNA, 468 bp, Unknown
  Ascusbbf_99843, encodes 16S rRNA
agagtttgatcctggctcagaacgaacgctggcggcaggcctaacacatgcaagtcggacgctccgcaaggggcgtggcagacgggtgagtaacgcgtgggaacgtacccttcggttcggaataacccagggaaacttgggataataccggatacgtccgcaaggagaaagatttatcgccgaaggatcggcccgcgttggattagctagttggcggggtaatggcccaccaaggcgacgatccatagctggtctgagaggatgatcagccacactgggactgagacacggcccagactcctacgggaggcagcagtggggaatattggacaatgggcgaaagcctgatccagccatgccgcgtgagtgatgacggccttagggttgtaaagctctttcagcggggaagataatgacggtacccgcagaagaagccccggctaacttcgtgccagcagccgcggtaat

SEQ ID NO: 2887 - DNA, 490 bp, Unknown
  Ascusbbf_328725, encodes 16S rRNA
agagtttgatcatggctcaggacgaacgctggcggcgtgcctaatacatgcaagtcgagcgaatgacgagaagcttgcttctctgatttagcggcggacgggtgagtaacacgtgggcaacctgccctgtagactgggataacttcgggaaaccggagctaataccggataattcttttagcctcatggctttaagctaaaaggcgcttcggcgtcactacaggatgggcccgcggtgcattagctagttggtggggtaacggcctaccaaggcaacgatgcatagccgacctgagagggtgatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaacaagtgcgttaggtaatgaacgcaccttgacggtaccttat

SEQ ID NO: 2888 - DNA, 490 bp, Unknown
  Ascusbbf_430086, encodes 16S rRNA
agagtttgatcatggctcagaacgaacgctggcggcaggcctaacacatgcaagtcgagcgtgaaaggggcttcggccctgagtaaagcggcgcacgggtgagtaacacgtgaataatctgccctttggaccgggataacagaccgaaaggactgctaataccggataagcttccgcgccaaccgggcgagtggagaaaaggatgggtctttcgggaccatttaccagaggatgagttcgcgtcccattagatagttggtgaggtaatggctcaccaagtcaacgatgggtagctggtctaagaggatgatcagccacactggaactgagacacggtccagactcctacgggaggcagcagtggggaatcttgcgcaatggaggaaactctgacgcagccatgccgcgtgagtgatgaaggccctcgggttgtaaagctctgtctaaggggaaaaatggcattggatccaacaggtccgatgattgatgg

SEQ ID NO: 2889 - DNA, 490 bp, Unknown
  Ascusbbf_138883, encodes 16S rRNA
agagtttgatcatggctcagattgaacgctggcggcaggcttaacacatgcaagtcgaacggtaacaggaagaagcttgcttctttgctgacgagtggcggacgggtgagtaatgcttgggaatctggcttatggagggggataactactggaaacggtagctaataccgcgtaatgtctacggactaaagggtgggactttcgggccacctgccataagatgagcccaagtgagattaggtagttggtgaggtaatggctcaccaagccgtcgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtagcgaggaaggtggttgttttaatagaacaatcaattgacgttaactacagaag

SEQ ID NO: 2890 - DNA, 490 bp, Unknown
  Ascusbbf_1583374, encodes 16S rRNA
agagtttgatcctggctcagagcgaacgctggcggcatgcttaacacatgcaagtcgcacgaaggtttcggccttagtggcggacgggtgagtaacgcgtaggtatctatccatgggtgggggataacactgggaaactggtgctaataccgcatgacacctgagggtcaaaggcgcaagtcgcctgtggaggagcctgcgtttgattagctagttggtggggtaaaggcctaccaaggcgatgatcaatagctggtttgagaggatgatcagccacactgggactgagacacggcccagactcctacgggaggcagcagtgaggaatattggtcaatgggcgagagcctgaaccagccaagtagcgtgcaggatgacggccctatgggttgtaaactgcttttgtacgggaataaagtgagggacgtgtccctttttgtatgtaccgtaagaatagggaccggctaattccgtgccagcagccgcggta

SEQ ID NO: 2891 - DNA, 490 bp, Unknown
  Ascusbbf_65824, encodes 16S rRNA
agagtttgatcatggctcaggatgaacgctggcggcgtgcataacacattcaagtcgaacggacgagggtgcttcggtacccgagttagtggcggacgggtgagtaacgcgtgagcaacctgcccctgtatgtgggataacgtccggaaacggacgctaataccgcatgaatcaacgggaccgcatgattctgttgacaaagatttatcgtacagggatgggctcgcgtccgattagatagttggcggtgcaacggaccaccaagtcaacgatcggtagccggactgagaggttgaacggccacattggaactgagaaacggtccagactcctacgggaggcagcagtggggaatattgggcaatgggcgaaagcctgacccagcgacgccgcgtgaaggaagacggtcttcggattgtaaacttcttttatgtaggacgaagaaatgacggtactacaagaataagccacggctaactacgtgccagca

SEQ ID NO: 2892 - DNA, 490 bp, Unknown
  Ascusbbf_196419, encodes 16S rRNA
agagtttgatcctggctcaggacgaacgctggcggcgtgcctaatacatgcaagtagaacgctgagcactttagcttgctagagtgtgatgagttgcgaacgggtgagtaacgcgtaggtaacctgcctggtagcgggggataactattggaaacgatagctaataccgcataacagcttttctcgcatgagaggagtttgaaaggtgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaattctagtgagagtggaaagttcactagttgacggtagct

SEQ ID NO: 2893 - DNA, 490 bp, Unknown
  Ascusbbf_184497, encodes 16S rRNA
agagtttgatcatggctcaggacgaacgctggcggcgtgcttaacacatgcaagtcgagcggaaaggcccttcggggtactcgagcggcgaacgggtgagtaacacgtgagcaacctgtccttgacttcgggataagcctgggaaaccgggtctaataccggataggacctgccttcgcatgggggtgggtggaaagttttttcggtcaggggtgggctcgcggcctatcagcttgttggtggggtagtggcctaccaaggcttcgacgggtagccggcctgagagggcgaccggccacactgggactgagacacggcccagactcctacgggaggcagcagtggggaatattgcgcaatgggcggaagcctgacgcagcgacgccgcgtgggggatgacggccttcgggttgtaaacctctttcggcagggacgaagttgacgtgtacctgcagaagaagcgccggctaactacgtgccagcagccgcg

SEQ ID NO: 2894 - DNA, 490 bp, Unknown
  Ascusbbf_259603, encodes 16S rRNA
agagtttgatcatggctcaggatgaacgctagcggcaggcttaacacatgcaagtcgaggggcagcgcggtgtagcaatacactggcggcgaccggcgaaagggtgcgtaacgcgtgaacaatctgcccgtatccgggacataagcgatggaaacgtcgtctaatttcccataacaacaggagccgcatgacttttgtttgaaagatccgtcggatacggatgagttcgcgagacattagctagtcggcgtggtaacggcacaccgaggcgacgatgtctaggggttctgagaggaaggtcccccacactggaactgagacacggtccagactcctacgggaggcagcagtgaggaatattggtcaatgggcgcaagcctgaaccagccatgccgcgtgaaggatgacggccctatgggttgtaaacttcttttgtggtggagcaataagacgtacgcgtacgtcgatgagagtacatcacgaataagca

SEQ ID NO: 2895 - DNA, 490 bp, Unknown
  Ascusbbf_717289, encodes 16S rRNA
agagtttgatcatggctcagattgaacgctggcggcatgcctaacacatgcaagtcgaacgatgattaagagcttgctcttaagattagtggcggacgggtgagtaatgtatagggatctgcctgttagtgggggacaacagccggaaacggctgctaataccgcatacgctctacggaggaaagtgggggaccctcgggcctcacgctaacagatgaacctatatcagattagctagttggtggggtaagagcctaccaaggcgacgatctgtagctggtttgagagaatgatcagccacactgggactgagacacggcccagactcctacgggaggcagcagtggggaatattggacaatgggcgcaagcctgatccagcaatgccgcgtgtgtgaagaaggccttcgggttgtaaagcactttaagttgggaggaaaagcttggggttaatagccttaagtgttgacgttaccaacagaataagcac

SEQ ID NO: 2896 - DNA, 490 bp, Unknown
  Ascusbbf_266218, encodes 16S rRNA
agagtttgatcctggctcaggatgaacgctagcggcaggcttaacacatgcaagtcgaggggcagcgcggggtagcaatactctggcggcgaccggcgaaagggtgagtaacgcgtgagcaacgtgcccgtatgtgggggatagtcattagaaatgatgcgtaataccccgtaacacatggatccgcatggttccatgttgaaagatttattgcatacggatcggctcgcgtgccattagctggatggcggggtaacggcccaccatggcgacgatggctaggggttctgagaggaaggtcccccacattggaactgagacacggtccagactcctacgggaggcagcagtgaggaatattggacaatggccggaaggctgatccagccatgccgcgtgcgggaagacggccctatgggttgtaaaccgcttttgcgggggagcaataaggtgcacgcgtgcaccgatgagagtaccctgcgaataagca

SEQ ID NO: 2897 - DNA, 490 bp, Unknown
  Ascusbbf_687180, encodes 16S rRNA
agagtttgatcatggctcagagcgaacgttagcggcgcgcctaacacatgcaagtcgcacgcgaaagggggcaaccctgagtaaagtggcgcacgggtgcgtaacacgtagataacctgccctttgaagggggataacgttccgaaaggagcgctaataccgcataaggctgcggctgctacggcagcagcagacaaaggctgggaccggcaacggccagccgtcagaggaggggtctgcggcccatcagctagttggtgaggtaatggctcaccaaggcagagacgggtagctggtctgagaggatgatcagccacactggtactggaacacggaccagactcctacgggaggcagcagtggggaatcttggtcaatgggcgcaagcctgaaccagcgacgccgcgtgagtgatgaaggccttcgggttgtaaagctctgtggggagggacgaaagagcttagtcgaataggctaggtgttgacggtac

SEQ ID NO: 2898 - DNA, 490 bp, Unknown
  Ascusbbf_1481854, encodes 16S rRNA
agagtttgatcatggctcaggatgaacgctggcggcgtgcttaacacatgcaagtcgaacggagattactttttagcttgctattttgtaatctcagtggcggacgggtgagtaacgcgtgggtaacctgccttatccagggggataacagtgagaaattactgctaataccgcataagcgcacagtttcgcatgaaacagtgtgaaaagatttatcgggataagatggacccgcgtctgattagctagttggtgaggtaacagcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtg

SEQ ID NO: 2899 - DNA, 490 bp, Unknown
  Ascusbbf_1096326, encodes 16S rRNA
agagtttgatcatggctcaggatgaacgccggcggtgtgcctaatacatgcaagtcgaacgcactggcccaactgagatgacgtgcttgcactgatttgacgatggattaccagtgagtggcggacgggtgagtaacacgtaggcaacctgcccaagagcgggggataacatttggaaacaagtgctaataccgcataagattgatgaccacatggtcatcaatttaaagatggtttcggctatcactcttggatgggcctgcggtgcattagctagttggtaaggtaacggcttaccaaggcagtgatgcatagccgagttgagagactgatcggccacaatgggactgagacacggcccatactcctacgggaggcagcagtagggaatcttccacaatgggcgcaagcctgatggagcgacaccgcgtgagtgaagaagggtttcggctcgtaaagctctgttgttgaagaagaacgtgcgtgagag

SEQ ID NO: 2900 - DNA, 490 bp, Unknown
  Ascusbbf_165271, encodes 16S rRNA
agagtttgatcctggctcaggacgaacgctggcggcatgcctaacacatgcaagtcgaacggagttatttggattcgtctggataacttagtggcggacgggtgagtaacacgtgagcaacctgcccttcagagggggacaacagttggaaacgactgctaataccgcataacatatacttaaggcatcttgagtatatcaaagatttatcgctgagggatgggctcgcgtctgattagatagttggtgaggtaacggcccaccaagtctacgatcagtagccggactgagaggttgaacggccacattgggactgagatacggcccagactcctacgggaggcagcagtggggaatattggtcaatgggggcaaccctgaaccagcaatgccgcgtgaaggaagaaggccttcgggttgtaaacttctttgaccagggacgataatgacggtacctggaaaacaagccacggctaactacgtgccagca

SEQ ID NO: 2901 - DNA, 490 bp, Unknown
  Ascusbbf_204929, encodes 16S rRNA
agagtttgatcatggctcagaacgaacgctggcggcgcgtcttaagcatgcaagtcgaacgggattcaggggcttgcccctgatgagagtggcggactggtgagtaacacgtaggtgacatgccttttggttggggatagcctgtggaaacacagggtaataccgaataagaccgcggattctgatccgcggtgaaaggagctccggctccgccgatagattggcctgcggcccatcagctagtaggtgaggtaaaggcccacctaggcaatgacgggtatccggcctgagagggtgatcggacacattgggactgagatacggcccagactcctacgggaggcagcagctaagaatattccgcaatgggcgaaagcctgacggagcgacgccgcgtggatgatgaaggccgtgaggttgtaaaatccttttgtgagtgaggaataaacgccgcagggaatggcggcgcggtgactgtagctcacgaata

SEQ ID NO: 2902 - DNA, 490 bp, Unknown
  Ascusbbf_1760007, encodes 16S rRNA
agagtttgatcctggctcaggatgaacgctggcggcgtgcctaacacattcaagtcgaacggagaagtcccttcggggacggatcagtggcggacgggtgagtaacgcgtgagcaacctgccgtatagtgggggataacacagggaaacctgtgctaataccgcatgacacattgagaccgcatggtcatgatgtcaaggagaaattgctgtacgatgggctcgcgtatggttagacagttggcggggtaacggcccaccaaatcgacgatcattagccgaactgagaggttgaacggccacattggaactgagagacggtccagactcctacgggaggcagcagtggggaatattgggcaatgggcgaaagcctgacccagcgacgccgcgtgaggaaagaaggtcttcggattgtaaacctctttcagcagggaagaaggaagtgacggtacctgcagaagaagtcacggctaaccacgtgccagcag

SEQ ID NO: 2903 - DNA, 490 bp, Unknown
  Ascusbbf_126716, encodes 16S rRNA
agagtttgatcatggctcaggatgaacgctggcggcgtgcttaacacatgcaagtcgaacgagcggaggaccttcgggtccgaagcgagtggcggacgggtgagtaacgcgtgggtaacctgccttataccgggggataacagatggaaacgactgttaataccgcataagcccacagtgccgcatggtacagtgagaaaagttccggcgatataagatggacccgcgtctgattagttagttggtggggtaacggcctaccaagacgacgatcagtagccgacctgagagggtgatcggccacattgggactgagacacggcccaaactcctacgggaggcagcagtggggaatattgggcaatgggcgcaagcctgacccagcgacgccgcgtgagtgaagaagtatttcggtatgtaaagctctatcagcagggaagatcatgacggtacctgactaagaagcaccggctaaatacgtgccagcagc

SEQ ID NO: 2904 - DNA, 490 bp, Unknown
  Ascusbbf_138636, encodes 16S rRNA
agagtttgatcatggctcaggatgaacgctggcggcgtgcctaacacatgcaagtcgaacgggaactccaagatgagacttcggtggatttttggaaattctagtggcggacgggtgagtaacgcgtgggtaacctgcccttaagaggagaataacagtgagaaatcactgctaatacaccataagaaattttgtcgcatgacaagatttggaaagatttatcgcttaaggatggacccgcgtttgattagccagttggtagggtaacggcctaccaaagcaacgatcaatagccggcctgagagggtgaacggccacattggaactgagacacggtccaaactcctacgggaggcagcagtggggagtattgcacaatgggcgaaagcctgatgcagcaacgccgcgtgagtgaagaagtatttcggtatgtaaagctctatcgatggggaataaaatgaaggtacccaagtaagaagccccggctaac

SEQ ID NO: 2905 - DNA, 490 bp, Unknown
  Ascusbbf_141906, encodes 16S rRNA
agagtttgatcctggctcaggatgaacgctagcggcaggcctaatacatgcaagtcgaacggcatcgcgggtagcaatacctggcggcgagtggcggatgggtgcgtaacacgtatgcaacctacccattactgggaaatagctcgaagaaattcgaattaatgtcccataatatcttttagtggcatcacttttagattaaagatttatcggtaatggatgggcatgcgtttgattagctagttggtgaggtaatggctcaccaaggctacgatcaatagggggtctgagaggatggtcccccacactggtactgagatacggaccagactcctacgggaggcagcagtagggaatattgggcaatggaggcaactctgacccagccatgccgcgtgaaggatgaaggcgttctgcgttgtaaacttcttttatatgggaagaaacgactcttgcgagaggcattgacggtaccatatgaataagcacc

SEQ ID NO: 2906 - DNA, 490 bp, Unknown
  Ascusbbf_154120, encodes 16S rRNA
agagtttgatcatggctcaggacgaacgctggcggcgtgcctaacacatgcaagtcgaacgaagcactcggagcttgctttgagtgacttagtggcggacgggtgagtaatgcgtgagcaacctgccctgaagagggggacaacagttggaaacgactgctaataccgcataacgtatccggagggcatcctctggataccaaagatttatcgcttcaggatgggctcacgtctgattagctagttggtgaggtaacggcccaccaaggctgcgatcagtagccggactgagaggttgaacggccacattgggactgagatacggcccagactcctacgggaggcagcagtggggaatattaggcaatgggggcaaccctgacctagcaacgccgcgtgaaggaagaaggccttcgggttgtaaacttcttttatgagggacgaaggacgtgacggtacctcatgaataagccacggctaactacgtgcc

SEQ ID NO: 2907 - DNA, 490 bp, Unknown
  Ascusbbf_383091, encodes 16S rRNA
agagtttgatcatggctcaggatgaacgctagcggcaggcttaacacatgcaagtcgaggggcagcgtgggggtagcaatactcccgacggcgaccggcgcacgggtgagtaacgcgtatgcaacctttcccagacagggggatagcccagggaaacttggattaataccccgtaggccgtggggcggcatcgccctatggttaaagttccggcggtctggggtgggcatgcgtgccattaggcagttggtggggtaacggcccaccaaaccgacgatggctacggggtctaaaaggatggtcccgcacattggaactgagacacggtccaaactcctacgggaggcagcagtgaggaatattggtcaatggggggaaccctgaaccagccatgccgcgtggaggaagacggccctacgggttgtaaactcctttagcacgggaataaactcagtcacgtgtgactgattgaaggtaccgtgagaataag

SEQ ID NO: 2908 - DNA, 490 bp, Unknown
  Ascusbbf_708741, encodes 16S rRNA
agagtttgatccgggctcaggatgaacgctggcggcgtgcataacacattcaagtcgaacggtgaagttccttcgggaacggagcagtggcggacgggtgagtaacgcgtgagcaacctgccgtatagtgggggataacacagggaaacttgtgctaataccgcataacacattgaggtcgcatggctttgatgtcaaagatttattgctgtacgatgggctcgcgtatgattagacagttggtagggtaacggcctaccaaatcaacgatcattagccgaactgagaggttgaacggccacattggaactgagaaacggtccagactcctacgggaggcagcagtggggaatattgggcaatgggcgaaagcctgacccagcgacgccgcgtgagggaagaaggtcttcggattgtaaacctctttcagcagggaagaaggaagtgacggtacctgcagaagaagtcacggctaactacgtgccagcag

SEQ ID NO: 2909 - DNA, 490 bp, Unknown
  Ascusbbf_381162, encodes 16S rRNA
agagtttgatcatggctcaggacgaacgctggcggcgtgcctaatacatgcaagtcgagcgaacagataaggagcttgctcctttgacgttagcggcggacgggtgagtaacacgtgggtaacctgccctatagtttgggataactccgggaaaccggggctaataccgaataagtgatttcttcgcatgaagtgaatctggaaagacggtttcggctgtcgctataggatggacccgcggcgcattagctagttggtgaggtaacggctcaccaaggcaacgatgcgtagccgacctgagagggtgatcggccacactgggactgagacacggcccagactcctacgggaggcagcagtagggaatcttccacaatggacgaaagtctgatggagcaacgccgcgtgagtgaagaaggatttcggttcgtaaaactctgttgcaagggaagaacaagtagcgtagtaactggcgctaccttgacggtac

SEQ ID NO: 2910 - DNA, 490 bp, Unknown
  Ascusbbf_174095, encodes 16S rRNA
agagtttgatcatggctcagattgaacgctggcggcatgccttacacatgcaagtcgaacggcagcataggagcttgctcctgatggcgagtggcgaacgggtgagtaatatatcggaacgtgccctagagtgggggataactagtcgaaagattagctaataccgcatacgatctacggatgaaagtgggggatcgcaagacctcatgctcttggagtggccgatatctgattagctagttggtggggtaaaagctcaccaaggcgacgatcagtagctggtctgagaggacgaccagccacactggaactgagacacggtccagactcctacgggaggcagcagtggggaattttggacaatgggggcaaccctgatccagcaatgccgcgtgagtgaagaaggccttcgggttgtaaagctcttttgtcagggaagaaacggtgagggctaatatcccttgctaatgacggtacctgaagaataagc

SEQ ID NO: 2911 - DNA, 490 bp, Unknown
  Ascusbbf_220713, encodes 16S rRNA
agagtttgatcctggctcaggatgaacgctggcggcgtgcctaatacatgcaagtcgaacggggtggatgggagcttgctccttgatacctagtggcgaacgggtgagtaacacgtaggtaacctgcctttcagtttgggatacccagaggaaactttggctaataccggataactaatttggaggcatctccaaattctaaaaggggctctcaagcctcgctgattgatggacctgcggcgcattagctagttggtgagataatagcccaccaaggcgaggatgcgtagccgacctgagagggtgaacggccacactggaactgagacacggtccagactcctacgggaggcagcagtagggagttttcggcaatgggcgaaagcctgaccgagcaacgccgcgtgagtgatgaaggtcttcggattgtaaaactctgttgtaagggaagaacggtacggtgaggaaatgctccgtatttgacggtacc

SEQ ID NO: 2912 - DNA, 490 bp, Unknown
  Ascusbbf_447666, encodes 16S rRNA
agagtttgatcatggctcaggatgaacgctagcggcaggcttaacacatgcaagtcgaggggcagcgcgggtagcaatacctggcggcgaccggcgaaagggtgagtaacgcgtgagcaacgtgcccgtggttgggggatagtcattagaaatgatgcgtaataccccgtaacataaggagtcgcatgactttttattgaaagatttattgaccacggatcggctcgcgtaccattagctagatggcggggtaacggcccaccatggcgacgatggttaggggttctgagaggaaggtcccccacattggaactgagacacggtccagactcctacgggaggcagcagtgaggaatattggacaatggccggaaggctgatccagccatgccgcgtgcgggaggacggccctatgggttgtaaaccgcttttgcgagggagcaataaggtctacgtgtagaccgatgagagtaccttacgaataagcatc

SEQ ID NO: 2913 - DNA, 490 bp, Unknown
  Ascusbbf_445601, encodes 16S rRNA
agagtttgatcatggctcaggatgaacgctagcgacaggcctaacacatgcaagtcgaggggcagcgagaggtagcaatactttgtcggcgaccggcgcacgggtgagtaacgcgtatgcaacctggctacggctacgggatagccttgcgaaagtaagattaataccgtatgcgacgtttggggacatccccggatgttgaaagatttatcggcagtagatgggcatgcgtctgattaggtagttggcggggtaacggcccaccaagccgacgatcagtaggggttctgagaggaaggtcccccacattggaactgagacacggtccaaactcctacgggaggcagcagtgaggaatattggtcaatggacggaagtttgaaccagccaagtcgcgtgaaggaagacggttctatggattgtaaacttcttttgctcgagggtaaaggtcggtacgtgtaccgatttgcaagtatcgagtgaataagca

SEQ ID NO: 2914 - DNA, 490 bp, Unknown
  Ascusbbf_1222797, encodes 16S rRNA
agagtttgatcatggctcaggatgaacgctggcggcgtgcttaacacatgcaagtcgaacggaggacccatgacggagttttcggacaacagaatggaatccttagtggcggacgggtgagtaacgcgtgaggaacctgccttggagaggggaataacacagagaaatttgtgctaataccgcatgatacaattctatcgcatggtagtgattgtcaaagattttatcgctctgagatggcctcgcgtctgattagcttgttggcggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttatgagggacgaaacaaatgacggtacctcatgaataagctc

SEQ ID NO: 2915 - DNA, 490 bp, Unknown
  Ascusbbf_185918, encodes 16S rRNA
agagtttgatcatggctcaggacgaacgctggcggcgtgcttaaaacatgcaagtcgaacggacgagggtgagtacttgtacgaacccaagttagtggcggacgggtgagtaacgcgtgagcaatctgcctatcacagggggataacaactggaaacgggtgctaataccgcatatgaccacaacccgacatcgggaaggggtgaaaggagcgatccggtgatagatgagcttgcgtctcattagctagttggtgaggtaacggcccaccaaggcgacgatgagtagccgatctgagaggatgaacggccacattggaactgagagacggtccaaactcctacgggaggcagcagttaggaatattgggcaatggaggaaactctgacccagcaacgccgcgtgaaggaagaaggttttcggattgtaaacttctgatctgtggaaaaaagagagtgatggtaccacaggagcaagccacggctaactac

SEQ ID NO: 2916 - DNA, 490 bp, Unknown
  Ascusbbf_445691, encodes 16S rRNA
agagtttgatcatggctcagattgaacgctggcggcatgcctaacacatgcaagtcgaacgatgatttccagcttgctggaatgattagtggcggacgggtgagtaatgtatagggatctgcctgttagtgggggacaacagccggaaacggctgctaataccgcatacgctctacggaggaaagtgggggaccttcgggcctcacgctaacagatgaacctatatcagattagctagttggtggggtaagggcctaccaaggcgacgatctgtagctggtttgagagaatgatcagccacactgggactgagacacggcccagactcctacgggaggcagcagtggggaatattggacaatgggggcaaccctgatccagcaatgccgcgtgtgtgaagaaggccttcgggttgtaaagcactttaagttgggaggaaaagcttgttgttaatagcgataagtgttgacgttaccaacagaataagcac

SEQ ID NO: 2917 - DNA, 490 bp, Unknown
  Ascusbbf_1877186, encodes 16S rRNA
agagtttgatcatggctcaggatgaacgctggcggcatgcctaagacatgcaagtcgtacgaggttgcctgttgaaatttactgcttgcagcaaatggatatagatcacaacctagtggcgaaagggtgagtaacacgtgagttatctacctcagagactgggataactactggaaacggtagctaataccggatgatatatggaacgatacgttgttctatagtaaaaggtgcctttaaagcatcactttgagatgagcttgcgacgtattagctagttggtgaggtaatggcttaccaaggcgaagatgcgtagccgacctgagagggtgatcggccacactgggactgagacacggcccagactcctacgggagacagcagttagggatattcgtcaatgggggaaaccctgaacgagcaatgccgcgtgagtgatgacagttctatggattgtaaaactctgttgttagggacgaacgacctatat

SEQ ID NO: 2918 - DNA, 490 bp, Unknown
  Ascusbbf_432303, encodes 16S rRNA
agagtttgatcctggctcaggacgaacgctggcggcgtgcttaacacatgcaagtcgaacgagaatctatggaaagaggtttcgaccgatggaagtagaggaaagtggcggactggtgagtaacgcgtgagtaacctgcccttcagagggggacaacagttggaaacggctgctaataccgcatgatgcacgtttgtcgcatggcagacgtgtcaaagatttatcgctgaaggatgggctcgcgtctgattagctagttggtggggtaaaggctcaccaaggcgacgatcagtagccggactgagaggttgaccggccacattgggactgagatacggcccagactcctacgggaggcagcagtggggaatattgggcaatggacgaaagtctgacccagcaacgccgcgtgaaggaagaaggtcttcggattgtaaacttctttgacaggggaagagtggaagacggtaccctgaaaacaagccacggc

SEQ ID NO: 2919 - DNA, 490 bp, Unknown
  Ascusbbf_1839971, encodes 16S rRNA
agagtttgatcatggctcagaacgaacgctggcggcgcgtcttaagcatgcaagtcgggcgggattacggtgcttgcaccgtatgagagcggcggactggtgagtaacgcgtgggtgacgtacccccgtgaaggggatagctcctagaaataggaggtaataccggataatctgcagtgtgtcagaggcactgcaggaaaggagcttttgctccgcacggggagcggcccgcgtactattagctggttagtgaggtaacggcccaccaaggcgatgatagttacccggcctaagagggtggacgggcacattgggactgagatacggcccagactcctacgggaggcagcagctaagaatattccgcaatgggggaaaccctgacggagcgacgccgcgtggatgaagaaggccggaaggttgtaaaatccttttatgactgatgaataaggagtgtgagagaaacgcattctgatgacggtaggtcatg

SEQ ID NO: 2920 - DNA, 490 bp, Unknown
  Ascusbbf_486713, encodes 16S rRNA
agagtttgatcctggctcagaacgaacgccggcggcgcgtcttaagcatgcaagtcgggcgggattccagtgcttgcactggatgagagcggcggactggtgagtagcgcgtgggcgacgcgccccctgcaccgggacagccggcagaaatgccgggtgatacgggatgagctcccgccttgtggcgaggcgggaggaaagcggccacggccgcggcaggggagcggcccgcgtcccatcagctagtaggcggggcaagggcccacctaggctacgacgggtacccggactgagaggttggacgggcacattgggactgagatacggcccagactcctacgggaggcagcagctaagaatattccgcaatgggggaaaccctgacggagcgacgccgcgtggacgatggaggccggaaggttgtaaagtcctctggcgcccgaggaatttccgctgcagggaatggcagcggagtgactgtagggcgaga

SEQ ID NO: 2921 - DNA, 490 bp, Unknown
  Ascusbbf_283459, encodes 16S rRNA
agagtttgatcatggctcagaatgaacgttggcggcgtggattaggcatgcaagtcggacgcccctcgggggcgtggcgaaagggtgagtaaggcgacggcaaccaaccccgcggagggggacagccgggggaaacctcgggtaatcccccatgacgcctcggtgggggcatccccatcaggccaaaggtgcgagcccgccgcgggacgggccgttgtggtatcagctggatggtggggtcacggcccaccatggcgatgacgcctaccgggcgtgcgagcgtggcccggcacactgggactgagacactgcccagacacctacgggtggctgcagtcgagaatcttcggcaatgggcgacagcctgaccgagcgacgccgcgtggaggatgaaggccttcgggttgtaaactcctgtcgagggggaacaaggggcggtgaagagccgtccttgagtgatccctggaggaagcacgggctaagttcgtgc

SEQ ID NO: 2922 - DNA, 490 bp, Unknown
  Ascusbbf_284551, encodes 16S rRNA
agagtttgatcatggctcagaacgaacgctggcggcgcgcttaacacatgcaagtcgagcggtctgtagcaatacaggcagcggcgaacgggtgagtaacacgtgggtaatctgccctcgagtccgggataactcggcgaaagccgagctaataccggatgagctcacggtgcggcatcgcacagtgggaaaagtggcaacacgctcaaggatgagcccgcggcccatcagctagttggcggggtaatggcccaccaaggctacgacgggtagctggtctgagaggacgaccagtcacactggaactgagacacggtccagactcctacgggaggcagcagtggggaatcttgcgcaatgggcgaaagcctgacgcagcgacgccgcgtgtgcgatgaaggcccttgggtcgtaaagcactgtcgcgagggaagaaacctgacggtacctcgagaggaagcaccggctaactctgtgccagcagccgcgg

SEQ ID NO: 2923 - DNA, 490 bp, Unknown
  Ascusbbf_719555, encodes 16S rRNA
agagtttgatcatggctcagaatgaacgctggcggcatggattaggcatgcaagtcgaacgagaaagcgccctcgggcgcgagtaaagtggcggaagggtgagtagcacgtggggaacctgccccggggaccggaacaagcctgtgaaaacgggtctgaaaccggatggcgccccggcccgcatgggccggaggcgaaaaattcattgccccgggatggccccgcggcccattagctagttggcggggtagaggcccaccaaggccgcgacgggtaggtggtctgagaggatggtcacccacactgggactgagacactgcccagactcctgcgggaggctgcagtcgagaatcttccgcaatgggcgcaagcctgacggagcgatgccgcgtgagggaagtaggccttcgggtcgtgaacctctgtcggcggggacgaagcaagcgacggtacccgccaaggaagccacggctaaccacgtgccagcag

SEQ ID NO: 2924 - DNA, 490 bp, Unknown
  Ascusbbf_1814089, encodes 16S rRNA
agagtttgatcctggctcagaacgaacgctggcggcgcgtcttaagcatgcaagtcggacggcaggttgccttcgggcagccgagagtggcgaacgggtgagtaacacgtaagtgatctgccccgcagttggggatagcctgtggaaacacagggtaataccggatgagatgtcaatgactgaactatgacatgaaagtggctacggccacgctgggggacgagcttgcggctcattagctagttgggggtgtaacggaccaccaaggcgacgatgagtagccggcctgagagggtgaacggccacattgggactgagacacggcccagactcctgcgggaggcagcagctaagaatattccgcaatgggggaaaccctgacggagcgacgccgcgtgaacgatgaaggcagagatgttgtaaagttcttttatcactggagaataaggagggcagggaatggccctctgatgacgtcaggtgatgaata

SEQ ID NO: 2925 - DNA, 490 bp, Unknown
  Ascusbbf_1815872, encodes 16S rRNA
agagtttgatcctggctcaggatgaacgctagcggcaggcctaatacatgcaagtcgaacgggaggcgcccttcggggcgccgagagtggcggacgggtgcgcaacgcgtatgcaaccatcccccgacgggcgcacagccggtggaaacgccgggtaatgcgccatgcggccttacgggggcatccccgggaggcgaaagctccggcggtcggggacgggcatgcgtgccattagatagtcggcggggtgacggcccaccgagtcgacgatggctaggggatctgagaggacggtcccccacactggtactgagacacggaccagactcctgcgggaggcagcagtaagggatattgggcaatgggcgggagcctgacccagccatgccgcgtgagggaatgaggccctacgggtcgtgaacctcttttgttcggggacaacgactcccacgggatgggaggctgagggtaccgaaggaataagcgccgg

SEQ ID NO: 2926 - DNA, 490 bp, Unknown
  Ascusbbf_329536, encodes 16S rRNA
agagtttgatcctggctcaggatgaacgctagcggcaggcttaacacatgcaagtcgaggggcatcgcggggtagcaatactctggcggcgaccggcgaaagggtgagtaacgcgtgagcaacatacccgggagagggggatagtcattggaaacgatgcgtaataccccgtaacatatggtatcgcatggtattatattgagagatttattgattccggattggctcgcgtgccattaggtagttggcggggtaacggcccaccaagccgacgatggctaggggttctgagaggaaggtcccccacattggaactgagacacggtccagactcctacgggaggcagcagtgaggaatattggacaatggaaggaattctgatccagccatgccgcgtgcgggaggacggccctatgggttgtaaaccgcttttttgtgggagcaataaggtctacgagtagactgatgagagtaccatgagaataagca

SEQ ID NO: 2927 - DNA, 490 bp, Unknown
  Ascusbbf_209343, encodes 16S rRNA
agagtttgatcctggctcaggatgaacgctagcggcaggcttaacacatgcaagtcgaggggcagcgagggtagcaatacctgtcggcgaccggcggaagggtgcgtaacgcgtgagcaacatgcccgcggccgggggataagcattggaaacgatgtctaataccccatacgatgcgaggaggcatctccttgttttgaaagatttatcggcagcggattggttcgcgtgacattagctagtcggcggggtaacggcccaccgaggcgacgatgtctaggggttctgagaggaaggtcccccacactggaactgagacacggtccagactcctacgggaggcagcagtgaggaatattggtcaatgggcggaagcctgaaccagccatgccgcgtgaaggaataaggccctatgggtcgtaaacttcttttgacgcagagcaataagggtcacgtgtggtccgatgagagtatgcgtcgaataagcatc

SEQ ID NO: 2928 - DNA, 490 bp, Unknown
  Ascusbbf_1788486, encodes 16S rRNA
agagtttgatcatggctcagattgaacgctggcggcaggcctaacacatgcaagtcgagcgcgaaagttcttcggaatgagtaaagcggcggacgggtgagtaacgcgtgggaatctgcctggtagtgggggacaacgttcggaaacgaacgctaataccgcatacgccctacgggggaaggggggggatcttcggacctctcgctatcagatgagcccgcgtcggattagcttgttggtggggtaaaggcctaccaaggcgacgatccgtaactggtctgagaggatgatcagtcacactggaactgagacacggtccagactcctacgggaggcagcagtggggaatattggacaatgggggcaaccctgatccagccatgccgcgtgtgtgaagaaggccttagggttgtaaggcactttcagtggggagaaaggttgtttacttaatacgtaagcaaattgatgttacccacagaagaagcaccgg

SEQ ID NO: 2929 - DNA, 490 bp, Unknown
  Ascusbbf_332990, encodes 16S rRNA
agagtttgatcctggctcaggatgaacgctggcggcgtgcttaacacatgcaagtcgaacggagtattgacgctgacgagtggagagcttgctcgaagcaaatcttgtcgatacttagtggcggacgggtgagtaacgcgtgggtaacctgccgtatgcagggggacaacagttggaaacgactgctaataccgcatatgcacacagtaaggcatcttacagggtggaaagaatttcggcatacgatggacccgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaag

SEQ ID NO: 2930 - DNA, 490 bp, Unknown
  Ascusbbf_1880040, encodes 16S rRNA
agagtttgatcctggctcaggacgaacgctggcggcgtgcttaacacatgcaagtcgaacgaggaacggatggaagcttgcttttatccgtttcgagtggcggacgggtgagtaacgcgtgaggtacctggcttttgcagggggatagcgtttcgaaagagacggtaataccgcatgagaccacagcaccgcatggtaaaggggtcaaaggagagatccggcagaagatggactcgcgtcccattaggcagttggcggggtaaaggcccaccaaaccgacgatgggtagccgacctgagagggtgatcggccacattggaactgagagacggtccaaactcctacgggaggcagcagtggggaatattgggcaatgggcgaaagcctgacccagcaacgccgcgtgagggaagaaggttttcggattgtaaacctctgtcccaggagacgagaaggagacggtatcctgggaggaagccccggctaacta

SEQ ID NO: 2931 - DNA, 490 bp, Unknown
  Ascusbbf_1568751, encodes 16S rRNA
agagtttgatcctggctcaggatgaacgctggcggcgtgcttaacacatgcaagtcgaacgaagcacttgagatgagaccttcgggtggattttcttgtgacttagtggcggacgggtgagtaacgcgtgggtaacctgccccatacagggggataacagttggaaacgactgctaagaccgcataacaagggagtaccgcatgacacttccttcaaagatttatcggtatgggatgggcccgcgtctgattagccagttggtgaggtaatggcccaccaaagcaacgatcagtagccggcttgagagagtgaacggccacattgggactgagacacggcccaaactcctacgggaggcagcagtgggggatattggacaatgggggaaaccctgatccagcgacgccgcgtgagtgaagaagtatttcggtatgtaaagctctatcagcagggaagaaaaagcgcaagcattgacagtacctgactaag

SEQ ID NO: 2932 - DNA, 490 bp, Unknown
  Ascusbbf_466081, encodes 16S rRNA
agagtttgatcatggctcaggatgaacgctggcggcgtgcttaacacattcaagtcgaacggtgaagggggcttcggttcccggatcagtggcggacgggtgagtaacgcgtgaataacctgcctgtgtgtgggggataacagctggaaacggctgctaataccgcataacgtacggacaccgcatgatgaccgtaccaaagatttattgcgcacagatggattcgcgtccgattagatagttggtgaggtaacggcccaccaagtcgacgatcggtagccggactgagaggtcgaacggccacattggaactgagacacggtccagactcctacgggaggcagcagtggggaatattgggcaatggacgaaagtctgacccagcgacgccgcgtgagggaagaagatcttcggattgtaaaccttagtcaacagggaagaagaaagtgacggtacctgtggaggaagccacggctaactacgtgccagc

SEQ ID NO: 2933 - DNA, 490 bp, Unknown
  Ascusbbf_713419, encodes 16S rRNA
agagtttgatcctggctcaggatgaacgctggcggcgtgcctaatacatgcaagtcgatcgctggagacttagcttgctaagtcaaaggagaggcgaacgggtgagtaatacataagcaacctgcccacgaagactgggataattcctggaaacggggactaataccggataggcagtcatatcgcatgatgagactgttaaaggttcaaaacactggtggatgggcttatggcgcattagttagttggtgaggtaacggcccaccaagacgatgatgcgtagccggcctgagagggtgaacggccacattgggactgagacacggcccagactcctacgggaggcagcagtagggaattttcggcaatgggggaaaccctgaccgagcaacgccgcgtgagtgatgacggccttcgggttgtaaagctctgttgtaagggaagaacggtacggagagaatctgtaaatgacggtaccttaccagaaagc

SEQ ID NO: 2934 - DNA, 490 bp, Unknown
  Ascusbbf_879621, encodes 16S rRNA
agagtttgatcctggctcaggatgaacgctggcggcgtgcctaacacatgcaagtcgaacgaagcatcttgcccgaggaagaggagtgcttgcacgaatccaactcaactgagatgacttagtggcggacgggtgagtaacgcgtgggtaacctgccctatacagggggataacagttagaaatgactgctaataccgcataagcgcacagcatcgcatggtgcagtgtgaaaagccgagacggtataggatggacccgcgtctgattagccagttggcagggtaacggcctaccaaagcaacgatcagtagccggcctgagagggtgaacggccacattgggactgagacacggcccaaactcctacgggaggcagcagtgggggatattgcacaatgggggaaaccctgatgcagcgacgccgcgtgagtgaagaagtatttcggtatgtaaagctctatcagcagggaagaaaatgacggtacctga

SEQ ID NO: 2935 - DNA, 490 bp, Unknown
  Ascusbbf_1724722, encodes 16S rRNA
agagtttgatcctggctcaggacgaacgctggcggcgtgcttaacacatgcaagtcgaacgaggtttccggagagcttgctcgaagggaaccgagtggcggacgggtgagtaacgcgtgagcaacctgtctcacacagggggataacgcatcgaaagatgtgctaataccgcgtaggaccacggtgtcgcatggcactgaggtgaaaggagaaatccggtgtgaggtgggctcgcgtctgattagatagttggtgaggtaacggctcaccaagtcaacgatcagtagccgacctgagagggtgatcggccacattgggactgagacacggcccagactcctacgggaggcagcagtggggaatattgggcaatgggcgaaagcctgacccagcaacgccgcgtgaaggaagaaggttttcggatcgtaaacttctgtcctatgtgaagaggagacggtagcataggaggaagccccggctaactacgtgc

SEQ ID NO: 2936 - DNA, 490 bp, Unknown
  Ascusbbf_724623, encodes 16S rRNA
agagtttgatcatggctcagaacgaacgctggcggcgtgcctaacacatgcaagtcgagcgcgaaagggacttcggtcctgagtaaagcggcgaacgggtgagtaacacgtgagtaacgtaccttcaggtgggggataaccattcgaaaggatggctaataccgcataagaccacactgactaatgtcagaggggtcaaagccgcaaggcgccagaagatcggctcgcgtcccattaggtagttggtggggtaaaggcctaccaagcccgagatgggtagctggtctgagaggacgatcagccacactgggactgagacacggcccagactcctacgggaggcagcagtggggaatcttgcgcaatgggcgaaagcctgacgcagcaacgccgcgtgtgtgaagaaggcccttgggtcgtaaagcactgtcggaagggaagaaaaaaatgacggtaccttccaaggaagcaccggctaactccgtgccag

SEQ ID NO: 2937 - DNA, 490 bp, Unknown
  Ascusbbf_623913, encodes 16S rRNA
agagtttgatcctggctcaggacgaacgctggcggcgtgcttaacacatgcaagtcgagggcactccttcgggggtgaccggcgaacgggtgcgtaacacgtgagcaacctgcccgcttgtggggaatagccggcccaacggccgggtaataccgcatacgttccatggtccacctggactgtggaggaaagctttagcgcaggcggaggggctcgcggcctatcagctagttggtgcggtaacggcgcaccaaggcagtgacgggtagctggtctgagaggatggccagccacattgggacttagacacggcccagactcctacgggaggcagcagtggggaatactgcgcaatggccgaaaggctgacgcagcgacgccgcgtgggggaggaaggttttcggatcgtaaacccctgttgcccgggacgaactgttggtttcagccaacttgacggtaccgggtgaggaagcaccggctaactccgtgc

SEQ ID NO: 2938 - DNA, 490 bp, Unknown
  Ascusbbf_1891399, encodes 16S rRNA
agagtttgatcatggctcagagcgaacgtttgcggcgggcctaacacatgcaagtcgaacgagaatcggtccttcgggactgaggacagtggcgcacgggtgcgtaacacgtgggtaatcaaccccctagattgggacaacccggggaaactcgggctaataccggatatggcgactgggacttcggtcctggccgcgaaaggtccgcaagggccactaggggacgagctcgcggcccatcagcttgttggtgaggtaatggctcaccaaggctaagacgggtagctggtctgagaggatgatcagccacactggaactgagacacggtccagactcctacgggaggcagcagtggggaatattgcgcaatgggcgaaagcctgacgcagccacgccgcgtgagcgatgaaggtcttcggatcgtaaagctctgtggggggagaagaatcaagccggtgaagagccggccctgacggtatccccttagca

SEQ ID NO: 2939 - DNA, 490 bp, Unknown
  Ascusbbf_968502, encodes 16S rRNA
agagtttgatcatggctcaggatgaacgctggcggcgtgcctaacacatgcaagtcgaacgaggctcctctatctgatgtttcgactgaagacggaggatcaccgagtggcggatgggtgagtaacgcgtggagaacctgcccttatcagggggataacaactggaaacggttgacaataccgcatatagtgcatgatcgcatgttcttgcacggaaagatttatcggataaggatggctccgcgttggattagctagttggtggggtaacggcctaccaaggcgacgatccgtagccggcctgggagggcgaccggccacattgggactgagacacggcccagactcctacgggaggcagcagtggggaatattgcacaatgggcgcaagcctgatgcagcgacgccgcgtgaaggaagaagtatttcggtatgtaaacttctatcagcagggaagaaaacgacggtacctgactaagaagccccggct

SEQ ID NO: 2940 - DNA, 490 bp, Unknown
  Ascusbbf_732978, encodes 16S rRNA
agagtttgatcatggctcaggatgaacgctagcgacaggcctaacacatgcaagtcgaggggcagcgcgggagaagcttgcttttcctggcggcgaccggcgcacgggtgcgtaacaggtgtgcaatctgtcctataccggggcatagcccagcgaaagttggattaattctccatgtgaagcgagaccgcatgatcttgctttgaaacgtaagggtatagggtgagcacgcttctgattaggttgttggcggggtaacggcccaccaagccgacgatcagtaggggttctgagaggaaggtcccccacattggtactgagacacggaccaaactcctacgggaggcagcagtgaggaatattggtcaatgggcgagagcctgaaccagccaagtagcgtgcaggatgactgccctatgggttgtaaactgcttttataggggaataaagtccactacgtgtagtggtttgtatgtaccctatgaataag

SEQ ID NO: 2941 - DNA, 490 bp, Unknown
  Ascusbbf_372228, encodes 16S rRNA
agagtttgatcatggctcaggacgaacgctggcggcgtgcctaacacatgcaagtcgaacggagtgatcatagcttgctaagatcacttagtggcggacgggtgagtaacgcgtggggaacctgcctttcagagggggataacgttctgaaaagaacgctaataccgcataacgtatgtttatcgcatggtagatataccaaaggagcaatccgctgaaagatggccccgcgtccgattagatagttggtgaggcaacggctcaccaagtcgacgatcggtagccggactgagaggttgaacggccacattgggactgagacacggcccagactcctacgggaggcagcagtgggggatattgcacaatgggggaaaccctgatgcagcaacgccgcgtgagggaagaaggttttcggattgtaaacctctgtccttggtgaagataatgacggtagccgaggaggaagctccggctaactacgtgccag

SEQ ID NO: 2942 - DNA, 490 bp, Unknown
  Ascusbbf_1039312, encodes 16S rRNA
agagtttgatcctggctcaggacgaacgctggcggcgtgcttcacacgtgcaagtcgaacggaaaggcccagcttgctgggtactcgagtggcgaacgggtgagtaacacgtgagtaatctgcctttggctttgggataagcctcggaaacggggtctaataccggatatgacgcttctttgcatgaagaggtgtggaaagtttttcggctgaaaatgggctcgcggactatcagcttgttggtggggtaatggctcaccaaggctttgacggatagccggcctgagagggcgaccggccacactgggactgagacacggcccagactcctactggaggcagcagtggggaatattgcgcaatgggcgaaagcctgacgcagcgacgccgcgtgagggatgacggccttcgggttgtaaacctctttcggtaccgacgaagcgagagtgacggtaggtgcagaagaagcgccggctaactacgtgccagc

SEQ ID NO: 2943 - DNA, 490 bp, Unknown
  Ascusbbf_478712, encodes 16S rRNA
agagtttgatcctggctcaggacgaacgctggcggcgtgcttaacacatgcaagtcgagcggtaaggccctttcgggggtacacgagcggcgaacgggtgagtaacacgtgagtaatctgcccttcacttcgggataactaccggaaacggtggctaataccggatatgaccacttcatgcatgtgatggtggtggaaagtgtttagcggtgggggatgtgctcgcggcctatcagcttgttggtgaggtaatggctcaccaaggcttcgacgggtagccggcctgagagggtgaccggccacactgggactgagacacggcccagactcctacgggaggcagcagtggggaatattggacaatgggcggaagcctgatccagcaacgccgcgtgagggatgacggccttcgggttgtaaacctctttcagctctgacgaagcgaaagtgacggtaggagcagaagaagcaccggccaactacgtgccag

SEQ ID NO: 2944 - DNA, 490 bp, Unknown
  Ascusbbf_247682, encodes 16S rRNA
agagtttgatcctggctcaggacgaacgctggcggcgtgcctaacacatgcaagtcgaacggaaactattcgggaatttcggttcatggatagttttagtggcggacgggtgagtaacgcgtgagaatctgcctttaagtggggaataacagttggaaacgactgctaataccgcataacatgggaaaccatcaaaggaggtgcaagcctccgcttagagatgagctcgcgtctgattagctagttggcagggtaagagcctaccaaggcgacgatcagtagccggcctgagagggtgaacggccacattggaactgagacacggtccaaactcctacgggaggcagcagtggggaatattgcgcaatgggggaaaccctgacgcagcgacgccgcgtgagcgaagaaggccttcgggttgtaaagctctgttttaagggacgaaacctgatactaggaaatgagtagcaattgacggtaccttaagagg

SEQ ID NO: 2945 - DNA, 490 bp, Unknown
  Ascusbbf_341309, encodes 16S rRNA
agagtttgatcatggctcaggatgaacgctggcggcgtgcctaacacatgcaagtcgaacgatgaaaccgcctccgggcggacatgaagtggcgaacgggtgagtaacacgtgaccaacctgccccgcgcaccgggacagccccccgaaagggggattaataccggatactccggccgggccgcatggcccggccgggaaagctccggcggcgcgggatggggtcgcggcccatcaggtagtaggtcgggtagaggccgacctagccgacgacgggtagccgggttgagagaccgaccggccacattgggactgagatacggcccagactcctacgggaggcagcagtggggaatattgcgcaatgggggcaaccctgacgcagcaacgccgcgtgcgggatgaaggcgtccgcgtcgtaaaccgctttcagcagggaggaaacctgacagtacctgcagaagaagccccggctaactacgtgccagcag

SEQ ID NO: 2946 - DNA, 490 bp, Unknown
  Ascusbbf_1866772, encodes 16S rRNA
agagtttgatcatggctcaggacgaacgctggcggcgtgcctaacacatgcaagtcgaacggagtattccacccgagaccagatgtagcttgctacggatgggatcaattgggatacttagtggcggacgggtgagtaacgcgtgaataacctgcccaacagagggggataacgtttggaaacgaacgctaataccgcataacattacggtatcgcatggtacagtaatcaaaggagcaatccgctgatggatggattcgcgtccgattagctagttggtgagataagagctcaccaaggcgacgatcggtagccggactgagaggttgaacggccacattgggactgagacacggcccagactcctacgggaggcagcagtgggggatattgcacaatgggggaaaccctgatgcagcaacgccgcgtgagggaagaaggttttcggattgtaaacctctgtcctaggtgaagataatgacggtagcct

SEQ ID NO: 2947 - DNA, 490 bp, Unknown
  Ascusbbf_1780079, encodes 16S rRNA
agagtttgatcatggctcaggacgaacgctggcggcgtgcctaacacatgcaagtcgaacggggtaactcgctgaaattgagatcagcttgctgaaggaaatttcttgagttacttagtggcggacgggtgagtaacgcgtgagcaacctgccttacagagggggacaacagttggaaacgactgctaataccgcatgacgtcgcgggaccgcatgatcctgcgaccaaagatttatcgctgtaagatgggctcgcgtccgattagatagttggtgaggtaacggcccaccaagtcgacgatcggtagccggactgagaggttgaacggccacattgggactgagacacggcccagactcctacgggaggcagcagtgggggatattgcacaatgggcgaaagcctgatgcagcaacgccgcgtgaaggaagaaggtcttcggattgtaaacttctgttttcggtgaagaaacaaatgacggtagccgaa

SEQ ID NO: 2948 - DNA, 490 bp, Unknown
  Ascusbbf_1839404, encodes 16S rRNA
agagtttgatcctggctcaggacgaacgctggcggcgtgcttaacacatgcaagtcgagcggtaaggccctttggggtacacgagcggcgaacgggtgagtaacacgtgggtgatctgccttgcactctgggataagcctgggaaactgggtctaatactggatatgaccgcgaatcgcatggtttgtggtggaaagatttatcgatgcgagatgggcccgcggcctatcagcttgttggtggggtaatggcctaccaaggcgacgacgggtggccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcgactccgacgaagcgtaagtgacggtaggagtagaagaagcaccggccaactacgtgccagcagc

SEQ ID NO: 2949 - DNA, 490 bp, Unknown
  Ascusbbf_1829113, encodes 16S rRNA
agagtttgatcatggctcaggatgaacgctggcggcatgcctaagacatgcaagtcgaacgaggtgccccgatgaagatgaagtgcttgcacagatttggattcggatcagcacctagtggcggacgggtgagtaacacgtgggtgacctacctttgagactgggatacctattggaaacgatagttaataccggataacacattaattcgttttaatgttaaaaggagcctttaaagcttcactcttagatgggcctgcggagtattagatagttggtggggtaatggcctaccaagtcgacgatgcttagccgaactgagaggttgatcggccacattgggactgagacacggcccaaactcctacgggagacagcagttaggaatattcgtcaatgggggaaaccctgaacgagcaatgccgcgtgaacgatgaaggccctctgggttgtaaagttctgttacttgggaagaatatctaagataaga

SEQ ID NO: 2950 - DNA, 490 bp, Unknown
  Ascusbbf_1782101, encodes 16S rRNA
agagtttgatcatggctcaggatgaacgctggcggcgcatttaagacatgcaagtcgaacgaaaacactcaattgaaatcgatttgaagatttatctgatatgaagtttcgcccgagtgttttagtggcggacgggtgagtaatacgtagataacctgccttatagacagaaataactactggaaacggtagctaatgtctgataagaccacgcttaggcatctaagagcggtcaaaggggtaacccgctataagatggatctacggctgattagttagttggtgagataacagcccaccaagacgatgatcagtagccgagctgagaggctggccggccacattgggactgagacacggcccagactcctacgggaggcagcagttgggaatattggacaatggaggaaactctgatccagtgacgccgcgtgaaggaagaaggtcttcggattgtaaacttattttatcagggaagaaacaaatgact

SEQ ID NO: 2951 - DNA, 490 bp, Unknown
  Ascusbbf_1681911, encodes 16S rRNA
agagtttgatcatggctcaggacgaacgctggcggcgtgcctaacacatgcaagtcgaacggaactttgcgctgaaattgagagcagcttgctgcaggaagtttcttgtaaagtttagtggcggacgggtgagtaacgcgtgaggaacctgccttacagagggggacaacagttggaaacgactgctaataccgcataacatagcgagaggacatcctcttgttatcaaaggagcaatccgctgtaagatggcctcgcgtccgattagatagttggcggggtaacggcccaccaagtcgacgatcggtagccggactgagaggttgaacggccacattgggactgagacacggcccagactcctacgggaggcagcagtgggggatattgcacaatggaggaaactctgatgcagcaacgccgcgtgagggaagaaggttttcggattgtaaacctctgtttttagtgacgaaacaaatgacggtagcta

SEQ ID NO: 2952 - DNA, 490 bp, Unknown
  Ascusbbf_1600958, encodes 16S rRNA
agagtttgatcatggctcaggatgaacgctggcggcgtgcctaacacatgcaagtcgaacggttaagccggcttcggccgggtatacagtggcgaacgggtgagtaacacgtgaccaacctgccccgcgctccgggatagccccgcgaaagcgagattaataccggatgacgcgggaggggcgcatgcccctcccgccaaagcccaggcggcgcgggatggggtcgcggcccattaggtagtaggcggggtgacggcccacctagccgacgatgggtagccgggttgagagaccgaccggccacattgggactgagatacggcccagactcctacgggaggcagcagtggggaatattgcgcaatgggggcaaccctgacgcagcaacgccgcgtgcgggaagaaggccctcgggttgtaaaccgctttcagcagggaagatcgtgacggtacctgcagaagaagccccggctaactacgtgccagcagc

SEQ ID NO: 2953 - DNA, 490 bp, Unknown
  Ascusbbf_1843501, encodes 16S rRNA
agagtttgatcatggctcagaacgaacgctggcggcgtgcttaacacatgcaagtcgtgcgcgactgggcttcggtccagttgagcggcgaacgggtgcgtaacacgtggataatctgccttcgggctcggaataacctctcgaaagaggggctaataccggataagcccccggggacttcggttcctgagggaaaaggtggcctctatttataagctaccacctgaagatgagtccgcggcccatcagctagttggcggggtaatggcccaccaaggctacgacgggtagctggtctgagaggacgatcagccacactgggactgagacacggcccagactcctacgggaggcagcagtggggaatcttgcgcaatggacgaaagtctgacgcagcaacgccgcgtgagtgatgaaggtctttggatcgtaaagctctttcggctgggaagaaccgcctcgtggctaatatccacgaggtctgacggta

SEQ ID NO: 2954 - DNA, 490 bp, Unknown
  Ascusbbf_464518, encodes 16S rRNA
agagtttgatcatggctcaggatgaacgctggcggcgtgcttaacacatgcaagtcgagcgagaagctcatgaacaattcttcggaagcgggaatgagtggaaagcggcggacgggtgagtaacgcgtaggcaacctgccccgtacaaagggatagctactggaaacggtaattaatacctcataacacggagatgccgcatggcatcatcgtcaaagatttatcggtatgggatgggcctgcgtctgattagcttgttggtggggtaacggctcaccaaggcgacgatcagtagccgacctgagagggtaaacggccacattggaactgagacacggtccaaactcctacgggaggcagcagtggggaatattgcacaatggggggaaccctgatgcagcaacgccgcgtgagcgaagaaggcctttgggtcgtaaagctctgtcctgaaggaagaaggaagtgacggtacttcaggaggaagccccgg

SEQ ID NO: 2955 - DNA, 490 bp, Unknown
  Ascusbbf_980997, encodes 16S rRNA
agagtttgatcatggctcagaacgaacgctggcggtgcgttttaagcatgcaagtcgagcggcaagtgctagcaatagcacctagagcggcggacgggtgagtaacacgtggataatctacctcggagtttgggatataccgtggaaacacggagtaataccggatacgatgccacttggagacaagtgtcaggaaagatgctacggcatcgctttgagatgagtccgcggcccattagctagacggcggggtaaaggcccaccgtggcgatgatgggtagccggcctgagagggtgtacggccacattgggactgagacacggcccagactcctacgggaggcagcagctaagaatcttccgcaatggacgaaagtctgacggagcgacaccgcgtgaatgatgaaggccgaaaggttgtaaaattcttttctgttggaggaataaactttcgagggaatgcgagagcgatgacgttaaaacaggaata

SEQ ID NO: 2956 - DNA, 490 bp, Unknown
  Ascusbbf_1287736, encodes 16S rRNA
agagtttgatcctggctcaggatgaatgctggcggcatgcctaatacatgcaagtcgagcggcaacgagggtttcatcctattctggaagtgattcgagagtagaatgaaacctgtcggcgagcggcggacggctgagtaacgcgtgggaacgtaccccaaactgagggataactagtcgaaagattagctaataccgcatgtgatcttcggattaaagctttcgggcggtttgggaatggcctgcgtacgattagatagttggtgaggtaatggctcaccaagtcgacgatcgttagatggtttgagaggatgatcatccagactgggactgagacacggcccagactcctacgggaggcagcagtagggaatctttcacaatgggcgaaagcctgatggagcaatgccgcgtgcaggacgaaggccttcgggttgtaaactgcttttataagcgaggaatatgacggtaacttatgaataaggatcgg

SEQ ID NO: 2957 - DNA, 490 bp, Unknown
  Ascusbbf_449515, encodes 16S rRNA
agagtttgatcatggctcaggatgaacgctggcggcgtgcttaacacatgcaagtcgaacggaacttttctcccgaagcgattgcgagcttgctcaagatcaattcatttgaaaagtttagtggcggacgggtgagtaacgcgtgggtaacctgccgtatgccgggggacaacagttggaaacgactgctaataccgcataagcgcacagtatcgcatgatacagtgtgaaaaactccggtggcatacgatggacccgcgtctgattagctagttggtgaggtagcggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgac

SEQ ID NO: 2958 - DNA, 490 bp, Unknown
  Ascusbbf_1410463, encodes 16S rRNA
agagtttgatcctggctcaggacgaacgctggcggcgtgcttaacacatgcaagtcgagcggaaaggccccttcgggggtactcgagcggcgaacgggtgagtaacacgtgagcaacctgcccttgacttcgggataagcctgggaaactgggtctaataccggatatgaccattgcgtgcatgcgtggtggtggaaagtttttcggttggggatgggctcgcggcctatcagcttgttggtggggtgatggcctaccaaggcttcgacgggtaaccggcctgagagggcgaccggtcacactgggactgagacacggcccagactcctacgggaggcagcagtggggaatattgcgcaatgggcggaagcctgacgcagcgacgccgcgtgggggatgacggccttcgggttgtaaacctctttcagcatcgacgaagctcttttggggtgacggtaggtgcagaagaagcgccggctaactacgtgcc

SEQ ID NO: 2959 - DNA, 490 bp, Unknown
  Ascusbbf_1753095, encodes 16S rRNA
agagtttgatcctggctcaggacgaacgctggctgcgtgcttaacacatgcaagtcgaacgctgaagcccgcagcttgctgtgggtggatgagtggcgaacgggtgagtaacacgtgagtaacctgcccccgacttcgggacaagcccgggaaactgggtctaataccggatatgacaaccgaaggcatcttcggttgtggaaagttttttcggttggggatgggctcgcggcctatcagtttgttggtgaggtaatggctcaccaagacgacgacgggtagccggcctgagagggcgaccggccacactgggactgagacacggcccagactcctacgggaggcagcagtggggaatattgcacaatgggggaaaccctgatgcagcgacgcagcgtgcgggatgacggccttcgggttgtaaaccgctttcagcagggaagaagccccttggggtgacggtacctgcagaagaagtaccggctaacta

SEQ ID NO: 2960 - DNA, 490 bp, Unknown
  Ascusbbf_1811440, encodes 16S rRNA
agagtttgatcatggctcaggatgaacgctagcggcaggcttaacacatgcaagtcgagcggagtttagtggaaggaggattcgtccaacggaacctaaacttagcggcggatgggtgaggaacgcgtggataacctaccgtgcacagggggataacagttggaaacgactgttaataccgcatatgctcacagtaccgcatggtacagggaggaaagattaatcggtgcatgatggatccgcgtcggattagccagttggcggggtaacggcccaccaaagcgatgatccgtagccggcctgagagggcgaccggccacattgggactgagacacggcccaaactcctacgggaggcagcagtgggggatattgcacaatgggggaaaccctgatgcagcgacgccgcgtgaaggaagaagtatttcggtatgtaaacttctatcagcagggaagaaaatgacggtacctgactaagaagccccggcta

SEQ ID NO: 2961 - DNA, 490 bp, Unknown
  Ascusbbf_1042808, encodes 16S rRNA
agagtttgatcctggctcaggatgaacgctggcggcgcgcctaacacatgcaagtcgagcggaggacccgccctcgggcgggcgatcagcggcgaacgggtgagtaacgcgtgggcaacctgcccccccctcgggaatagctccgggaaaccggtggtaacgcccgacggcccggagagagggcatcccctctccggcaaagctccggcggggggggatgggcccgcgtcccatcagctagacggcggggtgacggcccaccgtggcgacaacgggtagccgggctgagaggccggacggccacattgggactgagacacggcccagactcctacgggaggcagcagtggggaatattgcgcaatgggggcaaccctgacgcagcgacgccgcgtgcgggacggaggccctcgggccgtgaaccgctttcggcggggacgatagtgacggtacccgcagaagaagccccggctaactacgtgccagcagc

SEQ ID NO: 2962 - DNA, 490 bp, Unknown
  Ascusbbf_1792446, encodes 16S rRNA
agagtttgatcatggctcaggatgaacgctggcggcgtgcctaatacatgcaagtcgagcgaaccgatggagtgcttgcattcctgaggttagcggcggacgggtgagtaacacgtaggcaacctgcctgtacgaccgggataactccgggaaccggagctaataccggataggatgccgaaccgcatggttcggcatggaaaggcctttgagccgcgtacagatgggcctgcggcgcattagctagttggtggggtaacggcctaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgaggaaggtcttcggatcgtaaaactctgttgtcagggaagaaccgccgggatgacctcccggtctgacggtacctgacgagaaa

SEQ ID NO: 2963 - DNA, 490 bp, Unknown
  Ascusbbf_1540760, encodes 16S rRNA
agagtttgatcatggctcaggatgaacgctggcggcgtgcctaacacatgcaagtcgaacggaacttttaagggacaagacttcggtcaagtgatatttaagtttagtggcggacgggtgagtaacgcgtgagcaacctgcctttcagagggggataacgtccggaaacggacgctaataccgcatgacatagatttatcgcatggtgaatctatcaaagattttatcgctgagagatgggctcgcgtccgattaggtagttggtggggtaacggctcaccaagccgacgatcggtagccggactgagaggttgaacggccacattgggactgagacacggcccagactcctacgggaggcagcagtggggaatattgcacaatgggcgcaagcctgatgcagcaacgccgcgtgagggaagacggttttcggattgtaaacctctgtctttggtgacgaagaagtgacggtagccaaggaggaagccac

SEQ ID NO: 2964 - DNA, 469 bp, Unknown
  Ascusbbf_1593557, encodes 16S rRNA
agagtttgatcatggctcaggatgaacgctggcggcgtgcctaacctatgcaagtcgaacgaggcttcgagccgagtggcggacgagtgagtaacacgtacctaatctgcctgtaagtggggaataaccgcccgaaagggtggctaataccccatgtgctctacggagtaaagcttttgcgcttacagatgagggtgcgacctatcagctagttggtgaggtaaaggcttaccaaggctatgacgggtagctggtctgagaggatgatcagccacgctgggactgagaacggcccagactcctacgggaggcagcaagtgggaatattgcacaatgggcgaaagcctgatgcagcgacgccgcgtgggggatgaaggttttcggatcgtaaaccccttttatcgattaggaagataagaccagtcgatgaataagcacctgctaactacgtgccagcagccgcggtaat

SEQ ID NO: 2965 - DNA, 490 bp, Unknown
  Ascusbbf_1570091, encodes 16S rRNA
agagtttgatcatggctcaggatgaacgctagcggcaggctcaacacatgcaagtcgaacgaagcactggaccttcgggaccggtgactgagtggcggacgggtgagtaacgcgtgggtaacctgccctgtacagggggataacagttagaaatgactgctaataccgcataagcacacgagggggcatccctttgtgtgaaaaactccggtggtacaggatgggcccgcgtctgattagccagttggcagggtaacggcctaccaaagcgacgatcagtagccggtctgagaggatgaacggccacattggaactgagacacggtccaaactcctacgggaggcagcagtggggaatattgcacaatgggggaaaccctgatgcagcaacgccgcgtgagtgaggaagtatttcggtatgtaaagctctatcagcagggaagataatgacggtacctgacgaagaagctccggctaaatacgtgccagc

SEQ ID NO: 2966 - DNA, 490 bp, Unknown
  Ascusbbf_608315, encodes 16S rRNA
agagtttgatcctggctcaggacgaacgctggcggcgtgcctaatacatgcaagtcgagcggagagaacagaagcttgcttctgtttctctcagcggcggacgggtgagtaacacgtgggcaacctgccctgcagatcgggataactccgggaaaccggtgctaataccggatagtttgttctgcctcctggcagaacacggaaagacggtttcggctgtcactgcaggatgggcccgcggcgcattagctagttggtggggtaatggctcaccaaggccacgatgcgtagccgacctgagagggtgattggccacactgggactgagacacggcccagactcctacgggaggcagcagtagggaatcttccgcaatggacgaaagtctgacggagcaacgccgcgtgagtgatgaaggttttcggatcgtaaaactctgttgtgagggaagaacaagtgccacttaactactggcaccttgacggtacc

SEQ ID NO: 2967 - DNA, 490 bp, Unknown
  Ascusbbf_1873877, encodes 16S rRNA
agagtttgatcatggctcaggatgaacgctggcggcgtgcttaacacatgcaagtcgaacggagtatatcaaccgagaccttcgggtctcacctgttatacttagtggcggacgggtgagtaacgcgtgagcaaccaaccttctgcagtgggacaacaattagaaatgattgctaataccgcataagaccacagcatcgcatggtgcagtgagaaaagctgaggcggcagaaggcgggctcgcgttcgattagctggatggtgaggtaacggctcaccatggcgacgatcgatagccggactgagaggtcgaccggccacattgggactgagacacggcccagactcctacgggaggcagcagtggggaatattgcacaatgggggaaaccctgatgcagcgacgccgcgtgagtgatgaagtatttcggtatgtaaagctcttttagcagggaagaaaatgacagtacctgaagaaacagccccggcta

SEQ ID NO: 2968 - DNA, 490 bp, Unknown
  Ascusbbf_1856858, encodes 16S rRNA
agagttgatcatggctcaggatgaacgctagcggcaggcttaacacatgcaagtcgaggggtaacgcggtgtagcaatacactggcgacgaccggcgcacgggtgcgtaacgcgtatgcaacctaccttgtacagggggataacggagggaaacttccactaatatccatagtgttgggggatcgcatgattctccaactaaagctacggtggtgcaagatgggcatgcgtgacattagctagttggtaaggtaacggcttaccaaggcgacgatgtctaggggagctgagaggcttatcccccacactggtactgagacacggaccagactcctacgggaggcagcagtgaggaatattggtcaatggacggaagtctgaaccagccatgccgcgtggaggaagaaggtcctatgggttgtaaactccttttgttcgagagtaataagggctttgcgaagcccgatgagagtatcggacgaataagcat

SEQ ID NO: 2969 - DNA, 490 bp, Unknown
  Ascusbbf_84917, encodes 16S rRNA
agagtttgatcatggctcaggatgaacgctggcggcgtgcctaacacatgcaagtcgaacggaaacttatggaacggagattcgtcgaagagaaataagttttagtggcggacgggtgagtaacgcgtgggtaacctgcctcatagagggggataacagctggaaacgactgctaataccgcataagcccacagtaccgcatggtacagggggaaaagaattatcgctatgagatggacccgcgtctgattaactggttggtgaggtaacggcccaccaaggttacgatcagtagccggactgagaggttgaacggccacattgggactgagacacggcccaaactcctacgggaggcagcagtgggggatattgcacaatgggggaaaccctgatgcagcgacgccgcgtgggtgaagaagtctttcgggatgtaaagccctatcagcagggaagataatgacggtacctgactaagaagccccggcta

SEQ ID NO: 2970 - DNA, 490 bp, Unknown
  Ascusbbf_462102, encodes 16S rRNA
agagtttgatcctggctcagaacgaacgctggcggcgcgtcttaagcatgcaagtcgagcgggattcatgtgcttgcacatgatgagagcggcggactggcgaggagcgcgtgggcgacgcgccccccggactggaacagcccgtggaaacacggggtaatgccggacggcatgcggagtttggagactccgcatcaaaggggcttcggccccgccgggggagcggcccgcgtcccatcagctagttggcggggaaaaggcccaccaaggctgcgacgggtatccggcctgagagggcgatcggacgcattgggactgagatacggcccagactcctacgggaggcagcagctaagaatattccgcaatgggcgaaagcctgacggagcgacgccgcgtggacgatggaggccggaaggttgtaaagtccttttgggaaggaagaagaagcgggggaggaaacgcctccgcggcgacggtacttcgcgaa

SEQ ID NO: 2971 - DNA, 490 bp, Unknown
  Ascusbbf_1562145, encodes 16S rRNA
agagtttgatcctggctcaggatgaacgctagctacaggcttaacacatgcaagtcgaggggaaacgacatagagtgcttgcactttatgggcgtcgaccggcgaatgggtgagtaacgcgtatccaacctgcccttgactgagggatagcccagtgaaaactgaattaatacctcatgtcctcctcagacggcatcagacgaggagtaaagatttatcggtacaggatggatccgcgtttgattagccagttggcggggtaacggcccaccaaagcgacgatcaatagccggcctgagagggcggacggccacattgggactgagacacggcccagactcctacgggaggcagcagtgggggatattgcacaatggacgaaagtctgatgcagcgacgccgcgtgagtgaagaagtatttcggtatgtaaagctctatcagcagggaagaaaggctccgcaaggagagatgacggtacctgagtaagaa

SEQ ID NO: 2972 - DNA, 490 bp, Unknown
  Ascusbbf_1348878, encodes 16S rRNA
agagtttgatcctggctcaggatgaacgctggcggcgtgcctaacacatgcaagtcgaacggagttattttggaaagttcttcggaactggaatctataacttagtggcggacgggtgagtaacgcgtgagcaatctgcccttaggtgggggataacagtcggaaacggctgctaataccgcataaaacattttgaaggcatcttcgaaatgtcaaagatttattgcctttggatgagctcgcgtctgattagctggttggtgaggtaacggcccaccaaggcgacgatcagtagccggactgagagggtgaacggccacattgggactgagacacggcccagactcctacgggaggcagcagtggggaatattgcgcaatggggggaaccctgacgcagcaacgccgcgtgattgaagaaggccttcgggttgtaaagatctttaattagggacgaaacatgacggtacctaaagaataagctccggct

SEQ ID NO: 2973 - DNA, 490 bp, Unknown
  Ascusbbf_196212, encodes 16S rRNA
agagtttgatcctggctcaggacgaacgctggcggcatgcctaacacatgcaagtcgaacggtctaagagataaatttttaatttatttcaaggatagtggcgaacgggtgagtaacgcgtgagcaacctaccttttagagggggataacgcttggaaacaggcgctaataccgcataagctccgagaattgagtggttccaggagaaaaggagaaatccgctaaaagatgggctcgcgtccgattagctagttggtgagataacagcccaccaaggcaacgatcggtagccggactgagaggttgaacggccacattgggactgagacacggcccagactcctacgggaggcagcagtgggggatattgcacaatggggggaaccctgatgcagcaatgccgcgtgagggaagaagtttttcggaatgtaaacctctgtccttcgggaagataatgacggtaccgaaggaggaagctccggctaactac

SEQ ID NO: 2974 - DNA, 490 bp, Unknown
  Ascusbbf_731748, encodes 16S rRNA
agagtttgatcctggctcaggatgaacgctagcggcaggcttaacacatgcaagtcgaggggcagcgcgtcgtagcaatacgatggcggcgaccggcgcaagggtgcgtaacgcgtgagcaatctgcccgtatcagggggataagcgatggaaacgtcgtctaataccgcataacagttggggaggcatctttccgacttgaaagcttcggtggatacggatgagctcgcgagacattagttagttggcggggtaacggcccaccaagaccgcgatgtctaggggaactgagaggttggtcccccacactggaactgagacacggtccagactcctacgggaggcagcagtgaggaatattggacaatggccggaaggctgatccagccatgccgcgtgaaggataaggtcctatggattgtaaacttcttttgagtgggagcaataagggtgtcgtgacacccgatgagagtaccattcgaataagcat

SEQ ID NO: 2975 - DNA, 490 bp, Unknown
  Ascusbbf_635545, encodes 16S rRNA
agagtttgatcatggctcaggacgaacgctggcggcatgcttaacacatgcaagtcgaacgatgcaaaagcaaatcagcgatgaggcgattttgtatagtggcgaacgggtgagtaacgcgtgagcaacctgccttgtacattgggacaccagagggaaacttctgttaataccgaataagaccacggcgtcgcatgacgcaggggtaaaagcgatttagcggtacaagatgggctcgcgtcccattagctagttggcgggataacagcccaccaaggcgacgatgggtagccgacttgagagagtgatcggccacaatggaactgagacacggtccatactcctacgggaggcagcagtggggaatattgggcaatgggcgaaagccttacccagcaatgccgcgtgaatgatgaaggtcttcggattgtaaagttcttttattagtcatgaacacaatgacagtagctaatgaataagccccggctaa

SEQ ID NO: 2976 - DNA, 490 bp, Unknown
  Ascusbbf_678676, encodes 16S rRNA
agagtttgatcatggctcaggacgaacgctagcgacaggcttaacacatgcaagtcgaggggcagcggtggagagagcttgctctcttcagccggcgaccggcgcacgggtgagtaacacgtatgcaacctgcccttgacactgggataacccggagaaatccggactaataccgggcgatacccctggaggacatcctccggaggtcgaaggaagcgattccggtcaaggatgggcatgcggcgcattagctagttggcggggtaacggcccaccaaggcgacgatgcgtaggggttctgagaggaaggtcccccacattggtactgagacacggaccaaactcctacgggaggcagcagtgaggaatattggtcaatgggcgcgagcctgaaccagccaagtcgcgtgagggaggacggccctacgggttgtaaacctcttttgtcggggagcaaggactgccacgtgtggcagggcgagagtacccg

SEQ ID NO: 2977 - DNA, 490 bp, Unknown
  Ascusbbf_5071, encodes 16S rRNA
agagtttgatcatggctcaggatgaacgctggcggcgtgcctaacacatgcaagtcgaacgaagcatatacggcagaacttttcggagtgaagcggtttatgacttagtggcggacgggtgagtaacgcgtgggcaacctgcccttaaccgggggacaacagttggaaacggctgctaataccgcataagcgcacggaaccgcatggttcagtgtgaaaaattccggtggttaaggatgggcccgcgttggattaggtagttggtgcggtaacggcgcaccaagccgacgatccatagccgacctgagagggtgaccggccacattgggactgagacacggcccagactcctgcgggaggcagcagtggggaatattgcacaatgggggaaaccctgatgcagcgacgccgcgtgagtgaagaagtatttcggtatgtaaagctctttcggcagggaagaagatgacggtacctgcagaagaagccccgg

SEQ ID NO: 2978 - DNA, 490 bp, Unknown
  Ascusbbf_34467, encodes 16S rRNA
agagtttgatcatggctcaggattaacgctggcggcatgcctaatacatgcaagtcgaatggtttagcttgctagaccatggcgaacgggtgagtaacacgtaggtaacctaccttaaggacgaggataacctttggaaacgaaggataatactggataggacatcacaaatcacatgattagatgtttaaaggagcgatccaccataagaggggcctgcggcgcattagctagttggtgaggtaagggcccaccaaggcgatgatgcgtagctggactgagaggttgaacagccacaatgggactgagaacggcccatactcctacgggaggcagcagtagggaattttcggcaatgggcggaagcctgaccgagcaatgccgcgtgatcgaagaagtatttcggtatgtaaagatcttttatttgggaagaaaaaacaaattgactgaaccaaatgaataagctccggctaactacgtgccagcagcc

SEQ ID NO: 2979 - DNA, 490 bp, Unknown
  Ascusbbf_727372, encodes 16S rRNA
agagtttgatcatggctcaggattaacgctggcggcatgcctaatacatgcaagtcgaatggactagcttgctagtccatggcgaacgggtgagtaacacgtaggtaacctaccttaaggacgaggataacctttggaaacgaaggataatactggataggacattaaaaatcacgtgattaaatgtttaaaggagcaatccaccataagaggggcctgcggcgcattagctagttggtgaggtaaaggcccaccaaggcgatgatgcgtagctggactgagaggttgaacagccacaatgggactgagaacggcccatactcctacgggaggcagcagtatggaattttcggcaatggacaaaagtctgaccgagcaatgccgcgtgatcgaagaagtatttcggtatgtaagatcttttatttgggaagaaaaaacaaattgactgaaccaaatgaataagctccggctaactacgtgccagcagccg

SEQ ID NO: 2980 - DNA, 490 bp, Unknown
  Ascusbbf_25919, encodes 16S rRNA
agagtttgatcctggctcaggatgaacgctagcgacaggcctaacacatgcaagtcgaggggcagcatggagtagcaatactctgatggcgaccggcgcacgggtgcgtaacaggtgtgcaatctatccgtaatcggggaatagcccggcgaaagttggattaatgctccatgtgagtggaagccgcatggttttcatttaaaacgtgaggattacggttgagcacgcttctgattaggtagttggtgaggtaacggctcaccaagccgacgatcagtaggggttctgagaggaaggtcccccacattggaactgagacacggtccaaactcctacgggaggcagcagtgaggaatattggtcaatgggcggaagcctgaaccagccaagtcgcgtgaaggatgaaggttctatggattgtaaacttcttttattcgagggtaaagtgccggacgtgtccggtattgcaagtatcgaatgaataagcatc

SEQ ID NO: 2981 - DNA, 490 bp, Unknown
  Ascusbbf_60383, encodes 16S rRNA
agagtttgatcatggctcaggatgaacgctggcggcaggcttaatacatgcaagtcgaacggtaaggcccgaagtggcaacacggagggtacacgagtggcgcacgggtgcgtaacgcgtatgcaacctgcccctcaccgggacaaaacagctggaaacggctgctaatatcccatggctacctgagagggcatccttttaggtataaagattcattggtgagggatgggcatgcgtattattaggtagttggcggggtaacggcccaccaagccgacgatgattaggggttctgagaggaaagacccccacactggaactgagacacggtccagactcctacgggaggcagcagtagggaatattgggcaatggaggcaactctgacccagccatgccgcgtgaaggaataaggccctatgggtcgtaaacttcttttatcgtggagtaaacccggccacgtgtggccggttgagagtacacgaggaat

SEQ ID NO: 2982 - DNA, 490 bp, Unknown
  Ascusbbf_28203, encodes 16S rRNA
agagtttgatcatggctcaggatgaacgctagcggcaggcttaacacatgcaagtcgaggggcagcgggtgtagcaatacatgccggcgaccggcgcaagggtgcgtaacgcgtgagcaatctgcccgtatcagggggataagcgatggaaacgtcgtctaataccgcataacaccaatgatggcatcatcgatggttgaaagcttcggtggatacggatgagctcgcgagacattagttagttggcggggtaacggcccaccaagaccgcgatgtctaggggaactgagaggttggtcccccacactggaactgagacacggtccagactcctacgggaggcagcagtgaggaatattggacaatggccggaaggctgatccagccatgccgcgtgaaggaataaggtcctatggattgtaaacttcttttgtacgagagcaataagtgtcacgtgtgacacgatgagagtatcgtacgaataagcatc

SEQ ID NO: 2983 - DNA, 490 bp, Unknown
  Ascusbbf_112661, encodes 16S rRNA
agagtttgatcatggctcaggatgaacgctggcggcgtgcttaacacatgcaagtcgagcgagaaatgttcaaacagagattcgtcaacgggcggacatggacagcggcggacgggtgagtaacgcgtaggtaacctacccttaactgcgggatagcctagggaaacctggattaataccacataatgcgttggagtcacatggctttaacgccaaagatttatcggttaaggatggacctgcgtctgattagccagttggtggggtaacggcctaccaaagcgacgatcagtagccgacctgagagggtgatcggccacattggaactgagacacggtccaaactcctacgggaggcagcagtggggaatattgcacaatgggcgcaagcctgatgcagcaacgccgcgtgagcgaagaaggccttcgggttgtaaagctctgtccttagggacgaagaagtgacggtacctaaggaggaagccccggc

SEQ ID NO: 2984 - DNA, 490 bp, Unknown
  Ascusbbf_186547, encodes 16S rRNA
agagtttgatcatggctcagaatgaacgttggcggcgtggattaggcatgcaagtcgtacggtaagccccatagcttgctacggggcctagagtggcgaaagggataggataatgtagatgacataccctcgggaccgggatagcgtttggaaacgaacggtaataccggataacatctccggatcaaaggtgagattccgcctgaggattggtttacacactattagatagttggcggggtaaaggcccaccaagtcgacgatggttaccgggcgtgagagcgtgacccggatcactgggactgagacactgcccagacacctacgggtggctgcagtcgagaatcttcggcaatgggcgcaagcctgaccgagcgacgccgcgtgtgtgacgaaggtcttcggattgtaaagcactgtcgtgtgggaggaagtcacgttgggcaatcctggcgtgttgacctatcacaggaggaaggacgggctaagt

SEQ ID NO: 2985 - DNA, 490 bp, Unknown
  Ascusbbf_802097, encodes 16S rRNA
agagtttgatcatggctcaggacgaacgctggcggcgtgcctaacacatgcaagtcgagcggggacgagggagcttgcttccgagtcctaacggcggacgggtgagtaacgcgtgagcaacctgcctttcacagggggataacgcatcgaaagatgtgctaataccgcgtaagaccacggcaccgcatggtgcaggggtcaaaggagcaatccggtgaaagatgggctcgcgtccgattagctagttggtgagataacagcccaccaaggcgacgatcggtagccgacctgagagggtgatcggccacattggaactgagaaacggtccagactcctacgggaggcagcagtggggaatattgggcaatgagcgaaagcctgacccagcaacgccgcgtgagggaagaagggcttcggctcgtaaacctctgtcctatgggacgaaagagatgacggtaccataggaggaagccccggctaactacgtgc

SEQ ID NO: 2986 - DNA, 490 bp, Unknown
  Ascusbbf_141846, encodes 16S rRNA
agagtttgatcatggctcaggatgaacgctagcggcaggcctaatacatgcaagtcgcacgggagcgggccttcgggcctgcgagagtggcggacgggtgcgcaacgcgtatgcaaccaacccccgtaaggcggacagccggtggaaacgccgggcaatccgccatgacgccgccgcggggcatcccgtggcggccaaagcctggaggcggacggggacgggcatgcgtcccattagattgttggcggggtgacggcccaccaagtcatcgatgggtaggggatctgagaggacggtcccccacactggcactgagacacgggccagactcctgcgggaggcagcagtaggggatattggtcaatgggcgggagcctgaaccagccatgccgcgtgagggaatggggccctacgggtcgtgaacctcttttgcgcagggacaatgtgccgcacgtgatgcggcgttgagggtactgcgcgaataagcgcc

SEQ ID NO: 2987 - DNA, 490 bp, Unknown
  Ascusbbf_276993, encodes 16S rRNA
agagtttgatcatggctcaggatgaacgctggcggcgtgcctaatacatgcaagtcgaacgaggttagcaataaccgagtggcgaacgggtgagtaacacgtaggtaacctgccttacagtttgggatacccgagggaaaccttggctaataccgaataaatcttgaagaggcatctcttcgagctaaaaggggcctttaaagcctcgctgaaagatggacctgcggcgcattagctagttggtgagataacagcccaccaaggcgaggatgcgtagccgacctgagagggtgaacggccacactggaactgagacacggtccagactcctacgggaggcagcagtagggagttttcggcaatgggggaaaccctgaccgagcaacgccgcgtgaacgatgaaggtcttcggattgtaaagttctgttatcagggaagaatgatatcgtgaggaaatgctcgatgtttgacggtacctgattagaaagcc

SEQ ID NO: 2988 - DNA, 472 bp, Unknown
  Ascusbbf_87951, encodes 16S rRNA
agagtttgatcctggctcagagcgaacgctggcggcaggcttaacacatgcaagtcgaacgggcgtagcaatacgtcagtggcagacgggtgagtaacacgtgggaacgtaccctttggttcggaacaacccagggaaacttgggctaataccggatattccctcacggggaaagatttatcgccaaaggatcggcccgcgtctgattagcttgttggtgaggtaacggctcaccaaggcgacgatcagtagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcagcggggaagataatgacggtacccgcagaagaagccccggctaacttcgtgccagcagccgcggtaat

SEQ ID NO: 2989 - DNA, 490 bp, Unknown
  Ascusbbf_645672, encodes 16S rRNA
agagtttgatcctggctcaggatgaacgctagcggcaggcttaacacatgcaagtcgaggggtaacgggggtgcttgcacccgccgacgaccggcgcacgggtgagtaacgcgtacacaacctaccttttagcgggggatagcccagggaaacttggattaataccccatgttatcgattgttcacctggacgatcgatcaaacatttatggctaacagatgggtgtgcgtcccattagctagtaggtaaggcaacggcttacctaggcgacgatgggtaggggccctgagagggggatcccccacactggtactgagacacggaccagactcctacgggaggcagcagtgaggaatattggacaatgggggcaaccctgatccagccatgccgcgtgcaggaagacggccctatgggttgtaaactgcttttgtacaggaagaaacgttcccacgtgtgggaatttgacggtactgtaagaataaggat

SEQ ID NO: 2990 - DNA, 490 bp, Unknown
  Ascusbbf_1372901, encodes 16S rRNA
agagtttgatcctggctcaggatgaacgctagcggcaggcttaacacatgcaagtcgaggggcagcgcggggtagcaatactctggcggcgaccggcggaagggtgcgtaacgcgtgagcaacttgcccgtcactgggggataggcactggaaacggtgtgtaatactccataacatatggattcacatggatttatattgaaagattcgttggtgacggatgggctcgcgtaacattagctagtcggcggtgtaccggcccaccgacgctacgatgtttaggggttctgagagtaaggtcaccacgcatgaaactgagaaacggtccagaatcctacgggaggcagcagtgaggaatattggtcaatgggcggaatcctgaacaagccatgccgagtgcaggaataaggccctatgggtcgtaaactgcttttccttgagggcaataagggtcacgagtggcccgatgagagtatcaggggaataagca

SEQ ID NO: 2991 - DNA, 490 bp, Unknown
  Ascusbbf_112697, encodes 16S rRNA
agagtttgatcctggctcaggatgaacgctagcggcaggcttaacacatgcaagtcgaggggcatcgcggggtagcaatactctggcggcgaccggcgaaagggtgagtaacgcgtgagcaacatgcccggtactgggggatagtcattggaaacgatgcgtaataccccgtaacaacagagtccgcatggtctttgtttgagagattcattgataccggattggctcgcgtaccattagctagttggcggggtaacggcccaccaaggcgacgatggttaggggttctgagaggaaggtcccccacattggaactgagacacggtccagactcctacgggaggcagcagtgaggaatattggacaatggccgggaggctgatccagccatgccgcgtgcgggaggacggccctatgggttgtaaaccgcttttgtcagggagcaataaggtccacgtgtggtccgatgagagtacctggcgaataagca

SEQ ID NO: 2992 - DNA, 490 bp, Unknown
  Ascusbbf_1593851, encodes 16S rRNA
agagtttgatcctggctcaggataaacgctggcggcgcacataagacatgcaagtcgaacgaacttaacctttagtttactaatggagcggttagtggcggactggtgagtaacacgtaagcaacctgcctatcagaggggaacaacagttaaaaataactgctaataccgcatatgccttgagtaacgcatgttacaaaagggaaaggagcaatccactgataaatgggcttgcgtctgattagatagttggtggggtaacggcctaccaagtcaacgatcagtagccggactaaaaaattgaacggccacattaggactgagatacggcccagactcctacgggaggcagcagtcgggaatattgcgcaatggaggaaactctgacgcagtgacgccgcgtgcaggaagaaggttttcggattgtaaactgctttagacagggaagaacaaggacagtacctgtagaataagctccggctaactacgt

SEQ ID NO: 2993 - DNA, 490 bp, Unknown
  Ascusbbf_191687, encodes 16S rRNA
agagtttgatcctggctcaggatgaacgctagctacaggcttaacacatgcaagtcgaggggcagcatggagtttgcttgcaaactctgatggcgaccggcgcacgggtgcgtaacgcgtatccaaccttccccctactccggcacagcccgtcgaaaggcggattaactccggatggcgtgccttccccgcatgggggagccactaaagtttgacggtaggggatggggatgcgaccgattaggtagacggcggggcaacggcccaccgtgccttcgatcggtaggggttctgagaggaaggtcccccacactggaactgagacacggtccagactcctacgggaggcagcagtgaggaatattggtcaatgggcggaagcctgaaccagccaagtagcgtgcgggacgacggccctatgggttgtaaaccgcttttgattgggaacaaagagcgccacgcgtggcgcgttgcgtgtacctttcgaata

SEQ ID NO: 2994 - DNA, 490 bp, Unknown
  Ascusbbf_168372, encodes 16S rRNA
agagtttgatcatggctcaggatgaacgctagctacaggcttaacacatgcaagtcgaggggcagcatgtatctggcttgccagatatgatggcgaccggcgcacgggtgcgtaacgcgtgttcaaccttccccatactcgggaacagcccatcgaaagatggattaatgcccgatgttgtctttcaccctcctgggtgttagaccaaagattcatcggtatgggatgggaacgcgtccgattagctggacggcggggtaacggcccaccgtggcgacgatcggtaggggttctgagaggaaggtcccccacactggaactgagacacggtccagactcctacgggaggcagcagtgaggaatattggtcaatggccgcgaggctgaaccagccaagtagcgtgaaggatgactgccctatgggttgtaaacttcttttgcaggggaataacaagtcccacgtgtgggactctgcatgtaccctgcgaat

SEQ ID NO: 2995 - DNA, 490 bp, Unknown
  Ascusbbf_257759, encodes 16S rRNA
agagtttgatcatggctcaggatgaacgctggcggcgtgcctaacacatgcaagtcgagcggagataagcaccggatgaagatttatcggattccaccgcttatcttagcggcggatgggtgagtaacgcgtggataacctgccccttgcagggggataacaaccggaaacgggtgctaataccgcataggcgcgtagggccgcatggtcctaagcgtaaagatttatcggcaagggatggatccgcgtcggattaacttgttggcggggtaacggcccaccaaggtgatgatccgtagccggcctgagagggcgaccggccacattgggactgagacacggcccaaactcctacgggaggcagcagtgggggatattgcacaatggggggaaccctgatgcagcgacgccgcgtgagcgaagaagtgcttcggcatgtaaagctctatcggtggggaagaagatgacggtacccacagaagaagccccg

SEQ ID NO: 2996 - DNA, 490 bp, Unknown
  Ascusbbf_711708, encodes 16S rRNA
agagtttgatcatggctcaggacgaacgctggcggcgtgcttaacacatgcaagtcgagcggtaaggctccttcgggagtacacgagcggcgaacgggtgagtaacacgtgagcaatctacccttcacatcggaataaccccgggaaactggggctaataccggatatcacttctatgggcatccatggaagttgaaagctccggcggtgagggatgagctcgcggcctatcagcttgttggtgaggtaacggctcaccaaggcaacgacgggtagccggcctgagagggtgaccggccacactgggactgagacacggcccagactcctacgggaggcagcagtggggaatattggacaatgggcgaaagcctgatccagcaacgccgcgtgagggatgacggccttcgggttgtaaacctctttcagcagggacgaagcgcaagtgacggtacctgcagaagaagcaccggccaactacgtgccagca

SEQ ID NO: 2997 - DNA, 490 bp, Unknown
  Ascusbbf_1343591, encodes 16S rRNA
agagtttgatcctggctcaggatgaacgctagcggcaggcttaacacatgcaagtcgaggggcagcgcggggtagcaatatcctggcggcgaccggcggaagggtgcgtaacgcgtgagcaacttgcccgtcactggaggataggcactggaaacggtgtgtaatactccataacataagaattcgcatgagtttttattgaaagattcattggtgacggatgggctcgcgagacattagctagtcggcggggtaacggcacaccgaggctacgttgtctaggggttctgagaggaaggtcccaacacctgaaactggacaacggtccagcctcctacgggaggcagcagtgaggaatattggtcaatgggcggaagcctgaaccagccatgccgcgtgaaggaataaggccctatgggtcgtaaacttcttttccttgagggcaataaggatcacgagtggtccgatgagagtatcaggggaataagca

SEQ ID NO: 2998 - DNA, 490 bp, Unknown
  Ascusbbf_28432, encodes 16S rRNA
agagtttgatcatggctcagaacgaacgctggtggcgtgtcttatacatgcaagtcgagcggcgtagcaatacgtagcggcgaacgggtgagtaacgcgtaagcaatctgccccatatcaggaaatacccgtgccaacgcgcggttaatgtccaggagagtggctccccgcatggggagttgactagagattcatcggtatgggatgagcttgcgtccgattagctagttggcggggcaacggcccaccaaggcgacgatcggtagccggcctgagagggtgatcggccacattgggactgagatacggcccagactcctacgggaggcagcagtagggaatattgcacaatggggggaaccctgatgcagcaacgccacgtgtgggaagaagcatttcggtgtgtaaaccactgtcgtgagggaataaggcccagtttaggctgggattgaatgtacctcgaaaggaagcaccggcaaacttcgtgcca

SEQ ID NO: 2999 - DNA, 490 bp, Unknown
  Ascusbbf_20756, encodes 16S rRNA
agagtttgatcctggctcaggatgaacgctggcggcgtgcctaatacatgcaagtcggacgcaatgcttcggcattgagtggcgaacgggtgagtaagacataagcaacctgcccctgtgagggggataactgctggaaacggcagctaagaccgcataggcatagaggacgcatgtcgactatgttaaatatcccacgggatagcacagggatgggcttatgacgcattagccagctggtgaggtaacggctcaccagggcgacgatgcgtagccggcctgagagggtggacggccacactgggactgagacacggcccagactcctacgggaggcagcagtagggaattttcggcaatgggcgaaagcctgaccgagcaacgccgcgtgaaggaagaagtcattcgtgatgtaaacttctgttatgaaggaagaacggcagatggagggaatgccatgtgcgtgacggtacttcatgaggaagccacg

SEQ ID NO: 3000 - DNA, 489 bp, Unknown
  Ascusbbf_13545, encodes 16S rRNA
agagtttgatcatggctcagaacgaacgctggcggcaggcttaacacatgcaagttgaacgggaatgttctggtagcttgctactgggacatgagagtagcgcactggtgagtaacacgtgggaacataccttttggtgggggatagcaattggaaacgattgataataccgcataagccctaagggggaaagattaattgccgaaagattggcccgcggaagattaggtagttggtggggtaagggcctaccaagcctacgatctatagctgatctgagaggatgaacagccacattggaactgagacacggtccagactcctacgggaggcagcagtgaggaatattgggcaatggaggaaactctgacccagccatgccgcgtgagtgagaaggtcttcggattgtaaagctcttttatgcaggaagatgatgacagtactgcaagaaaaagcaccggcaaacttcgtgccagcagccgcggtaat

SEQ ID NO: 3001 - DNA, 490 bp, Unknown
  Ascusbbf_13536, encodes 16S rRNA
agagtttgatcatggctcaggatgaacgctagcgacaggcctaacacatgcaagtcgaggggcagcatggttgaagcttgcttcaactgatggcgaccggcgcacgggtgcgtaacgggtgtgcaatttgtcctataccaagggatagcccgctgaaaggcggattaatactttatgtgagtagggggggcatcctctttatttgaaacgtgagggtataggttgagcacgcttctgattagatagttggtagggtaacggcctaccaagtcgacgatcagtaggggtcctgagagggaggtcccccacattggaactgagacacggtccaaactcctacgggaggcagcagtgaggaatattggtcaatggacggaagtctgaaccagccaagtcgcgtgaaggaagacggttctatggattgtaaacttcttttggcagagggtaaagtgaggtacgtgtaccttattgcaagtatctgttgaataag

SEQ ID NO: 3002 - DNA, 490 bp, Unknown
  Ascusbbf_230158, encodes 16S rRNA
agagtttgatcatggctcaggataaacgctggcggcgcacataagacatgcaagtcgaacggaagtcgttgtaatgattttgacatgaacagagaacttgttcgaaggaattgaagattgacttacaacaatggctttagtggcggactggtgagtaacacgtaagcaacctgcctattagaggggaataacagtgagaaatcattgctaataccgcatatgccataataaccacatggttatagtgggaaaggagtaatccgctaatagatgggcttgcgtctgattagttagttggtggggtaacggcctaccaagaccgcgatcagtagccggactgagaggttcaacggccacattgggactgagatacggcccagactcctacgggaggcagcagtcgggaatattgcgcaatggaggcaactctgacgcagtgacgccgcgtataggaagaaggttttcggattgtaaactattgtcgataggg

SEQ ID NO: 3003 - DNA, 490 bp, Unknown
  Ascusbbf_153554, encodes 16S rRNA
agagtttgatcctggctcaggacgaacgctggcggcgtgcctaacacatgcaagtcgaacggagtgttgcgctgaaattgagagtagcttgctacaggaaatttcttgtaacacttagtggcggacgggtgagtaacgcgtgaggaacctgccttacagagggggacaacagttggaaacgactgctaataccgcataacgtagcgagaagacatcttcttgttaccaaaggagcaatccgctgtaagatggcctcgcgtccgattagatagttggcggggtaacggcccaccaagtcgacgatcggtagccggactgagaggttgaacggccacattgggactgagacacggcccagactcctacgggaggcagcagtgggggatattgcacaatggaggaaactctgatgcagcaacgccgcgtgagggaagaaggttttcggattgtaaacctctgtttttagtgaagaaacaaatgacggtagcta

SEQ ID NO: 3004 - DNA, 470 bp, Unknown
  Ascusbbf_409472, encodes 16S rRNA
agagtttgatcatggctcagagcgaacgctggcggcaggcttaacacatgcaagtcgagcgggcccttcggggtcagcggcggacgggtgagtaacgcgtgggaacgtgccttctggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaat

SEQ ID NO: 3005 - DNA, 490 bp, Unknown
  Ascusbbf_377634, encodes 16S rRNA
agagtttgatcatggctcaggacgaacgctggcggcgtgcctaatacatgcaagtcgagcgctggagcgtttccttcgggaaacaatccggagcggcggacgggtgagtaacacgtaggcaacctgcccgtaagactgggataactaccggaaacggtagctaataccggataggtggcttcttcgcatggagaggtcaagaaacgcggagtaatctgcggcttacggatgggcctgcggcgcattagctagttggcagggtaatggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacggcccggagggtaactactccgggagtgacggtact

SEQ ID NO: 3006 - DNA, 490 bp, Unknown
  Ascusbbf_157224, encodes 16S rRNA
agagtttgatcctggctcaggatgaacgctagcggcaggcttaacacatgcaagtcgaggggcagcgcgtggtagcaataccatggcggcgaccggcgcacgggtgcgtaacgcgtatgcaacctgcctgtaacagggggataacccggagaaatttggactaataccgcatattgccaagctgcagcattgcaatttggcgaaaggagcgatccggttacagatgggcatgcgtgacattaggtagttggcggggcaacggcccaccaagccgacgatgtctaggggaactgagaggttagtcccccacactggtactgagacacggaccagactcctacgggaggcagcagtgaggaatattggtcaatggaggaaactctgaaccagccatgccgcgtgcgggaggaaggccctacgggttgtaaaccgcttttacgggggagcaataagcgccgtgcgcggcgtgatgagagtaccccgggaataa

SEQ ID NO: 3007 - DNA, 490 bp, Unknown
  Ascusbbf_244936, encodes 16S rRNA
agagtttgatcatggctcagaacgaacgctggcggcgcgtcttaagcatgcaagtcgggcggcaaggatgtgcttgcacatccctagagcggcggactggtgagtaacgcgtgggtgacgcaccctccggacggggatagcctgcagaaatgcagggtaataccggatacggccgcacgggccggaaccgtgcggggaaaggagcttcggctccgccgggggagcggcctgcgtcccatcagcttgtaggcggtgtaacggaccacctaggcgatgacgggtacccggcctgagagggtgggcgggcacattgggactgagatacggcccagactcctacgggaggcagcagctaagaatattccgcaatgggcgaaagcctgacggagcgacgccgcgtggacgatgaaggccggaaggttgcagagtcctttggcacgcgaggaaggagcgggggagggaatgcccccgcggtgactgtagcgtgaga

SEQ ID NO: 3008 - DNA, 490 bp, Unknown
  Ascusbbf_710377, encodes 16S rRNA
agagtttgatcctggctcaggatgaacgctggcggcacgcttaacacatgcaagtcgaacggagttcagaggagcttgcttttctgaacttagtggcggacgggtgagtaacacgtgagcaatctgcctttcagagggggatagcagttggaaacgactgataataccgcataacatatactgaccgcatgatcggtatatcaaagattttatcgctgaaagatgagctcgcgtctgattagctagttggtgaggtaacggctcaccaaggcgacgatcagtagccggactgagaggttgaacggccacattgggactgagacacggcccagactcctacgggaggcagcagtggggaatattgcacaatgggcgcaagcctgatgcagcgatgccgcgtgagggaagaaggttttcggattgtaaacctctgtcttaggggacgagaaaggacggtaccctaggaggaagctccggctaactacgtgcc

SEQ ID NO: 3009 - DNA, 490 bp, Unknown
  Ascusbbf_1571467, encodes 16S rRNA
agagtttgatcatggctcaggatgaacgctggcggcgtgcctaacacattcaagtcgaacgaactgtagaaatacagtgagtggcggacgggtgagtaacgcgtaagcaacctgcctttgtgtgtggaataacaactggaaacagttgctaataccgcataacgcagagagatcgcatggtctttctgccaaagatttatcgcacaaagatgggcttgcgtccgattagatagttggcggggtaacggcccaccaagtcaacgatcggtagccggactgagaggttgaacggccacattggaactgagatacggtccagactcctacgggaggcagcagtggggaatattgggcaatggacgaaagtctgacccagcgacgccgcgtgagggaagaaggtcttcggattgtaaaccttagtcaacagggacgaagcaagtgacggtacctgtggaaagccacggctaactacgtgccagcagccgcggta

SEQ ID NO: 3010 - DNA, 490 bp, Unknown
  Ascusbbf_328511, encodes 16S rRNA
agagtttgatcctggctcaggacgaacgctggcggcgtgcctaacacatgcaagtcgagcgaggtccaaccggtggcaacaccggggaagacctagcggcgaacgggtgagtaacacgtgagaaacctgccccgaacactgggataaccaggggaaaccctggctaataccggataccccctgcagatcgcatggtcagcagtggaaagaacttcggttcgggagggtctcgcggcctatcagctagttggtggggtaacggcccaccaaggcatcgacgggtagctggtctgagaggacgatcagccacactgggactgagacacggcccagactcctacgggaggcagcagtggggaatattgcgcaatgggcgaaagcctgacgcagcaacgccgcgtgcgggatgaaggccttcgggttgtaaaccgctttcggcagggacgaaattgacggtacctgcagaagaagccccggccaactacgtgcc

SEQ ID NO: 3011 - DNA, 490 bp, Unknown
  Ascusbbf_272604, encodes 16S rRNA
agagtttgatcctggctcaggatgaacgctagcggcaggcctaatacatgcaagtcggacggtatttccctttcgggggagagagagtggcgcacgggtgcgtaacgcgtatgcaacctgccccttacagggggatagcccggggaaacccggattaataccccatgttccgtgtttccggcatcggaggtacggcaaaggcttcggccggtaagggatgggcatgcgtaggattagcttgttggcggtgtaacggaccaccaaggcgacgatccttaggggttctgagaggaaggtcccccacactggcactgagatacgggccagactcctacgggaggcagcagtagggaatattgggcaatgggcggtagcctgacccagccatgccgcgtgcaggaagacggcgttctgcgttgtaaactgcttttatacgggaagaaaaggcccatgcgtgggacattgccggtaccgtatgaataagcaccgg

SEQ ID NO: 3012 - DNA, 490 bp, Unknown
  Ascusbbf_218090, encodes 16S rRNA
agagtttgatcctggctcaggacgaacgctggcggcgtgcctaatacatgcaagtagaacgctgaaggagggagcttgcttcttctggatgagttgcgaacgggtgagtaacgcgtaggtaacctgcctgatagcgggggataactattggaaacgatagctaataccgcataagaggtaataacacatgttattggtttaaaaggggcaactgctccactatcagatggacctgcgttgtattagctagttggtaaggtaacggcttaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacggatgtgggagtggaaaatccatgtcgtgacggtatct

SEQ ID NO: 3013 - DNA, 490 bp, Unknown
  Ascusbbf_305697, encodes 16S rRNA
agagtttgatcctggctcaggacgaacgctggcggcgtgcttaaaacatgcaagtcgaacggagattttagggagcttgcttcttgaaatcttagtggcggacgggtgagtaacacgtgagcaacctgcctatcacagggggataacacttagaaataggtgctaataccgcatatgaccacagaccggcatcggtcagaggtgaaaggagttaaatctggtgatagaggggcttgcgtatcattagctagttggtgaggtaacggcccaccaaggccacgatgattagccgatctgagaggatgaccggccacattggaactgagatacggtccagactcctacgggaggcagcagttaggaatattgggcaatggaggaaactctgacccagcaacgccgcgtgaaggatgaaggttttcggattgtaaacttctgatctgtggaaagaaaaaaatgacggtaccacaggagcaagccccggctaact

SEQ ID NO: 3014 - DNA, 490 bp, Unknown
  Ascusbbf_399798, encodes 16S rRNA
agagtttgatcatggctcaggacgaacgctggcggcgtgcttaacacatgcaagtcgagcggggacaatggaagagcttgctcggaaattgttctagcggcggacgggtgagtaacgcgtgagcaatctgtcccagacagggggataacagatggaaacatctgctaataccgcataagaccactttctggcatcaggaaggggtaaaaggaggaatccggtttggggtgagctcgcgtccgattagctagttggcgaggtaacggcccaccaaggcgacgatcggtagccgacctgagagggtgaacggccacattggaactgagaaacggtccaaactcctacgggaggcagcagtggggaatattgggcaatgggcgaaagcctgacccagcaacgccgcgtgagggaagaaggttttcggattgtaaacctctatcgtggaggacgaaggaagtgacggtactccacaaggaagccccggctaact

SEQ ID NO: 3015 - DNA, 490 bp, Unknown
  Ascusbbf_386603, encodes 16S rRNA
agagtttgatcctggctcaggatgaacgctagcggcaggcttaacacatgcaagtcgaggggcagcgggtccagcaatggatgccggcgaccggcgcaagggtgcgtaacgcgtgagcgacatgcccgtgaccgggggataaccgatggaaacgtcgcctaatcccgcataacacattcagctgcatggctgaatgttgaaaactcaggtggtcacggattggctcgcgtatcattagctagtcggcggggtaacggcccaccgaggctacgatgattaggggttctgagaggaaggtcccccacaatggaactgagacacggtccatactcctacgggaggcagcagtgaggaatattggtcaatgggcggaagcctgaaccagccatgccgcgtgcgggatgacggccctatgggttgtaaaccgcttttgagagggagcaataaggatctcgagcaggtctgatgagagtacctttcgaataagcat

SEQ ID NO: 3016 - DNA, 490 bp, Unknown
  Ascusbbf_231704, encodes 16S rRNA
agagtttgatcctggctcaggacgaacgctggcggcgtgcctaacacatgcaagtcgaacgaggtatatttttcggaatatacttagtggcggacgggtgagtaacgcgtgaacaatctgccctgtacaaaggaatagcctcgggaaaccgggattaaaaccgtataacactttagtatcgcatgatacagaagtcaaatatttataggtatgggatgagttcgcgtctgattagctagttggtaaggtaatggcttaccaaggcgacgatcagtagccggcctgagagggtgaacggccacactggaactgagacacggtccagactcctacgggaggcagcagtggggaatattgcacaatggaggaaactctgatgcagcgacgccgcgtgagtgaagaaggtcttcggatcgtaaaactctgtccttggtgaagataatgacggtagccaaggaggaagccccggctaactacgtgccagcagccg

SEQ ID NO: 3017 - DNA, 490 bp, Unknown
  Ascusbbf_318947, encodes 16S rRNA
agagtttgatcatggctcaggatcaacgctggcggcgtgcctaatgcatgcaagtcgaacggggtgaccttcgggtcactcacgtggcggacgggtgaggaacacgtgggtaacctgcccagtggtggggggtagccctcggaaacgaggggtaattccgcatacgcttgctgaccttgtggggtgagtaaggaaaggccttcgggtcgccactggaggggcctgcgaccgattagctagctggtggggtaatggcctaccagggcgacgatcggtagctggtttgaggggatgatcagccacacggggactgagacacggccccgactcctacgggaggcagcagcaaggaattttccgcaatgggcgaaagcctgacggagcaacgccgcgtgcgggatgacgcttttcggagtgtaaaccgctgttcatggggacgaagcactgacggtacccatggaggaaggcccggctaactacgtgccagcag

SEQ ID NO: 3018 - DNA, 490 bp, Unknown
  Ascusbbf_990593, encodes 16S rRNA
agagtttgatcctggctcagattgaacgctggcggcatgcttaacacatgcaagtcgaacggcagcactatttagtttactagagaggtggcgagtggcgaacgggtgagtaacgcgtaggaatataccttgaagagtgggacaacttggggaaactcaagctaataccgcatatactctacggaggaaagctggggaccgcaaggcctggcgctttaagaatagcctgcgtccgattagctagttggtggggtaaaggcctaccaaggcgacgatcggtagctggtctgagaggatgatcagccacactggaactgagacacggtccagactcctacgggaggcagcagtggggaatattggacaatggggggaaccctgatccagcaatgccgcgtgtgtgaagaaggcctgagggttgtaaagcactttcggtggggaggaggttatataggttaagagctaatatgatggacgttacccacataag

SEQ ID NO: 3019 - DNA, 490 bp, Unknown
  Ascusbbf_23869, encodes 16S rRNA
agagtttgatcatggctcaggacgaacgctggcggcgtgcttaacacatgcaagtcgaacgaggttaatgtgaggaagtcttcggatggaatcgtgttaaccgagtggcggacgggtgagtaacgcgtgagcaacctgtcttctacagggggataacactccgaaaggagcgctaataccgcataagaccacggtttcgcatgggactgaggtcaaaggagcaatccggtagaaggtgggctcgcgtcccattagatagttggtgaggtaacggctcaccaagtcgacgatgggtagccgacctgagagggtgatcggccacattggaactgagatacggtccagactcctacgggaggcagcagtggggaatattgggcaatgggcgaaagcctgacccagcaacgccgcgtgagggaagaaggtcttcgggttgtaaacctctgtccttggtgaaaaggaaggatggtagccaaggaggaagccccgg

SEQ ID NO: 3020 - DNA, 490 bp, Unknown
  Ascusbbf_67816, encodes 16S rRNA
agagtttgatcatggctcaggacgaacgctggcggtgtgcctcatacatgcaagtcgaacgataaggttccttcgggaatacataagtggcggacgggtgagtacaacataggaaatctgccctaaagcgggggacaacagagggaaacttctgctaataccccatatgagcttagttgaaatactaatcttgaaagatttatcactttaggatgagcctgtgcctgattagctagttggtggtgtaatggactaccaaggcgacgatcagtagctggtttgagaggatgatcagccacaatgggactgagacacggcccatactcctacgggaggcagcagtagggaattttgcgcaatgggggaaaccctgacgcagcaacaccgcgtgaatgttaagcccttcggggtgtaaagttctgtcagtagggaagaacaaatgactgtacctacaaaggaagcaccggctaactccgtgccagcagccgcg

SEQ ID NO: 3021 - DNA, 490 bp, Unknown
  Ascusbbf_354237, encodes 16S rRNA
agagtttgatcatggctcaggacgaacgctggcggcgtgcctaatacatgcaagtcgagcgcttgcacaagaaagcttgctttcttgttgcttgagcggcggacgggtgagtaacacgtgggcaacctgcctataagactgggataacttcgggaaaccggagctaataccggataatgcttttgaacacatgttcgaaagcggaaagatggtttcggctatcacttatagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatcggagtaactgccggtaccttgacggt

SEQ ID NO: 3022 - DNA, 490 bp, Unknown
  Ascusbbf_370049, encodes 16S rRNA
agagtttgatcctggctcaggatgaacgctggcggcgtgcctaacacatgcaagtcgaacggagtaccaccggactgagattcgtcgaaggaaggtgactacttagtggcggacgggtgagtaacgcgtgggtaacctgcctcatagagggggacaacagttggaaacgattgctaataccgcataagcccccggtaccgcatggtacagagggaaaagattcatcgctatgagatggacccgcgttagattagccagttggcggggtaacggcccaccaaagcaacgatctatagccggactgagaggttgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaaaggacggtacctgactaagaagccccggc

SEQ ID NO: 3023 - DNA, 467 bp, Unknown
  Ascusbbf_636902, encodes 16S rRNA
agatttgatcctggctcagaacgaacgctggcggcaggcttaacacatgcaagtcgagcgccccgcaaggggagcggcagacgggtgagtaacgcgtgggaatctaccttttgctacggaataactcagggaaacttgtgctaataccgtatgtgtccttcgggagaaagatttatcggcaagagatgagcccgcgttggattagctagttggtggggtaaagtcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgacggtcttaggattgtaaagctctttcaccggtgaagataatgacggtaaccggagaagaagccccggctaacttcgtgccagcagccgcggtaat

SEQ ID NO: 3024 - DNA, 490 bp, Unknown
  Ascusbbf_1808403, encodes 16S rRNA
agagtttgatcatggctcagaacgaacgctggcggcgcgttttaagcatgcaagtcgagcggtagcagcaatgcgagagcggcggacgggtgagtaacacgtgggtaatctgccctccggtcgggaatagcctgtggaaacacaagataataccggatgcgatggtttttgcacaagcagagatcaggaaaggagccaaggctccgccggaggatgagcccgcgtcccattagctagatggtgaggtaaaggcccaccatggcgatgggtagccggcctgagagggtgaacggccacattggaactgagacacggtccagactcctacgggaggcagcagctaagaatcttccacaatggacgaaagtctgatggagcgacgccgcgtgggcgatgaaggccgtgaggttgtaaagcccttttcttgagggggaataaagcgggcagggaatggcccgctgatgacgtgaatcaaggaataagccccggc

SEQ ID NO: 3025 - DNA, 490 bp, Unknown
  Ascusbbf_18857, encodes 16S rRNA
agagtttgatcatggctcagaacgaacgctggcggcgcgtcttaagcatgcaagtcgaacggcaagatggtagcttgctactatcctagagtggcggactggtgagtaacacgtgggtgacgtacccttcagacggggatagctggtagaaatatcagataataccggatacgattctgcaggttagagctgcagaaggaaaggagctatggcttcgctgaaggaacggcctgcgacccatcagctggttggtgaggtaaaggcccaccaaggcaatgacgggtatccggccttagagggtgaacggacacattgggactgagatacggcccagactcctacgggaggcagcagctaagaatattccgcaatggacgaaagtctgacggagcgacgccgcgtggatgatgaaggccggaaggttgtaaaatccttttaaaaccgaggaataagctaaagagggaatgctttagcggtgactgtaagtttt

SEQ ID NO: 3026 - DNA, 490 bp, Unknown
  Ascusbbf_1203367, encodes 16S rRNA
agagtttgatcctggctcaggacgaacgctggcggcgtgcctaacacatgcaagtcgtacgagaatttagcgaaagattccttcgggatgaaattattagaggaaagtggcggacgggcgagtaacgcgtgaataacctgcccataagagggggataatccgtggaaacgcggactaataccgcatattgagtaataaccgcatggtaaatacttgaaagatttatcgcttatggatggattcgcgtcagattagatagttggagaggtaacggctcaccaagtcaacgatctgtagccgaactgagaggttgatcggccgcattgggactgagacacggcccagactcctacgggaggcagcagtggggaatattgcgcaatggggggaaccctgacgcagcaacgccgcgtgcaggaagaaggtcttcggattgtaaactgttgtcgcaagggaagaaaaagatgacggtaccttgtgagaaagtcac

SEQ ID NO: 3027 - DNA, 490 bp, Unknown
  Ascusbbf_73690, encodes 16S rRNA
agagtttgatcctggctcaggacgaacgctggcggcatgcctaacacatgcaagtcgaacggagtttttcccttcgggggaagacttagtggcgaacgggtgagtaacgcgtgagcaacctgccttggcgagggggataacacttggaaacaggtgctaataccgcataagaccacacttccgcatgggagaggggtcaaaggagcaatccgcgctgagaggggctcgcgtcccattaggtagatggcggggcaacggcccaccatgccgacgatgggtagccgagctgagaggctgatcggccacactggaactgagacacggtccagactcctacgggaggcagcagtggggaatattgggcaatgggcgaaagcctgacccagcaatgccgcgtgagggatgaaggtcttcggattgtaaacctctgtccttggtgacgaaggaagtgacggtagccaaggaggaagccccggctaactacgtgcca

SEQ ID NO: 3028 - DNA, 490 bp, Unknown
  Ascusbbf_32640, encodes 16S rRNA
agagtttgatcatggctcaggatgaacgctggcggcgtgcttaacacatgcaagtcgaacgaagcatttatctttgatgttttcggactgaaaagatttatgacttagtggcggacgggtgagtaacgcgtgggcaacctgccgtatgcagggggacaacagttggaaacgactgctaataccgcataagcgcacactggcacatgccggagtgtgaaaagatttatcggcatacgatgggcccgcgttggattaggttgttggtgaggtaacggcccaccaagcctacgatccatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgcataagaagccccgg

SEQ ID NO: 3029 - DNA, 490 bp, Unknown
  Ascusbbf_45536, encodes 16S rRNA
agagtttgatcctggctcaggatgaacgctggcggcgtgcttaacacatgcaagtcgaacggggaagcataacggaagttttcggatggaagatatgctttctagtggcggacgggtgagtaacgcgtaaacaatctgccttgaagagggggataacagatagaaatatttgctaataccgcataagaccacagtggggcatcccacaggggtcaaaggagcaatccgcttcaagatgagtttgcgtactattagctagttggtgaggtaacggcccaccaaggcaacgatggttagccggcctgagagggtgaacggccacattggaactgagatacggtccagactcctacgggaggcagcagtgaggaatattgggcaatgggcgaaagcctgacccagcaacgccgcgtggaggaagaaggtcttcggattgtaaacttctgttatgggggaaaaagaaagtgatggtaccccatgagaaagctac

SEQ ID NO: 3030 - DNA, 490 bp, Unknown
  Ascusbbf_923547, encodes 16S rRNA
agagtttgatcatggctcaggatgaacgctggcggcgtgcctaacacatgcaagtcgaacggagatcatttggaaataagcttcggcagaaagaaggatgatcttagtggcggacgggtgagtaacgcgtggagaacctgccctgtacagggggataacatccagaaatggatgctaaaaccgcataagcgcacagagtcgcatgactcagtgtgaaaaactccggtggtacaggatggctccgcgttggattagccagttggcggggtaacggcccaccaaagcgacgatccatagccggcctgagagggtggacggccacattgggactgagacacggcccagactcctacgggaggcagcagtggggaatattgcacaatggggggaaccctgatgcagcgacgccgcgtgaaggaagaagtatttcggtatgtaaacttctatcagcagggaagaaaatgacggtacctgactaagaagccccggc

SEQ ID NO: 3031 - DNA, 490 bp, Unknown
  Ascusbbf_602323, encodes 16S rRNA
agagtttgatcatggctcaggacgaacgctagcggcgtgcttcatacatgcaagtcgaacgagaatccggtgcttgcaccggaggaaagtggcggacgggtgagtaaaatgtagagaatctgccttcaagcgggggatagcagttggaaacgactattaataccccatatgcgcgtagctgagatgctattcgtgaaaattccggtgcttggagatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgatcgagacgcccttcggggtgtaaagatctgtcagtggggacgaacgatgacggtacccacagaggaagcaccggctaactccgtgccagcagccgc

SEQ ID NO: 3032 - DNA, 490 bp, Unknown
  Ascusbbf_1486622, encodes 16S rRNA
agagtttgatcctggctcaggatgaacgctggcggcgtgcgtaacacatgcaagttgagcgacgacgtgcttgaagtggcgacatggagggcgcgagcggagcagcggacgggtgagtacaacatgagaagctgtcctgtggcgggggacaacgtctagaaatggacgctaataccccatagtccgagaggttaaagcagcaatgcaccacaggaggcgctcgtgccctatcagctagttggcgaggtaacggctcaccaaggcgacgacgggtagccggcctgagagggtgtccggccacactgggactgagatacggcccagactcctacgggaggcagcagtggggaatattgggcaatgggagaaatcctgacctagcgacgccgcgtgaacgaagaaggccttcgggtcgtaaagttcttttatgcgggaagaaggaagtgacggtaccgcatgaataagccccggctaactacgtgccagcagc

SEQ ID NO: 3033 - DNA, 490 bp, Unknown
  Ascusbbf_292557, encodes 16S rRNA
agagtttgatcctggctcagagcgaacgctagcggaatgctttatacatgcaagtcgaacgaatgagtttatattgagtagcaatacgatttataaatgagttagtggcgaacgggtgagtaatagataggaacttgccgagtagtgggggacaacagatagaaatgtctgctaataccgcatacgcccgagaggggaaagatttatcgctatttgagaggcctattcacgattagcttgttggtgagataaaagcccaccaaggcgacgatcgttagccggtcttagaggacgatcggccacattgggactgagacacggcccagactcctacgggaggcagcagtagggaatattggacaatggaggcaactctgatccagcaattccgcgtgagtgatgaaggtgttatgcattgtaaaactcttttgcctgtgaagataatgacggtaacaggagaataagcaccgactaactatgtgccagcagc

SEQ ID NO: 3034 - DNA, 490 bp, Unknown
  Ascusbbf_344479, encodes 16S rRNA
agagtttgatcctggctcaggacgaacgctggcggcgtgcctaacacatgcaagtcgaacgggggagtggagcttgctccacttcttagtggcggacgggtgagtaacgcgtgagcaacctgcctatcagagggggatagcctggggaaacctaggataataccgcatataatatagtgattgcatgattgctatatgaaaggagtaatccgctgatagatgggctcgcgtccgattagccagttggtgaggtaacggctcaccaaagcgacgatcggtaaccgggctgagaggctgaacggtcacattggaactgagacacggtccagactcctacgggaggcagcagtgggggatattgcacaatggggggaaccctgatgcagcaacgccgcgtgagggaagaaggttttcggattgtaaacctctgtccttagagaagaaaagaatgacggtatctgaggaggaagctccggctaactacgtgcca

SEQ ID NO: 3035 - DNA, 490 bp, Unknown
  Ascusbbf_1456659, encodes 16S rRNA
agagtttgatcatggctcaggacgaacgctggcggcacgcctaacacatgcaagtcgaacggacgagagagagcttgctctttcaagttagtggcggacgggtgagtaacacgtgagcaacctacctttaagagagggatagcttctggaaacggatggtaataccacataacacattgataccgcatgatattagtgtcaaagatttatcgcttagagatgggctcgcgtctgattagatagttggtgaggtaacggctcaccaagtcgacgatcagtagccggactgagaggttgaacggccacattgggactgagacacggcccagactcctacgggaggcagcagtggggagtattgcacaatgggggaaaccccggtgcagcgatgccgcgtggaggaagaaggttttcggattgtaaactccttttgtcagggaagataatgactgtacctgacgaataagctccggctaactacgtgccagca

SEQ ID NO: 3036 - DNA, 490 bp, Unknown
  Ascusbbf_285476, encodes 16S rRNA
agagtttgatcatggctcaggacgaacgctggcggcgcgcttaaaacatgcaagtcgaacggagtcttttggattcgtctgaaagacttagtggcgaacgggtgagtaacacgtgaggaacctgccctttacagggggataacacttagaaataggtgctaataccgcataagaccacagaaccgcatggttccggggtcaaaggagcaatccggtaaaggatggcctcgcgtccgattagctggttggcggggtaacggcccaccaaggcgacgatcggtagccggactgagaggttggacggccacattgggactgagacacggcccagactcctacgggaggcagcagttgggaatattgcacaatgggcgaaagcctgatgcagcgacgccgcgtgagggaagaaggttttcggattgtaaacctctgttccgggggacgaagaaatgacggtaccctggaaggaagctacggctaactacgtgcc

SEQ ID NO: 3037 - DNA, 490 bp, Unknown
  Ascusbbf_443772, encodes 16S rRNA
agagtttgatcatggctcagattgaacgctggcggcaggcctaacacatgcaagtcgagcggcagcgggaaagtagcttgctacttttgccggcgagcggcggacgggtgagtaatgcctgggaaattgcccagtcgagggggataacagttggaaacgactgctaataccgcatacgccctacgggggaaagcaggggaccttcgggccttgcgcgattggatatgcccaggtgggattagctagttggtgaggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggtcagtagctaatacctgctggctgtgacgttactcgcaga

SEQ ID NO: 3038 - DNA, 490 bp, Unknown
  Ascusbbf_762264, encodes 16S rRNA
agagtttgatcctggctcagaacgaacgctggtggcgtgttttatacatgcaagtcgagcgaggacagtagcttgctactgagccgagcggcgaacgggtgagtaacgcgtaagcaatctgccccacaatcgggaacaaccgtgccaacgcgcggctaatgccggatattgtgtcctactgcatagtaggttaacgaaagatttatcgttgtgggatgagcttgcgtccgattagctagttggcggggtaatagcccaccaaggcgacgatcggtagccggcctgagagggtgatcggccacattgggactgagatacggcccagactcctacgggaggcagcagtagggaatattgcgcaatggggggaaccctgacgcagcaacgccacgtgtgggaagaagcatttcggtgtgtaaaccactgtcggaaaggaataacggaagacttcggtctttatgaatgtacttttagaggaagcaccggcaaa

SEQ ID NO: 3039 - DNA, 490 bp, Unknown
  Ascusbbf_1103137, encodes 16S rRNA
agagtttgatcatggctcaggatgaacgctagcgacaggcttaacacatgcaagtcgaggggcagcgtggcggcagcaatgccgccgacggcgaccggcgcactggtgagtaacacgtatgcaacctgccccccacagggggacaatccagagaaatttggtctaataccgcataagaggccgaggggcatcccccggccttgaaagctaatttgcggtgggggatgggcatgcggcgcattagctggttggcggggtgacggcccaccaaggcgacgatgcgtaggggttctgagaggaaggtcccccacactggtactgagacacggaccagactcctacgggaggcagcagtgaggaatattggtcaatggacggaagtctgaaccagccaagtcgcgtgagggaggaaggtccttcggattgtaaacctcttttgccggggagtaaccgggcggacttgtccgtccctgagagtacccggagaaaa

SEQ ID NO: 3040 - DNA, 490 bp, Unknown
  Ascusbbf_12979, encodes 16S rRNA
agagtttgatcatggctcaggacgaacgctggcggcgtgcttaacacatgcaagtcgaacgaggatcaaggagagcttgcttgaattgattcgagtggcggacgggtgagtaacgcgtgaacaatctgtctcacacaggggaataacgcatcgaaagatgtgctaataccgcataggaccacggtttcgcatgggactgaggtgaaaggagcaatccggtgtgaggtgagttcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgcaagcctgacccagcaacgccgcgtgaaggaagaaggttttcggatcgtaaacttctgtccttggtgaagaggagtagacggtagccaaggaggaagccccggctaactacg

SEQ ID NO: 3041 - DNA, 490 bp, Unknown
  Ascusbbf_24084, encodes 16S rRNA
agagtttgatcatggctcaggacgaacgctggcggcgtgcttcatacatgcaagtcgaacgagaagccgacttcggttggtagaaagtggcggacgggtgagtaaaatgtagagaatctgcctcaaagtgggggacaacagagggaaacttctgctaataccgcatatgcgcgtagttgagatgctattcgtgaaaactccggtgctttgagatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatgggggaaaccctgacgcagcaacgccgcgtgaacgatgaagcccttcggggtgtaaagttctgtcagtggggacgaaacttgacggtacccacagaggaagcaccggctaactccgtgccagcagccgcg

SEQ ID NO: 3042 - DNA, 490 bp, Unknown
  Ascusbbf_170480, encodes 16S rRNA
agagtttgatcatggctcaggatgaacgctggcggcgtgcctaacacatgcaagtcgagcgggaaatcctcaaagaaagcttcggcagactgagaggatggatagcggcggacgggtgagtaacgcgtaggtaagctgccccatgcacagggatagcctcgggaaactgggattaatacctgatgacaccgcgcattcacatggatatgcggtcaaagatttatcggcatgggatgcacctgcgtctgattagctagttggcagggtaacggcctaccaaggcaacgatcagtagccgacctgagagggtaatcggccacattggaactgagacacggtccaaactcctacgggaggcagcagtggggaatattgcacaatgggcgcaagcctgatgcagcaacgccgcgtgagcgatgaaggtcttcggatcgtaaagctctgtccttggggacgaaggaagtgacggtacccaaggaggaagccccgg

SEQ ID NO: 3043 - DNA, 490 bp, Unknown
  Ascusbbf_1373486, encodes 16S rRNA
agagtttgatcatggctcagaacgaacgctggcggcatggattaggcatgcaagtcgtgcgcgaaagcggccttcgggctgttagtagagcggcgaactggtgagtacaaggtgactaacctgcccttaagtgggggataacttccggaaacgggagctaataccgcatggtctctgcgatttacggattgtcgagtaaagcatttatgcgcttaaggatggggtcaccccccattagctagttggtagggtaacggcctaccaaggctacgatgggtagctggactgagaggttggccagccacactgggactgagatacggcccagactcctacggggggcagcagtctagaggcttcgacaatgcccgaaagggtgatcgagcgatgccgcgtgcgggatgaaggtcttcggattgtaaaccgcttttatctgggaagaacgcctgtctcgtgaagataggtttgacggtaccagaggaataagccc

SEQ ID NO: 3044 - DNA, 490 bp, Unknown
  Ascusbbf_176731, encodes 16S rRNA
agagtttgatcctggctcaggatcaacgctggcggcgtgcctaatgcatgcaagtcgaacggggtcaccttcgggtggctcacgtggcggacgggtgaggaacacgtggggaatctgccgcacgctcgggggtagcccgcggaaacgcggggtaattccggatggactgggggcccgggtaggggtcgtcaggaaaggccttcgggtcggcgtgtgaggagcctgcgtccgattagctggttggtggggtaacggcctaccaaggcgatgatcggtagctggtctgagaggatgatcagccacacggggactgagacacggccccgactcctacgggaggcagcagcaaggaattttccgcaatgggcgcaagcctgacggagcaacgccgcgtgcgggatgacgcctttcggggtgtaaaccgctgttcgtggggacgaagcactgacggtacccacggaggaaggcccggctaactacgtgccagcag

SEQ ID NO: 3045 - DNA, 490 bp, Unknown
  Ascusbbf_78188, encodes 16S rRNA
agagtttgatcctggctcagattgaacgctggcggcaggcttaacacatgcaagtcgagcggatgaaagtagcttgctactgaattcagcggcggacgggtgagtaatgcttaggaatctgcccattaatgggggacaacagttggaaacgactgctaataccgcatacgccctacgggggaaagcaggggatcttcggaccttgcgttaatggatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgaaagcctgatccagccatgccgcgtgtgtgaagaaggccttttggttgtaaagcactttaagcgaggaggaggctccctagattaatactctaggtgagtggacgttactcgcagaataagca

SEQ ID NO: 3046 - DNA, 490 bp, Unknown
  Ascusbbf_49738, encodes 16S rRNA
agagtttgatcatggctcaggattaacgctggcggcgtgcctaatacatgcaagtcgaatggtagtagcaatacaaaccatggcgaacgggtgagtaacacgtaggcaacctgactttaagacgaggataaccgttggaaacgacggataatactggataggacatcggaaggggcatccctggatgtttaaagattataatgtcacttagagaggggcctgcggcgcattagctagttggtgagataacagcccaccaaggcgatgatgcgtagccggactgagaggttgaacggccacaatggaactgagaacggtccatactcctacgggaggcagcagtagggaattttcggcaatgggcgcaagcctgaccgagcaacgccgcgtgaacgaagaagttattcgtaatgtaaagttcttttatctgggaagaaaaaacaaattgacggtaccagatgaataagctccggctaactacgtgccagca

SEQ ID NO: 3047 - DNA, 490 bp, Unknown
  Ascusbbf_62241, encodes 16S rRNA
agagtttgatcatggctcaggatgaacgctggcggcgtgcttaacacatgcaagtcgaacgaagcacctttaaccgaagattgacgtagcttgctactgattgattcatcttaaggtgactgagtggcggacgggtgagtaacgcgtgggtaacctaccctatacagggggataacagttggaaacgactgctaataccgcataagcgcacagtatcgcatgatacagtgtgaaaaactccggtggtataggatggacccgcgtctgattagctagttggtgaggtaacggctcaccaaggcaacgatcagtagccgacctgagagggtgaccggccacattgggactgagacacggcccaaactcctacgggaggcagcagtggggaatattgcacaatgggcgaaagcctgatgcagcgacgccgcgtgaacgatgaagtatttcggtatgtaaagttctatcagcagggaagaataatgacggtacc

SEQ ID NO: 3048 - DNA, 490 bp, Unknown
  Ascusbbf_1485057, encodes 16S rRNA
agagtttgatcctggctcaggatgaacgctagcgacaggcttaacacatgcaagtcgaggggcagcgggtcagagtgcttgcactttgatgccggcgaccggcgcacgggtgagtaacacgtatgcaacctgcccgggacagacggataaccggaagaaattccgactaatacggcatgacaccccgaggggacatccccttggagttaaaggaagtaattccggtcccggatgggcatgcggcgcattaggcagttggcggggtaacggcccaccaaaccgacgatgcgtaggggttctgagaggaaggtcccccacattggaactgagacacggtccaaactcctacgggaggcagcagtgaggaatattggtcaatggccggaaggctgaaccagccaagtcgcgtgagggactaaggccctacgggtcgtaaacctcttttgtcggggagcaatgggtgacttgcgagtcatcagggagagtaccc

SEQ ID NO: 3049 - DNA, 490 bp, Unknown
  Ascusbbf_301606, encodes 16S rRNA
agagtttgatcctggctcaggatgaacgctggcggcgtgcctaacacatgcaagtcgaacggactttaaattgaatgagacttcggttgaaggaaatttaaagttagtggcggacgggtgagtaacgcgtggagaacctgccctgtacagggggataacaaccagaaatggctgctaaaaccgcataagcgcacagtaccgcatggtacagtgtgaaaaactccggtggtacaggatggctccgcgttggattagccagttggcggggtaacggcccaccaaagcgacgatccatagccggcctgagagggtggacggccacattgggactgagacacggcccagactcctacgggaggcagcagtggggaatattgcacaatggggggaaccctgatgcagcgacgccgcgtgaaggaagaagtatctcggtatgtaaacttctatcagcagggaagaaaatgacggtacctgactaagaagccccggc

SEQ ID NO: 3050 - DNA, 490 bp, Unknown
  Ascusbbf_192983, encodes 16S rRNA
agagtttgatcatggctcaggatgaacgctggcggcgtgcttaacacatgcaagtcgaacgattaacccgccttcgggcggtcatagagtggcgaacgggtgagtaacacgtgaccaacctgccccatgccccgggacaaccgctggaaacggcggctaataccggatactccggcgaggccccatggccccgccgggaaagcccaggcggcatgggatggggtcgcggcccatcaggtagtaggcggggcgacggcccacctagccgacgacgggtagccgggttgagagaccgaccggccacattgggactgagatacggcccagactcctacgggaggcagcagtggggaattttgcgcaatggggggaaccctgacgcagcaacgccgcgtgcgggacgaaggccttcgggttgtaaaccgctttcagcagggaagacatcgacggtacctgcagaagaagccccggctaaatacgtgccagcagc

SEQ ID NO: 3051 - DNA, 490 bp, Unknown
  Ascusbbf_294019, encodes 16S rRNA
agagtttgatcctggctcaggataaacgctggcggcgcacataagacatgcaagtcgaacggaagtcgttgtaatgaaatggacatgaacagagaacttgttcaaagtgattgaaaatagacttacaacaatggctttagtggcggactggtgagtaacacgtaagcaacctgcctatcagaggggaataacagcgagaaatcgttgctaataccgcatatgccataggtaccacatggtactagtgggaaaggagcaatccgctgatagatgggcttgcgtctgattagttagttggtggggtaacggcctaccaagaccgcgatcagtagccggactgagaggttggacggccacattgggactgagatacggcccagactcctacgggaggcagcagtcgggaatattgcgcaatggaggaaactctgacgcagtgacgccgcgtataggaagaaggttttcggattgtaaactattgtcgataggg

SEQ ID NO: 3052 - DNA, 490 bp, Unknown
  Ascusbbf_184137, encodes 16S rRNA
agagtttgatcatggctcaggatgaacgctggcggcgtgcctaacacatgcaagtcgagcgggaagtctttgattgaaacttcggtcgaaagatgagatggatagcggcggacgggtgagtaacgcgtaggtaacctgccccttacacagggatagcccggggaaacctggattaatacctgataatgcggtgaagtcacatggctttaccgccaaagatttatcggtgagggatggacctgcgtctgattagccagttggtggggtaacggcctaccaaagcgacgatcagtagccgacctgagagggtaatcggccacattggaactgagacacggtccaaactcctacgggaggcagcagtggggaatattgcacaatgggcgcaagcctgatgcagcaacgccgcgtgagcgatgaaggtcttcggattgtaaagctctgtccttgaggacgaaaattgacggtactcttggaggaagccccggct

SEQ ID NO: 3053 - DNA, 490 bp, Unknown
  Ascusbbf_145261, encodes 16S rRNA
agagtttgatcatggctcaggacgaacgctggcggcgcgcttaacacatgcaagtcgtacggggcccttcggggttcagtggcgaacgggtgcgtaacacgtgagtgacctgccctggcacgggggataacccggggaaacccgggctaataccgcatgcgctctgcgggcttatggcctgtggaggaaaggtgctgaaaggcactgtgcttggaggggctcgcggcgtatcaggtagttggtgaggtaatggctcaccaagcctacgacgcgtagggggtctgagaggatgaccccccacattgggactgagatacggcccagactcctacgggaggcagcagtggggaatcttgcgcaatggccgaaaggctgacgcagcgacgccgcgtgcgggatgacgcttttcggagtgtaaaccgctgtcgggtgggacgaaggtcccgggaaggaaatgtcctggggatgacggtaccaccagaggaagcac

SEQ ID NO: 3054 - DNA, 490 bp, Unknown
  Ascusbbf_332436, encodes 16S rRNA
agagtttgatcctggctcagattgaacgctggcggcatgctttacacatgcaagtcggacggcagcgggggagtgcttgcacttctgccggcgagtggcgaacgggtgagtaatacatcggaacgtaccgggtagtgggggataactgatcgaaagatcagctaataccgcatacgctttgagaaggaaagcgggggatcttcggacctcgcgctatccgagcggccgatgtctgattaggtagttggtggggtaaaggcctaccaagccgacgatcagtagcgggtctgagaggatgatccgccacactgggactgagacacggcccagactcctacgggaggcagcagtggggaattttggacaatgggggcaaccctgatccagccatgccgcgtgtctgaagaaggccttcgggttgtaaaggacttttgtcagggaagaaaaggaaggggctaatatcccgttctgatgacggtacctgaagaat

SEQ ID NO: 3055 - DNA, 490 bp, Unknown
  Ascusbbf_1890422, encodes 16S rRNA
agagtttgatcatggctcaggacgaacgctggcggcgcgcctaacacatgcaagtcgaacggagctgagaggagcttgcttttcttagcttagtggcgaacgggtgagtaacgcgtgagtaacctgccctggagtgggggacaacagttggaaacgactgctaataccgcataagcccacggcccggcatcgggctgcgggaaaaggatttattcgctccaggatggactcgcgtccaattagctagttggtgaggtaacggcccaccaaggcgacgattggtagccggactgagaggttgaacggccacattgggactgagacacggcccagactcctacgggaggcagcagtgggggatattgcacaatgggggaaaccctgatgcagcgacgccgcgtggaggaagaaggttttcggattgtaaactcctgtcgttagggacgataatgacggtacctaacaagaaagcaccggctaactacgtgcc

SEQ ID NO: 3056 - DNA, 490 bp, Unknown
  Ascusbbf_1484321, encodes 16S rRNA
agagtttgatcatggctcaggacgaacgctggcggcgtgcctaacacatgcaagtcgagcggagaatgcggatatgtttacatagaagtattcttagcggcggacgggtgagtaacacgtgggtaacctgcctcaaagtgggggatagccttccgaaaggaagattaataccgcataagcctacagtatcgcatggtacagtaggaaaaggagcaatccgctttgagatggacccgcggcgcattagctagttggtgaggtaacggctcaccaaggcgacgatgcgtagccgacctgagagggtgatcggccacattggaactgagacacggtccagactcctacgggaggcagcagtggggaatattgcacaatgggcgaaagcctgatgcagcaacgccgcgtgagtgatgaaggccttcgggtcgtaaagctctttgatcagggatgataatgacagtacctgaaaaacaagccacggctaactacg

SEQ ID NO: 3057 - DNA, 490 bp, Unknown
  Ascusbbf_1460857, encodes 16S rRNA
agagttgatcatggctcaggatgaacgctggcggcgtgcttaacacatgcaagtcgagcgaggcttgtcaacggatgttttcggattgaagatgatgagacctagtggcggacgggtgagtaacgcgtggggaacctgccccattccgggggataccagttggaaacgactgttaataccgcataagcgcacagcaccgcatggtggagtgtgaaaaactgaggtggaacgggatggccccgcgtctgattagccagttggcagggtaacggcctaccaaagcgacgatcagtagccggcctgagagggcgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaagatgacggtacctgcacaagaagccccggcta

SEQ ID NO: 3058 - DNA, 490 bp, Unknown
  Ascusbbf_751336, encodes 16S rRNA
agagtttgatcatggctcaggatgaacgctggcggcgtgcctaatacatgcaagtcgaacgaggtggatgggagcttgctccttgatacctagtggcgaacgggtgagtaacacgtaggtaacctgccttacagtttgggatacccaagggaaactttggctaataccggataattgaccgggaggcatctcctggttctaaaaggggcctttaaagcctcgctgaaagatggacctgcggcgcattagctagttggtgagataacagcccaccaaggcgaggatgcgtagccgacctgagagggtgaacggccacactggaactgagacacggtccagactcctacgggaggcagcagtagggagttttcggcaatgggggaaaccctgaccgagcaacgccgcgtgaacgatgaaggtcttcggattgtaaagttctgttgtaagggaagaatgatatcttgaggaaatgctagatatttgacggtac

SEQ ID NO: 3059 - DNA, 490 bp, Unknown
  Ascusbbf_8035, encodes 16S rRNA
agagtttgatcatggctcaggataaacgctggcggcgtgcattatgcatgcaagtcgaacgagatacgcaagtatcgagtggcaaacgggtgagtaacacatagataacctgccctcgagtggggaataattctccgaaaggaggactaataccgcatacggtggcttttcacaagaagagttattaaagcagcaatgcgcttgaggaggggtctgtgtccgattagcttgttggtggggtaacggcctaccaaggccatgatcggtagctggtctgagaggatggtcagccacattgggactgagacacggcccagactcctacgggaggcagcagcaaggaattttgcgcaatggacgaaagtctgacgcagcaacgccgcgtgaaggatgaaggtcttcggattgtaaacttcttttataagggacgaatgatgacggtaccttatgaataagcttcggctaactacgtgccagcagccgcggtaat

SEQ ID NO: 3060 - DNA, 490 bp, Unknown
  Ascusbbf_101254, encodes 16S rRNA
agagtttgatcatggctcaggatgaacgctggcggcaggcctaatacatgcaagtcggacggcagcatgccgtagcaatacggtgatggcgagtggcgtacgggtgcgtaacacgtgtgcaacctgccccgcacagggacaaaacgccgggaaactggcgctaatatcccatgacgccgcgctggggcatcccattgcggctaaagaggcgactcggtgcgggatgggcacgcgtcccattagatagttggcggggtgacggcccaccaagtccgcgatgggtaggggttctgagaggacaggccccccacactggaactgagacacggtccagactcctacgggaggcagcagtaaggaatattggtcaatgggaggaatcctgaaccagccatgccgcgtgcgggaggaaggccctacgggtcgtaaaccgcttttgcccggggatagtgcgcgtcacgagtggcgcgagggaaggtaccgggcgaat

SEQ ID NO: 3061 - DNA, 490 bp, Unknown
  Ascusbbf_141644, encodes 16S rRNA
agagtttgatcatggctcaggatgaacgctagcggcaggcttaacacatgcaagtcgaggggcagcgggccgtagcaatacggtgccggcgaccggcggacgggtgcgtaacgcgtatgcaaccttccctgcacaggggtatagcccggcgaaagccggaataatcccccatagtttcaactccccgcatgaggggttggataaacgggcgaccgggtgcaggatgggcatgcgtgacattaggcagttggcggggtaacggcccaccaaacctacgatgtctaggggtcctgagagggaggtcccccacactggaactgggacacggtccagactcctacgggaggcagcagtgaggaatattggtcaatggaggaaactctgaaccagccatgccgcgtgcaggaaggaggccctacgggtcgagaactgcttttgttcgggacgagcatgaatacgtgtattcaagtgacggtaccggaagaataag

SEQ ID NO: 3062 - DNA, 490 bp, Unknown
  Ascusbbf_119846, encodes 16S rRNA
agagtttgatcatggctcaggatgaacgctggcggcacgcttaacacatgcaagtcgaacggagcagaaagagcttgcttttcctgctcagtggcggacgggtgcgtaacgcgtgggtaatctgcccttgacagggggataacgtatagaaatgtacgctaataccgcataagctcacggagtggcatcactctgggggaaaagggataccggtcaaggatgagcccgcgtctgattaggtagttggtgaggtaacggcccaccaagccaacgatcagtagccggtctgagaggatggacggccacattgggactgagacacggcccaaactcctacgggaggcagcagtggggaatattgcacaatggggggaaccctgatgcagcgatgccgcgtgaaggaagaagtatttcggtatgtaaacttctatcagcgaggaagaagatgacagtactcgagtaagaagccccggctaactacgtgccagca

SEQ ID NO: 3063 - DNA, 490 bp, Unknown
  Ascusbbf_458170, encodes 16S rRNA
agagtttgatcctggctcaggatgaacgctagcgacaggcctaacacatgcaagtcgaggggcagcggggagctgagcttgctcagttctgccggcgaccggcgcacgggtgagtaacgcgtatgcaaccttcccttttcagggggataacccggagaaatccggcctaatatcccatggttccttctgcaggcatctgcggaaggataaaggagtgatccggaaaaggatgggcatgcgtgacattagctagttggcggagtaacggcccaccaaggcgacgatgtctaggggttctgagaggaaggtcccccacactggtactgagacacggaccagactcctacgggaggcagcagtgaggaatattggtcaatgggcgatagcctgaaccagccaagtcgcgtgagggaagacggccctatgggttgtaaacctcttttgtcagggaacaatgaccggcacgcgtgccgggagagagtgtacctga

SEQ ID NO: 3064 - DNA, 490 bp, Unknown
  Ascusbbf_614464, encodes 16S rRNA
agagtttgatcctggctcagaacgaacgctggtggcatgcctaatacatgcaagtcgcacgagaaagtccttcggggcaagtacagtggcgcacgggtgagtaacgcgtgggtgacgtgccttttagtgggggacaacctcgggaaaccggggctaataccgcatgtgtagtttctatttgaataggaaactataaagatggcctctatttataagctatcgctagaagatcggcccgcgtagcattagcttgttggtggggtaatggcctaccaaggctacgatgcttaactggtctgagaggatgatcagtcacactggaactgagacacggtccagactcctacgggaggcagcagtagggaatattgcacaatgggggaaaccctgatgcagcaatgccacgtgagtgaggaaggccttcgggttgtaaagctctgtcctgagggaagaatggtatggtagctaatatctgctatatttgacggta

SEQ ID NO: 3065 - DNA, 490 bp, Unknown
  Ascusbbf_33958, encodes 16S rRNA
agagtttgatcatggctcaggacgaacgctggcggcgtgcttcatacatgcaagtcgaacgagaagctagagcttgctctggtggaaagtggcggacgggtgagtaacacgtaggaaacctgccttttagtgggggacaacagagggaaacttctgctaataccccatatgagcgtagctgaaatgctattcttgaaaactccggtgctaaaagatgggcctgcgcctgattagctagttggcggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgaacgtagaagcccttcggggtgtaaagttctgtcagaggggacgaattttgacggtaccctcagaggaagcaccggctaactccgtgccagcagccg

SEQ ID NO: 3066 - DNA, 487 bp, Unknown
  Ascusbbf_1484188, encodes 16S rRNA
agagtttgatcatgtctcagaacgaacgctggcggcaggcttaacacatgcaagttgaacgggatttgatggtagcttgctatcattaatgagagtagcgcactggtgagtaacacgtgggaatgtacattgtagtgggggacaacaggaggaaacttctgctaataccgcataatccctgagggggaaagatttatcgctataatatcggcccgcggaagattaggcagttggtggggtaaaggcctaccaaacctacgatctatagctggtctgagaggacgatcagccacattggaactgagacacggtccagactcctacgggaggcagcagtgaggaatattgggcaatggagggaactctgacccagccatgccgcgtgagtgagaaggttttcgaattgtaaagctctttcgggcgagaagatgatgacggtatcgccagaagaagtcacggctaactacgtgccagcagccgcggtaat

SEQ ID NO: 3067 - DNA, 490 bp, Unknown
  Ascusbbf_165765, encodes 16S rRNA
agagtttgatcctggctcaggacgaacgctggcggcgtgcctaacacatgcaagtcgagcgagaagtttttaattgaattcttcggaatgaagttaaaaatggagagcggcggacgggtgagtaacgcgtgagtaacctgccttcaggagggggacaacatttcgaaagggatgctaataccgcataaaattaggatatcgcatgataaactaatcaaagatttatcgcctgaagatggactcgcgtccgattagttagttggtggggtaacggcctaccaagacgacgatcggtagccgaactgagaggttgatcggccacattgggactgagacacggcccagactcctacgggaggcagcagtgggggatattgcgcaatggggggaaccctgacgcagcaacgccgcgtgaaggaagaaggccttcgggttgtaaacttctttaagtgtggaagataatgacggtacacacagaataagccacggc

SEQ ID NO: 3068 - DNA, 490 bp, Unknown
  Ascusbbf_1414828, encodes 16S rRNA
agagtttgatcatggctcagaacgaacgctggcggcgcgtcttaagcatgcaagtcgagcgggattgtccagcttgctggacatgagagcggcggactggcgaggagcgcgtgggcgacgcgccccccggactggaacagcccgtggaaacacggggtaatgccggacggcatgcccatcttggagggtgggcatcaaaggggcttcggccccgccgggggagcggcccgcgtcccatcagcttgttggcggcgcaagggaccaccaaggctacgacgggtgtccggcctgagagggcgatcggacgcattgggactgagatacggcccagactcctacgggaggcagcagctaagaatattccgcaatgggcgaaagcctgacggagcgacgccgcgtggacgatggaggccggaaggttgtaaagtccttttgggagggaagaagaaggccgggaggaaacgcccggccggcgacggtacctcgcgaa

SEQ ID NO: 3069 - DNA, 490 bp, Unknown
  Ascusbbf_117439, encodes 16S rRNA
agagtttgatcctggctcaggatgaacgctggcggcgtgcctaacacatgcaagtcgagcgggaatcgcccgaatgagatttcggtcaaatgaaggcgaggatagcggcggacgggtgagtaacgcgtaggtaagctgccctttgctgttggatagcctcgggaaactgggattaatacaacataacgcgtcgaggtcacatggtcttgacgccaaagatttatcggcaaaggatgcacctgcgtctgattagatagttggtgaggtaacggcccaccaagtcaacgatcagtagccgacctgagagggtgatcggccacattggaactgagacacggtccaaactcctacgggaggcagcagtggggaatattgcacaatgggggaaaccctgatgcagcaacgccgcgtgagcgaagaaggtcttcggatcgtaaagctctgtccttggggacgaaggaagtgacggtacccgaggaggaagccccgg

SEQ ID NO: 3070 - DNA, 490 bp, Unknown
  Ascusbbf_710843, encodes 16S rRNA
agagtttgatcctggctcaggacgaacgctggcggcatgcttaacacatgcaagtcgaacggagttatttccttcgggagataacttagtggcgaacgggtgagtaacacgtgaataacctgccttgtacacacgaataacaagccgaaaggtttgataatgcgcgataatatcgtagcctcgcatgaggcaacgaccaaagctccggcggtgcaagatggattcgcggcccattagctagttggtgaggtaacggcccaccaaggcaacgatgggtagccgacctgagagggtgatcggccacactggaactgagacacggtccagactcctacgggaggcagcagtggggaatattgggcaatgggcgcaagccttacccagcaatgccgcgtgagtgaagaaggtctttggattgtaaagctctttgattggggacgaaacaaatgacggtacccaaagaacaagccccggctaactacgtgccagc

SEQ ID NO: 3071 - DNA, 490 bp, Unknown
  Ascusbbf_1717473, encodes 16S rRNA
agagtttgatcatggctcagaacgaacgctggcggcgcgtcttaagcatgcaagtcgagcgggattagggtagcttgctaccctatgagagcggcggactggtgagtaacgcgtagatgacgaaccctccggacggggacagccggtagaaataccgggtaataccggatacggtcgtatgtgtcagaggcatacgaggaaaggagctcaggctccgccgggggatcggtctgcgacccatcagctagatggcggggtaaaggcccaccatggcgatgacgggtatccggcctaagagggtgaacggacacattgggactgagatacggcccagactcctacgggaggcagcagctaagaatattccgcaatgggcgaaagcctgacggagcgacgccgcgtggacgatgaaggccggaaggttgtaaagtcctttagtctgtgaggaataagccagagagggaatgctctggcggtgactgtagcagaa

SEQ ID NO: 3072 - DNA, 490 bp, Unknown
  Ascusbbf_137086, encodes 16S rRNA
agagtttgatcctggctcaggacgaacgctggcggtatgcctaacacatgcaagtcgaacgagtacttgagagcttgctcttttgtgctagtggcggacgggtgagtaacgcgtgagtaatctgccttaaagtgggggataacatttggaaacaaatgctaataccgcgtaagatattttcttcgcatgaagtttgtatcatagttttttcgctttaagatgagctcgcgtccgattagtttgttggcgaggtaaatgctcaccaagactgcgatcggtagccgggttgagagactgaacggccacattggaactgagacacggtccagactcctacgggaggcagcagtggggaatattgcacaatgggggaaaccttgatgcagcaataccgcgtgagggatgaaggctctagggttgtaaacctctgtccaaagggacgaattttgacggtacctttgaaggaagctccggctaactacgtgccagc

SEQ ID NO: 3073 - DNA, 490 bp, Unknown
  Ascusbbf_273743, encodes 16S rRNA
agagtttgatcatggctcagattgaacgctggcggcaggcctaacacatgcaagtcgagcgcgaaaggtcttcggaccgagtagagcggcggacgggtgagtaatgcgcaggaatttgcccagtagtgggggataacgtccggaaacgggcgctaataccgcatacgtcctacgggagaaagcaggggaccttcgggccttgcgctattggagaagcctgcgtcggattagcttgttggtggggtaaaggcctaccaaggcgacgatccgtagctggtctgagaggatgatcagccacactgggactgagacacggcccagactcctacgggaggcagcagtggggaatattggacaatgggggcaaccctgatccagccatgccgcgtgtgtgaagaaggccttagggttgtaaagcactttcagtggggaggaaggcccgttggctaatacccatcgggattgacgttacccacagaagaagcaccgg

SEQ ID NO: 3074 - DNA, 490 bp, Unknown
  Ascusbbf_1529662, encodes 16S rRNA
agagtttgatcctggctcaggacgaacgctggcggcgtgcttaacacatgcaagtcgaacgaggttattttgaaagcttgcttttaggataaccgagtggcgaacgggtgagtaacgcgtgagcaacctgtctcacacagggggataacgcatcgaaagatgtgctaataccgcatgagaccacagggggacatccccccggggtcaaaggagcaatccggtgtgaggtgggctcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgcaagcctgacccagcaacgccgcgtgagggaagaaggttttcggattgtaaacctctgtcctacatgaagaggagtagacggtagtgtaggaggaagccccggctaacta

SEQ ID NO: 3075 - DNA, 490 bp, Unknown
  Ascusbbf_1365645, encodes 16S rRNA
agagtttgatcatggctcaggagaaacgctggcggcgcacataagacatgcaagtcgaacggaatttagtcgaatgtttacatgagacgaaaatttagtggcggacgggtgagtaacacgtgagcaacctgcctttaggagggggataacattgagaaatcagtgctaataccgcataacgcataactgtcgcatggcagatatgccaaaggagcaatccacctaaagatgggctcgcggctgattagttagttggtggggtaacggcctaccaagacgatgatcagtagccgagctgagaggcacaacggccacattgggactgagacacggcccagactcctacgggaggcagcagtcgggaatattgcacaatggaggaaactctgatgcagtgacgccgcgtacaggaagaaggtctttggattgtaaactgttgtcgacagggaagaaaaatgacagtacctgtggaggaagctccggcaaacta

SEQ ID NO: 3076 - DNA, 490 bp, Unknown
  Ascusbbf_1517713, encodes 16S rRNA
agagtttgatcctggctcagagtgaacgctggcggcatggcttagacatgcaagtcgaacgatagtactccttcgggggtacaaaagtggcaaacgggtgcgtaacacgtgaacaatctaccttaaagtgggggatagcccagggaaacttggattaataccgcatgtggcagagtctcgcatgggattctcgctaaagcttgtaatggtgctttaagaggagttcgcggcctatcagcttgttggtgaggtaacggctcaccaaggctaagacgggtagctggtctgagaggatgatcagccacactgggactgagacacggcccagacacctacgggtggcagcagtctcgaatcattcacaatgggcaaaagcctgatggtgcaatgccgcgtgggggatgaaggtcttcggattgtaaacccctgtcattaaggactaaaacactgtgaagagcagtcttgaattaacttaaagaggaagaggtgg

SEQ ID NO: 3077 - DNA, 490 bp, Unknown
  Ascusbbf_1749968, encodes 16S rRNA
agagtttgatcatggctcaggacgaacgctggcggcgcgcctaacacatgcaagtcgaacggagctattttggcagaacccttcggggggaagctggtttagcttagtggcggacgggtgagtaacacgtgagcaacctgcctttcagagggggataacgtttggaaacgaacgctaataccgcataacgcagcgggccggcatcggcctgctgccaaaggagcaatccgctgaaagatgggctcgcgtccgattagatagttggtgaggtaacggcccaccaagtcgacgatcggtagccggactgagaggttgaacggccacattgggactgagacacggcccagactcctacgggaggcagcagtgggggatattgcacaatgggcgaaagcctgatgcagcgacgccgcgtgagggaagacggccttcgggttgtaaacctctgtctttggggacgataatgacggtacccaaggagaaagctccg

SEQ ID NO: 3078 - DNA, 490 bp, Unknown
  Ascusbbf_738768, encodes 16S rRNA
agagtttgatcctggctcaggatgaacgctagctacaggcttaacacatgcaagtcgaggggcagcatagaagttagcttgctaacttcggatggcgaccggcggatgggtgagtaacacgtatccaacctagcctttacaacgggataggctttcgaaagaaagattaatactgtatgttccgtgatcgcctcatggcgattccggcaaagatttatcggtaaaggatggggatgcgttccattaggtagtaggtgaggtaacggcccacctagcctacgatggataggggttctgagaggaaggtcccccacattggaactgagacacggtccaaactcctacgggaggcagcagtgaggaatattggtcaatgggcgagagcctgaaccagccaagtagcgtgcaggaagacggccctatgggttgtaaactgcttttgaaggggaataaaggggtctacgtgtagatctttgcatgtacctttcga

SEQ ID NO: 3079 - DNA, 490 bp, Unknown
  Ascusbbf_1313722, encodes 16S rRNA
agagtttgatcctggctcaggacgaacgctggcggcgtgcctaacacatgcaagtcgagcgaggtccaacctgtggcaacacaggggaagacctagcggcgaacgggtgagtaacacgtgagaaacctgccccgaacactgggataaccaggggaaaccctggctaataccggatgccctccagaggccgcatggccattggaggaaagatttatcggtttgggagggtctcgcggcctatcagctagttggtggggtaacggcccaccaaggcgtcgacgggtagctggtctgagaggacgatcagccacactgggactgagacacggcccagactcctacgggaggcagcagtggggaatattgcgcaatgggcgaaagcctgacgcagcaacgccgcgtgcgggatgaaggccttcgggttgtaaaccgctttcggcagggacgaaattgacggtacctgcagaagaagccccggccaactacgtgc

SEQ ID NO: 3080 - DNA, 490 bp, Unknown
  Ascusbbf_667875, encodes 16S rRNA
agagtttgatcctggctcaggatgaacgctagcgataggcttaacacatgcaagtcgaggggcagcacttcgggtggcgaccggcgcacgggtgagtaacgcgtatgcaacctaccttctacagggggataacctctcgaaagagagactaataccgcataaaacaggggcaccgcatggtgatatttgttaaagatttattggtagaagatgggcatgcgtaacattagcttgttggtgaggtaacggctcaccaaggcaacgatgtttaggggttctgagaggaaggtcccccacactggtactgagacacggaccagactcctacgggaggcagcagtgaggaatattggtcaatggacgcaagtctgaaccagccaagtcgcgtgaaggacgaaggtattatgtattgtaaacttctttttcaggggaataaagtgaggcttgcgagcctttttgcaagtaccctgcgaataaggatcggctaact

SEQ ID NO: 3081 - DNA, 490 bp, Unknown
  Ascusbbf_312026, encodes 16S rRNA
agagtttgatcctggctcaggataaacgctggcggcgcacataagacatgcaagtcgaacggaagtcgttatactgatttggatatgaacggagaacttgttcaaaggaaattgacattgatttataacaatggctttagtggcggactggtgagtaacgcgtgagcaacctgcctatcagaggggaacaacagttagaaatgactgctaataccgcatatgcctaagtaacacatgttacaatagggaaaggagcaatccgctgatagatgggctcgcgtctgattagatagttggtggggtaacggcctaccaagtcaacgatcagtagccggactgagaggttgaacggccacattgggactgagatacggcccagactcctacgggaggcagcagtcgggaatattgcgcaatggaggaaactctgacgcagtgacgccgcgtgcaggaagaaggttttcggattgtaaactgctttagacaggga

SEQ ID NO: 3082 - DNA, 490 bp, Unknown
  Ascusbbf_8484, encodes 16S rRNA
agagtttgatcctggctcaggatgaacgctggcggcgtgcttaacacatgcaagtcgaacggagatgaatttaggaagttttcggatggaatatgttcatcttagtggcggacgggtgagtaacgcgtaaacaatctgccttggagagggggataacagatagaaatatctgctaataccgcataagaccacaactgggcatccagatggggtaaaaggagttaaatccgcttcaagatgagtttgcgtactattagttagttggtgaggtaacggcccaccaagacaacgatggttagccggcctgagagggtgaacggccacattggaactgagaaacggtccagactcctacgggaggcagcagtgaggaatattgggcaatgggcgaaagcctgacccagcaacgccgcgtgaaggaagaaggtcttcggattgtaaacttctgttatgggggaaaaaggaagtgatggtaccccatgagaaagct

SEQ ID NO: 3083 - DNA, 490 bp, Unknown
  Ascusbbf_7273, encodes 16S rRNA
agagtttgatcatggctcaggatgaacgctggcggcaggcttaatacatgcaagttgaacggtaacatgagagtagcaatacttttgatgacgagtggcgtacgggtgcgtaacacgtgtgtaacctacctcatacaggaacaaaacacttggaaacgggtgctaatattccatagtattattttaaggcatcttagaataattaaagtcgcgagatggtatgagatgggcacgcggtccattagctagttggtatggtaacggcataccaaggcgacgatggataggggttctgagaggaaagacccccacattggaactgagacacggtccaaactcctacgggaggcagcagtaaggaatattggtcaatggtcggaagactgaaccagccatgccgcgtgcaggaatacggccctatgggttgtaaactgcttttattagaggataaagtggtgtacgagtacattattgcaggtatctaatgaat

SEQ ID NO: 3084 - DNA, 490 bp, Unknown
  Ascusbbf_61578, encodes 16S rRNA
agagtttgatcctggctcaggatgaacgctggcggcgtgcctaacacatgcaagtcgaacgaagcactttggttgatccttcgggtgatacttttgtgactgagtggcggacgggtgagtaacgcgtgggtaacctgccctgtacagggggataacagccagaaatggctgctaataccgcataagcgcacggaaggacatccttcagtgtgaaaaactccggtggtacaggatgggcccgcgtctgattagcttgttggcggggtaaaggcccaccaaggcgacgatcagtagccggtctgagaggatgaacggccacattggaactgagacacggtccaaactcctacgggaggcagcagtggggaatattgcacaatgggggaaaccctgatgcagcaacgccgcgtgagtgaagaagtatttcggtatgtaaagctctatcagcagggaagataatgacggtacctgactaagaagctccggctaa

SEQ ID NO: 3085 - DNA, 490 bp, Unknown
  Ascusbbf_68183, encodes 16S rRNA
agagtttgatcatggctcaggatgaacgctagcggcaggcttaacacatgcaagtcgaggggcagcgcgggtagcaatacctggcggcgaccggcgaaagggtgcgtaacgcgtgagcaacattcccgtatttgggggataagcagtggaaacgctgtctaataccccataacaacagaatccgcatggactcagtttaaaagattcgtcgaatacggattggctcgcgtggcattagctagtcggcggggtaacggcccaccgaggcgacgatgcctaggggttctgagaggaagaccccccacattgggactgagacacggcccaaactcctacgggaggcagcagtgaggaatattggtcaatggacggaagtctgaaccagccatgccgcgtgaaggatgactgccctatgggttgtaaacttcttttgcagcagagcaataaggtgtacgtgtacaccgatgagagtatgttgcgaataagcatc

SEQ ID NO: 3086 - DNA, 490 bp, Unknown
  Ascusbbf_81717, encodes 16S rRNA
agagtttgatcctggctcaggacgaacgctggcggcgtgcttaacacatgcaagtcgaacgagacttaaggaagagcttgctcggagataagtcgagtggcggacgggtgagtaacgcgtgaataatctgtctcatacagggggataacgcatcgaaagatgtgctaataccgcgtaggaccacgggttcgcatggaaccgaggtgaaaggagcaatccggtatgaggtgagttcgcgtctgattagatagttggtgaggtaaaggcccaccaagtcaacgatcagtagccgacctgagagggtgatcggccacattgggactgagacacggcccagactcctacgggaggcagcagtggggaatattgggcaatgggcggaagcctgacccagcaacgccgcgtgaaggaagaaggttttcggatcgtaaacttctgtcctatatgaagataatgacggtagtataggaggaagccccggctaactacg

SEQ ID NO: 3087 - DNA, 490 bp, Unknown
  Ascusbbf_136915, encodes 16S rRNA
agagtttgatcctggctcaggataaacgctggcaccatgcctaatacatgcatgtcgtacgagagcttcggctctagtggcaaatgggtgagtaacacgtaaggaactttccctagcgacgaggataacggttggaaacgactgctaatactggatagtatatagaaccgcatgattttatatttaaaggtccgtttggaccacgctaggatagccttgcggcgcattagatagttggtgaggtaacggcccaccaagtctatgatgcgtagctgcactgagaggtgaaacagccacattgggactgagacacggcccaaactcctacgggaggcagcagtagggaattttcggcaatgagcgaaagcttgaccgagcaatggtgcgtgaatgatgaaggtctttggattgtaaaattcttttattggggaagaaaaaatcgattaggaaatgattcgatcttgacggtacccattgaataagccccggc

SEQ ID NO: 3088 - DNA, 490 bp, Unknown
  Ascusbbf_66967, encodes 16S rRNA
agagtttgatcatggctcagattgaacgctagcgggatgctttacacatgcaagtcgaacggcagcacgaggagcttgctccttggtggcgagtggcgaacgggtgagtaatgtatcggaacgtgcccagtagcgggggataactactcgaaagagtggctaataccgcatacgtcctacgggagaaagcgggggaccttcgggcctcgcactattggagcggccgatatcggattagctagttggtggggtaaaggcctaccaaggcgacgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttgtcagggaagaaatcgcgtggacgaataatctgcgtggatgacggtacctgaagaataa

SEQ ID NO: 3089 - DNA, 490 bp, Unknown
  Ascusbbf_68059, encodes 16S rRNA
agagtttgatcatggctcaggatgaacgctggcggcgtgcctaacacatgcaggtcgaacgggacctatgtagatcaagacttcggtcaagtgaaatttaggtttagtggcggacgggtgagtaacgcgtgagcaatctgccgtatgcagggggacaacagagggaaacttctgctaataccgcataagcgcacagtatcgcatggtacagtgtgaaaagctccggcggcatacgatgagctcgcgtctgattagccagttggcggggtaacggcccaccaaagcgacgatcagtagccggcctgagagggtgaacggccacattgggactgagagacggcccagactcctacgggaggcagcagtgggggatattgcacaatggagggaactctgatgcagcgacgccgcgtgggtgaagaagtatttcggtatgtaaagccctatcagcagggaagataatgacggtacctgactaagaagccccggc

SEQ ID NO: 3090 - DNA, 490 bp, Unknown
  Ascusbbf_1427548, encodes 16S rRNA
agagtttgatatggctcaggacgaacgctggcggcgtgcttaacacatgcaagtcgagcggaaaggccccttcgggggtactcgagcggcgaacgggtgagtaacacgtgagcaacctgcccctgactctgggataagcccgggaaactgggtctaataccggatacgaccggccttcgcatggagtgtcggtggaaagtttttcggttggggatgggctcgcggcctatcagcttgttggtggggtgatggcctaccaaggcgacgacgggtaaccggcctgagagggcgaccggtcacactgggactgagacacggcccagactcctacgggaggcagcagtggggaatattgcgcaatgggcggaagcctgacgcagcgacgccgcgtgggggatgacggccttcgggttgtaaacctctttcagcagggacgaagctaacgtgacggtacctgcagaagaagcgccggctaactacgtgccagcag

SEQ ID NO: 3091 - DNA, 490 bp, Unknown
  Ascusbbf_95000, encodes 16S rRNA
agagtttgatcatggctcaggatgaacgctggcggcgtgcctaacacatgcaagtcgagcgagaattaaggaaacgatacttcggtaaagcggaattaaggacagcggcggacgggtgagtaacgcgtgggcaacctgccccttactggtggatagccgcgggaaactgcgagtaatacaccataatgcatagagaagacatcttcattatgccaaagatttatcggtaagggatgggcccgcgtccgattagctggttggtgaggcagcggctcaccaaggcgacgatcggtagccggcctgagagggcgatcggccacattggaactgagacacggtccagactcctacgggaggcagcagtggggaatattgcacaatgggggaaaccctgatgcagcaacgccgcgtgaaggaagaaggccttcgggtcgtaaacttctgttgaggggaaagatcatgacggtacccctttagaaagccccggcta

SEQ ID NO: 3092 - DNA, 490 bp, Unknown
  Ascusbbf_716067, encodes 16S rRNA
agagtttgatcctggctcaggatgaacgctggcggcgtgcctaacacatgcaagtcgaacggttaacccacctccgggtggtcatacagtggcgaacgggtgagtaacacgtgaccaacctgccccgcgctccgggacagcctcgcgaaagcgggattaataccggatgcgccccctcccccgcatgggggaggggggaaagcccaggcggcgcgggatggggtcgcggcccatcaggtagacggtcgggtggaggccgaccgtgccgacgacgggtagccgggttgagagaccgaccggccacattgggactgagatacggcccagactcctacgggaggcagcagtggggaatattgcgcaatgggggcaaccctgacgcagcaacgccgcgtgcgggacgacggccttcgggttgtaaaccgctttcagcagggaagacatcgacggtacctgcagaagaagccccggctaactacgtgccagcagc

SEQ ID NO: 3093 - DNA, 490 bp, Unknown
  Ascusbbf_134853, encodes 16S rRNA
agagtttgatcctggctcaggacaaacgctggcggcgtgcctaacacatgcaagtcgaacgaagcaccggggaaagagacttcggtcaatggatccggtgacttagtggcggacgggtgagtaatgcatgagcaacctgccctggagagggggacaacagctggaaacggctgctaataccgcatgatgtcgttggagggcatcctttgacgaccaaagatttatcgctctgggatgggctcatgtctgattagttagttggcggggcaacggcccaccaagactacgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttatcagggacgaaggatgtgacggtacctgatgaataagccacg

SEQ ID NO: 3094 - DNA, 490 bp, Unknown
  Ascusbbf_1227918, encodes 16S rRNA
agagtttgatcctggctcaggacgaacgctggcggcgtgcctaatacatgcaagtcgagcggacgttttattggtgcttgcaccgataaaacgttagcggcggacgggtgagtaacacgtgggcaacctgccctgtagattgggataactccgggaaaccggggctaataccgaataatactttttaactcatgttagaaagttaaaagatggttctgctatcactacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtagcgtagtaactggcgctaccttgacggt

SEQ ID NO: 3095 - DNA, 490 bp, Unknown
  Ascusbbf_4983, encodes 16S rRNA
agagtttgatcatggctcaggatgaacgctggcggcaggcttaatacatgcaagtcgaacggtaaggcccgaagtggcaacaccaagggtacacgagtggcgcacgggtgcgtaacgcgtatgcaacctgcccccaaccgggacaaaacagctggaaacggctgctaatatcccatggtcatccgggagggcatccttctggatgtaaagattcattggttggggatgggcatgcgtattattaggtagttggcggggtaacggcccaccaagccgacgatgattaggggtcctgagagggttatcccccacactggaactgagacacggtccagactcctacgggaggcagcagtagggaatattgggcaatgggagcaatcctgacccagccatgccgcgtgaaggaagacggtcctatggattgtaaacttcttttgccgcagagtaaccgcggggacgcgtccccgcctgagagtatgcggcgaat

SEQ ID NO: 3096 - DNA, 490 bp, Unknown
  Ascusbbf_47434, encodes 16S rRNA
agagtttgatcatggctcaggatgaacgctagcgacaggcctaacacatgcaagtcgaggggcagcgcggatgtagcaatacgtttggcggcgaccggcgcacgggtgcgtaacaggtgtgcaatctgtccataatcggggaataacccggcgaaagccgaactaacgctccatgtgagcgagcggggcatcctgcttgtttgaaacgtgaggattatgggtgagcacgcttctgattagatagttggtggggtaacggctcaccaagtcgacgatcagtaggggttctgagaggaaggtcccccacattggaactgagacacggtccaaactcctacgggaggcagcagtgaggaatattggtcaatgggcgagagcctgaaccagccaagtcgcgtgaaggatgaaggttctatggattgtaaacttcttttattcgagggtaaagtgtggtacgtgtaccatattgcaagtatcgaatgaataagca

SEQ ID NO: 3097 - DNA, 490 bp, Unknown
  Ascusbbf_70731, encodes 16S rRNA
agagtttgatcatggctcaggatgaacgctggcggcgtgcctaacacatgcaagtcgaacgaagcactggaaccgatttcttcggactgacgttcctttgacttagtggcggacgggtgagtaacgcgtggataacctgcctgtatctgggggataacagttagaaatgactgctaataccgcataagcgcacagtaccgcatggtaaagtgtgaaaagccttgtgcggatacagatggatccgcgttagattagccagttggcggggtaacggcccaccaaagcgacgatctatagccggcctgagagggcgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaattgacggtacctgactaagaagccccggc

SEQ ID NO: 3098 - DNA, 490 bp, Unknown
  Ascusbbf_240623, encodes 16S rRNA
agagtttgatcatggctcaggattaacgctggcggcatgcctaatacatgcaagtcgaatgggaagcttgctttccatggcgaacgggtgagtaacacgtaggtaacctgtctttaagacgaggataacctttggaaacgaaggataatactggatagtacatcacaaatcacatgattagatgtttaaaggagcaatccacttagagaggggcctgcggcgcattagctagttggtgaggtaagagcccaccaaggcgatgatgcgtagccggactgagaggttgaacggccacaatgggactgagaacggcccatactcctacgggaggcagcagtagggaattttcggcaatggacgaaagtctgaccgagcaatgccgcgtgaatgatgaagtatttcggtatgtaaaattcttttatatgggacgaaaaaacaaattgacggtaccatatgaataagctccggctaactacgtgccagcagccgc

SEQ ID NO: 3099 - DNA, 490 bp, Unknown
  Ascusbbf_666407, encodes 16S rRNA
agagttcgatcctggctcaggacgaacgctggcggcgtgcctaacacatgcaagtcgaacgaagcactgcggaaagagacttcggtcaatggaagctttgacttagtggcggacgggtgagtaacgcgtgaggaacctgcctttcagtgggggacaacagttggaaacgactgctaataccgcataatgtgttttgggggcatccccggaacaccaaagatttattgctgaaagatggactcgcgtctgattagatagttggtggggtaacggcctaccaagtcgacgatcagtagccggactgagaggttgaacggccacattgggactgagatacggcccagactcctacgggaggcagcagtggggaatattgggcaatgggggaaaccctgacccagcaacgccgcgtgaaggaagaaggctttcgggttgtaaacttcttttaccagggacgaaggacgtgacggtacctggagaaaaagccacg

SEQ ID NO: 3100 - DNA, 490 bp, Unknown
  Ascusbbf_156249, encodes 16S rRNA
agagtttgatcatggctcaggacgaacgctggcggtatgcttaacacatgcaagtcgaacgagacgttgggcgaattggtttcggctgatgagtctgacagaaagtggcgaacgggtgagtaacgcgtgggcaacctaccttatggaaagggatagcctcgggaaactgggagtaaaaccttataacatatgtttattgcatggtagacatatcaaaactccggtgccatgagatgggcccgcgtcctattagctagttggtgagataacagctcaccaaggcgacgataggtaaccggtctgagagggcgaacggtcacactggaactgagacacggtccagactcctacgggaggcagcagtggggaatattgcgcaatggggggaaccctgacgcagcaataccgcgtgagtgaagaaggatttcggtctgtaaagctcttttattagggaagaagaagtgacggtacctaatgaataagtcccggc

SEQ ID NO: 3101 - DNA, 490 bp, Unknown
  Ascusbbf_89375, encodes 16S rRNA
agagtttgatcatggctcaggatgaacgctggcggcgtgcctaacacatgcaagtcgagcggagatacttttataagcttgcttaaggagtatcttagcggcggatgggtgaggaacgcgtggagaacctgcccttcacagggggataacagttggaaacgactgttaataccgcatatgctcacagcaccgcatggtgcagggaggaaagcgctagtggtgaaggatggctccgcgtcggattagccagttggcggggtaacggcccaccaaagcgatgatccgtagccggcctgagagggcgaccggccacattgggactgagacacggcccaaactcctacgggaggcagcagtgggggatattgcacaatgggcgaaagcctgatgcagcgacgccgcgtgaaggaagacgtacctcggtatgtaaacttctatcagcagggaagaagatgacggtacctgactaagaagccccggctaactacgt

SEQ ID NO: 3102 - DNA, 470 bp, Unknown
  Ascusbbf_160104, encodes 16S rRNA
agagtttgatcctggctcagaacgaacgctggcggcaggcttaacacatgcaagtcgaacgccctcttcggagggagtggcagacgggtgagtaacacgtgggaacctacctaggggtacggaataactcggggaaactcgtgctaataccgtatacgaccttcgggtgaaagatttatcgcccctagatgggcccgcgctggattagctagttggtggggtaaaagctcaccaaggcgacgatccatagctggtctgagaggatgatcagccacactgggactgagacacggcccagactcctacgggaggcagcagtggggaatcttggacaatgggcgcaagcctgatccagccatgccgcgtgagtgatgaaggccttagggttgtaaagctctttcgccagggaagataatgactgtacctggataagaagccccggctaactccgtgccagcagccgcggtaat

SEQ ID NO: 3103 - DNA, 490 bp, Unknown
  Ascusbbf_1440099, encodes 16S rRNA
agagtttgatcctggctcaggatgaacgctggcggcgtgcctaatacatgcaagtcgtacgcgattagagcgcttgctctttgatcgagtggcgaacgggtgagtaacacgtgggtaacctgccctatagttgggaatacctaagggaaactttagttaataccgaataatgttagtgagaggcatctcttactaaagaaagcagcttttgctgcgctattggatggacctgcggcgcattagttagttggtgaggtaacggctcaccaagaccaggatgcgtagccgacctgagagggtgatcggccacaatgggactgagacacggcccatactcctacgggaggcagcagtagggagttttcggcaatgggggaaaccctgaccgagcaacgccgcgtgaacgatgaaggtcttcggattgtaaagttctgttgtaagggagtaatggcttcgagaatagaatgctcgaggtttgaaagtaccttac

SEQ ID NO: 3104 - DNA, 482 bp, Unknown
  Ascusbbf_665356, encodes 16S rRNA
agagtttgatcctggctcagaacgaacgctggcggcaggcttaacacatgcaagtcgagcgccccgcaaggggagcggcagacgggtgagtaacgcgtgggaatctacccatctctacggaataactcagggaaacttgtgctaataccgtatacgcccctttttggagacattgagggggaaagatttatcggagatggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccgatgaagataatgacggtagtcggagaagaagccccggctaacttcgtgccagcagccgcggtaat

SEQ ID NO: 3105 - DNA, 490 bp, Unknown
  Ascusbbf_1486655, encodes 16S rRNA
agagtttgatcatggctcaggatgaacgctagcgacaggcctaacacatgcaagtcgaggggtagcggaatgtagcaatacatttgctgacgaccggcgcacgggtgagtaacgcgtatgcaacctgcctactacagggggataacccggagaaattcggactaataccgcataatacagggataccgcatggtaatatttgttaaagattaattggtagtagatgggcatgcgttccattagctagttggggaggtaacggctcaccaaggcaacgatggataggggaactgagaggtttatcccccacactggaactgagacacggaccagactcctacgggaggcagcagtgaggaatattggtcaatgggcgagagcctgaaccagccaagtcgcgtgaaggaagactgccttatgggttgtaaacttcttttataagggaataaaagagattacgtgtaatctattgcatgtaccttatgaataa

SEQ ID NO: 3106 - DNA, 490 bp, Unknown
  Ascusbbf_1219931, encodes 16S rRNA
agagtttgatcctggctcaggatgaacgccagcgggaggcctaacacatgcaagccgagcggtatttgttcttcggaacagagagagcggcgtacgggtgcggaacacgtgtgcaacctgcctttatcagggggatagcctttcgaaaggaagattaataccccataatatttaggatggcatcattttaaattgaaaactaaggtggataaagatgggcacgcgcaagattagatagttggtagggtaacggcctaccaagtcgatgatctttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtatagggataaacctttccacgtgtggaaagctgaaggtactatacgaataagcaccggct

SEQ ID NO: 3107 - DNA, 490 bp, Unknown
  Ascusbbf_30163, encodes 16S rRNA
agagtttgatcatggctcaggatgaacgctagcggcaggcttaacacatgcaagtcgaggggcagcggggagtagcaatactctgccggcgaccggcaaaagggtgcgtaacgcgtgagcaacttgcccgtatccggggcataagcggtggaaacgccgtctaatttcccataacaacagaggccgcctgacctttgtttgaaagattcgtcggatacggataggctcgcgagacattagctagtcggcgtggtaacggcacaccgaggcgacgatgtctaggggttctgagaggaaggtcccccacactggaactgagacacggtccagactcctacgggaggcagcagtgaggaatattggtcaatgggcggaagcctgaaccagccatgccgcgtgaaggattgaggccctatgggtcgtaaacttcttttgtggtggagcaataagtgctacgtgtagcacgatgagagtacatcacgaataagca

SEQ ID NO: 3108 - DNA, 490 bp, Unknown
  Ascusbbf_62455, encodes 16S rRNA
agagtttgatcatggctcagaacgaacgctggcggcgcgtcttaagcatgcaagtcgagcggcaagattggtgcttgcactgatcctagagcggcggactggtgagtaacgcgtgggtgacttgccctgaggatggggatagccggtagaaataccgggtaataccgaatacgttcccgtgagttagagttacgggaagaaaggagcttcggctccgcctgaggagaggcccgcgtactattagctagttggtgaggtaacggcccaccaaggcaacgatagttatccggcctaagagggtgaacggacacattgggactgagatacggcccagactcctacgggaggcagcagctaagaatattccgcaatggaggaaactctgacggagcgacgccgcgtggatgatgaaggccggaaggttgtaaaatccttttgtacgtgaggaataagttcaggaggtaatgcctggatggtgactgtagcgtaa

SEQ ID NO: 3109 - DNA, 490 bp, Unknown
  Ascusbbf_112230, encodes 16S rRNA
agagtttgatcatggctcaggatgaacgctagcggcaggcttaacacatgcaagtcgaggggcatcgagtgtagcaatacatgtcggcgaccggcgaaagggtgagtaacgcgtgagcaacatacccgcagacgggggataggaggtggaaacgccttgtaataccccataagatacggagcggcatcgttttgtattgaaagattcattgtcagcggattggttcgcgtgccattaggtagacggcggggtaacggcccaccgtgccgacgatggctaggggttctgagaggaaggtcccccacattggaactgagacacggtccagactcctacgggaggcagcagtgaggaatattggtcaatggccgagaggctgaaccagccatgccgcgtgaaggatgaaggccctatgggtcgtaaacttcttttgtcgtggagcaataagggtcacgcgtggcccgatgagagtacacgtcgaataagcatc

SEQ ID NO: 3110 - DNA, 490 bp, Unknown
  Ascusbbf_115263, encodes 16S rRNA
agagtttgatcatggctcaggatgaacgctagcggcaggcttaacacatgcaagtcgaggggcagcgcgttgtagcaatacgatggcggcgaccggcggaagggtgcgtaacgcgtgagcaacctgcccctgtcagggggatagtcgatggaaacgtcgcgtaataccccgtacgatgcgtgaccgcatggtcatgtattgaaagattcatcggacagggatgggctcgcgtgacattagctagtcggcggggtaacggcccaccgaggcgacgatgtctaggggttctgagaggaaggtcccccacactggaactgagacacggtccagactcctacgggaggcagcagtgaggaatattggtcaatggccgagaggctgaaccagccatgccgcgtgcaggaatgaggccctacgggtcgtaaactgcttttgcggtggagcaataaggtgtacgcgtacaccgatgagagtacatcgcgaataagca

SEQ ID NO: 3111 - DNA, 490 bp, Unknown
  Ascusbbf_724529, encodes 16S rRNA
agagtttgatcatggctcaggacgaacgctggcggcgtgcctaacacatgcaagtcgaacgaggtaacaggaaagcttgctttcgctgacctagtggcgaacgggtgagtaacacgtgagaaacctgcctttgagtggggaataactcgaggaaactcgggctaataccgcatatcttcttcggaccgcatggtttgttgaagaaagaatttcgctcttagagggtctcgcggcctatcagctagttggtgaggtaactgctcaccaaggcaacgacgggtagctggattgagagatcgatcagccacactgggactgagacacggcccagactcctacgggaggcagcagtggggaatcttgcgcaatgggcgaaagcctgacgcagcaacgccgcgtgcggtgatgaaggccttcaaggttgtaaaccgctttcagcagggacgaaaatgacggtacctgcagaagaagccccggctaactacgtgcc

SEQ ID NO: 3112 - DNA, 490 bp, Unknown
  Ascusbbf_1670030, encodes 16S rRNA
agagtttgatcatggctcaggacgaacgctggcggcgtgcttaacacatgcaagtcgagcggggtgcccctttcgaggggtggcctagcggcgaacgggtgagtaacacgtgggcaaccaaccctcagctctgggataactccgggaaactggggctaataccggataggacttccgcggacatccgcggtggtggaaaggttaagtccggctggggacgggcccgcggtctatcagcttgttggtgaggtaatggcttaccaaggcgacgacggatagccggcctgagagggtgaccggccacactgggacggagacacggcccagactcctacgggaggcagcagtggggaatcttgcgcaatgggcgaaagcctgacgcagcaacgccgcgtgggggaagaaggccttcgggttgtaaacccctttcggtggggacgaagcctgttttgcaggtgacggtacccgcaaaagaagcaccggctaacta

SEQ ID NO: 3113 - DNA, 490 bp, Unknown
  Ascusbbf_664591, encodes 16S rRNA
agagtttgatcatggctcaggacgaacgctggcggcgtgcttaacacatgcaagtcgaacgctgaagctcctagcttgctgggggtggatgagtggcgaacgggtgagtaacacgtgagtaacctgccttgaacttcgggataagcgctggaaacggcgtctaataccggatatgacctgtcaccgcatggtggtgggtggaaagatttatcggttctagatggactcgcggcctatcagcttgttggtgaggtagtggctcaccaaggcgacgacgggtagccggcctgagagggtgaccggccacactgggactgagatacggcccagactcctacgggaggcagcagtggggaatattgcacaatggacgcaagtctgatgcagcaacgccgcgtgagggatgaatgccttcgggttgtaaacctcttttagtagggaagaagcgaaagtgacggtacctgcagaaaaagcaccggctaactacgtg

SEQ ID NO: 3114 - DNA, 490 bp, Unknown
  Ascusbbf_1446004, encodes 16S rRNA
agagtttgatcctggctcaggataaacgctggcggcgcacataagacatgcaagtcgaacggacttaactcattcttaacgattgagagcggttagtggcggactggtgagtaatgtataagtaacctgcctatcagaggggaacaacagttggaaacgactgctaataccgcatatgccacgagaatcacatggttcaagtgggaaaggagcaatccgctgatagatggacttatatctgattagctagttggtggggtaacggcctaccaaggcgacgatcagtagccggactgagagggtacatgggcacagtgggaatggggtcagggccagactcctacgggaggcagcaggtgggaatattgcgcaatggaggaaactctgacgcagtgaagccgcgggcaggaagaaggttttcggattgtaaacggctttagacagggaagaaaaaagacagtacctgtagaataagctccggctaactacg

SEQ ID NO: 3115 - DNA, 490 bp, Unknown
  Ascusbbf_114920, encodes 16S rRNA
agagtttgatcatggctcaggatgaacgctggcggcgtgcctaacacattcaagtcgaacggacgcgttcccttcgggggacaagttagtggcggacgggtgagtaatgcatgagcaacctgcctcgaagaggggaataacacagagaaatttgtgctaataccgcataatgtattcgggaggcatcttccggataagaaaggagcaatccgctttgagatgggctcatgtctgattagacagttggcggggtaacggcccaccaaatctacgatcagtagccggactgagaggttgaacggccacattgggactgagacacggcccagactcctacgggaggcagcagtggggaatattggacaatgggcgaaagcctgatccagcgacgccgcgtgaaggaagaaggtcttcggattgtaaactttagtgagcagggacgataatgacggtacctgcatagcaagccacggctaactacgtgccagca

SEQ ID NO: 3116 - DNA, 353 bp, Unknown
  Ascusbbf_1825117, encodes 16S rRNA
agagtttgatcatggctcagaacgaacgctggcggcgcgttttaagcatgcaagtcgagcggcagtagcaatacgagagcggcggacgggtgagtaacacgtgggtaatctgcctaccagtcggggatagcctgtggaaacacaggataataccggatgcgatgccctgcacacaagtgcggggcaggaaaggggccaaggccccgctggaagatgagcccgcgtcccattagctagatggcggggtaaaggcccaccatggcgatgatgggtagccggcctgagagggtgaacggccacattggaactgagacacggtccagactcctacgggagccagcagccgcggtaat

SEQ ID NO: 3117 - DNA, 490 bp, Unknown
  Ascusbbf_1810899, encodes 16S rRNA
agagtttgatcatggctcaggatgaacgccggcggtgtgcctaatacatgcaagtcgaacgcgttggcccgactgattgacgatgcttgcatctgattgacgacggtttaccaacgagtggcggacgggtgagtaacacgtaggcaacctgcccagaagcgggggacaacatttggaaacaagtgctaataccgcatgaatccgaaaaccgcatggttttcggctaaaagacggcttcggctgtcacttctggatgggcctgcggcgcattagttagttggtggggtaacggcctaccaagacgatgatgcgtagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaaactctgttgttgaagaagaacgtgcgtgagag

SEQ ID NO: 3118 - DNA, 490 bp, Unknown
  Ascusbbf_376383, encodes 16S rRNA
agagtttgatcctggctcaggatgaacgctagcgacaggcttaacacatgcaagtcgaggggcagcataaaagtagcaatactttggtggcgaccggcgcacgggtgagtaacgcgtatgcaacctacctatcagaggggaataacccggcgaaagtcggactaataccgcataaaacaggggcaccgcatggtgatatttgttaaagaaattcgctgatagatgggcatgcgttccattaggtagttggtgaggtaacggctcaccaagccgacgatggataggggaactgagaggttggtcccccacactggtactgagacacggaccagactcctacgggaggcagcagtgaggaatattggtcaatgggcgggagcctgaaccagccaagtcgcgtgaaggaagaaggatctatggttcgtaaacttcttttgcaggggaataaagtgcaggacgtgtcctgttttgtatgtaccctgagaataag

SEQ ID NO: 3119 - DNA, 490 bp, Unknown
  Ascusbbf_1879338, encodes 16S rRNA
agagtttgatcatggctcaggataaacgctggcggcgtgcataacacattcaagtcgaacgaagcactttcgaacgagacttcggtcaagtttggatttgacttagtggcggacgggtgagtaacgcgtgagcaatctgccttggggtgcgggataacgtcgggaaactgacgctaataccgcatgacgcacggaggtcgcatgtcctccatgccaaagatttattgccctgagatgagctcgcgtccgattagacagttggcagggtaacggcctaccaaatcaacgatcggtagccggactgagaggttgaacggccacattggaactgagatacggtccagactcctactggaggcagcagtggggaatattgggcaatgggcgaaagcctgacccagcgacgccgcgtgagggaagaaggtcttcggattgtaaacctctttcagcagggaagaaggaagtgacggtacctgcagaagaagccacg

SEQ ID NO: 3120 - DNA, 490 bp, Unknown
  Ascusbbf_1519972, encodes 16S rRNA
agagtttgatcatggctcagattgaacgctggcggcatgccttacacatgcaagtcgaacggcagcacgggtgcttgcacctggtggcgagtggcgaacgggtgagtaatacatcggaacgtaccttgtagtgggggatagctcggcgaaagccggattaataccgcatacgctctgaggaggaaagcgggggaccttcgggcctcgcgctacaagagcggccgatgtcagattagctagttggtggggtaaaagctcaccaaggcgacgatctgtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctctgggttaatacctcggggggatgacggtaccggaagaataagc

SEQ ID NO: 3121 - DNA, 490 bp, Unknown
  Ascusbbf_33248, encodes 16S rRNA
agagtttgatcatggctcaggatgaacgctagctacaggcttaacacatgcaagtcgagcggaacactttcgggtgtttagcggcagacgggtgagtaacacgtatccaacctttcccttacccgggtatagcctcgggaaactgagagtaatccccgatgtggtgcacgagaagcattttttgcgcacgaaagattcatcggtaaggggtggggatgcgttccattagttagtaggcggggcaacggcccacctagacgatgatggataggggttctgagaggaaggtcccccacattggaactgcgacacggtccaaactcctacgggaggcagcagtgaggaatattggtcaatggccggaaggctgaaccagccaagtagcgtgcaggatgacggccctatgggttgtaaactgcttttgtacgggaataacggtcgtcacgcgtgatgatgtgcatgtaccgtacgaataaggatcggctaactc

SEQ ID NO: 3122 - DNA, 490 bp, Unknown
  Ascusbbf_644655, encodes 16S rRNA
agagtttgatcctggctcaggataaacgctggcggcgcacataagacatgcaagtcgaacgaacttaattttaatatttatattaaaaagcggttagtggcggactggtgagtaacgcgtaagcaatctacctattagaggggaataacagtgagaaatcattgctaataccgcatatgccatagacatcacatgatgacagtgggaaaggagcaatccgctaatagatgagcttgcgtctgattagcttgttggtggggtgatggcctaccaaggcgacgatcagtagccggactgaggggttgaacggccacattgggactgagatacggcccagactcctacgggaggcagcagtcgggaatattgcgcaatggaggaaactctgacgcagtgacgccgcgtataggatgaaggttttcggattgtaaactattgtcgttagggaagataaaagacagtacctaaggaggaagctccggctaactac

SEQ ID NO: 3123 - DNA, 490 bp, Unknown
  Ascusbbf_23748, encodes 16S rRNA
agagtttgatcatggctcaggacgaacgctggcggcgtgcctaacacatgcaagtcgaacgagcgcaaggagcttgctccttgttgcgagtggcggacgggtgagtaacgcgtgaggaacctgcccttgagagggggataacgtccggaaacggacgctaataccgcataacatgttcaaatcgcatggtttgaacatcaaaggagcaatccgctgaaggatggcctcgcgtctgattagatagttggtgaggtaacggctcaccaagtcgacgatcagtagccggactgagaggttgatcggccacattgggactgagacacggcccagactcctacgggaggcagcagtgagggatattgcacaatgggggaaaccctgatgcagcaacgccgcgtgaaggaagacggttttcggattgtaaacttctgttttgggtgacgataatgacggtagcccgatagaaagccacggctaactacgtgccagc

SEQ ID NO: 3124 - DNA, 490 bp, Unknown
  Ascusbbf_65656, encodes 16S rRNA
agagtttgatcctggctcaggacgaacgctggcggcgtgcttaacacatgcaagtcgaacgaagcttgaatttagatttcttcggaatgataaatgatatgactgagtggcggacgggtgagtaacgcgtgagcaacctgcccttcggagggggatagcgtttggaaacgaacggtaataccgcataatgttagggaatggcatctttccctaaccaaaactccggtgccgaaggatgggctcgcgttggattagatagttggtggggtaacggcctaccaagtcgacgatccatagccggactgagaggttgatcggccacattgggactgagacacggcccagactcctacgggaggcagcagtggggaatattgcacaatgggggaaaccctgatgcagcaacgccgcgtgaaggaagacggttttcggattgtaaacttctgttcttagggaagaagaaagtgacggtacctaaggagcaagccac

SEQ ID NO: 3125 - DNA, 490 bp, Unknown
  Ascusbbf_98949, encodes 16S rRNA
agagtttgatcatggctcaggacgaacgctggcggtgtgcttaatacatgcaagtcgagcggagttaaggggcttgctccttaacttagcggcggacgggtgagtaacgcgcgagcaacctgcctatgtctggggaataacacagagaaatttgtgctaataccgcataagaccacagtggggcatcccacaggggtaaaagatttatcggatatagatgggctcacgtaccattagatagttggtagtgtaacggactaccaagtcgacgatggttagccgacctgagagggtgatcggccacattggaactgagatacggtccagactcctacgggaggcagcagtagggaatattcggcaatgggcgcaagcctgaccgagcaacaccgcgtgtgtgatgaaggtcttcggattgtaaagcactgtgatgggggacgaagaaagtgacggtaccccaagagcaagccacggctaactacgtgccagc

SEQ ID NO: 3126 - DNA, 490 bp, Unknown
  Ascusbbf_347717, encodes 16S rRNA
agagtttgatcctggctcaggatgaacgctggcggcgtgcttaacacatgcaagtcgagcgagaagctcgtgaccaattcttcggaagcgagatcgagtggaaagcggcggacgggtgagtaacgcgtaggcaacctgccccgtacaaagggatagctactggaaacggtaattaatacctcataacacggttccatcgcatgttgggaccgtcaaagatttatcggtatgggatgggcctgcgtctgattagctggttggtggggtaacggctcaccaaggcgacgatcagtagccgacctgagagggtaaacggccacattggaactgagacacggtccaaactcctacgggaggcagcagtggggaatattgcacaatggggggaaccctgatgcagcaacgccgcgtgagcgaagaaggcctttgggtcgtaaagctctgtcctgaaggaagaagtaagtgacggtacttcaggaggaagccccgg

SEQ ID NO: 3127 - DNA, 490 bp, Unknown
  Ascusbbf_219183, encodes 16S rRNA
agagtttgatcatggctcaggatgaacgctggcggcgtgcctaacacatgcaagtcgagcgggaaatccgtgacggatccttcgggtgacggatcggatggagagcggcggacgggtgagtaacgcgtaggtaacctgccctgtacagagggatagccactggaaacggtgattaatacctcataatgccggatctgcacatgcaggaccggtcaaagttttttcggtacaggatggacctgcgtctgattagctagttggtggggtaacggctcaccaaggcgacgatcagtagccgacctgagagggtgatcggccacattggaactgagacacggtccaaactcctacgggaggcagcagtggggaatattgcacaatgggggaaaccctgatgcagcaacgccgcgtgaacgaagaaggctcttgggtcgtaaagttctgttctgagggaagaagaaagtgacggtacctcaggagaaagccccgg

SEQ ID NO: 3128 - DNA, 490 bp, Unknown
  Ascusbbf_206115, encodes 16S rRNA
agagtttgatcatggctcaggacgaacgctggcggcatgccttacacatgcaagtcgaacggacctagcaataggttagtggcgaacgggtgagtaatacatgagcaacctgcctcaaacagggggataacaccgggaaactggtgctaataccgcataagaccacagcgcggcatcgcgcaggggtaaaaacgattcagtggtttgagatgggctcatgtcccattagctagttggtgagataacagcccaccaaggcgacgatgggtagccgacctgagagggtgatcggccacattgggactgagacacggcccagactcctacgggaggcagcagtggggaatattgggcaatgggcgaaagccttacccagcaatgccgcgtgagtgaagaaggtcttcggattgtaaagctctttgatcagggacgaacacaatgacggtacctgaagaacaagccccggctaactacgtgccagcagccgcgg

SEQ ID NO: 3129 - DNA, 490 bp, Unknown
  Ascusbbf_234701, encodes 16S rRNA
agagtttgatcctggctcaggacgaacgctggcggcgcgcctaacacatgcaagtcgaacggagatgggaaagcttgcttttccattttagtggcggacgggtgagtaacacgtgagcaacctgcctttcagagggggataacgtttggaaacgaacgctaataccgcataacatattcttgtggcatcacagggatatcaaaggagcaatccgctgagagatgggctcgcggccgattagatagttggcggggtaagggcccaccaagtcgacgatcggtagccggactgagaggttgaacggccacattgggactgagacacggcccagactcctacgggaggcagcagtggggaatattaggcaatgggggaaaccctgacctagcgacgccgcgtgagggaagacggtcttcggattgtaaacctctgtcttcagggacgaaaaagatgacggtacctgaagaggaagccacggctaactacgtgc

SEQ ID NO: 3130 - DNA, 490 bp, Unknown
  Ascusbbf_418033, encodes 16S rRNA
agagtttgatcctggctcaggatgaacgctagcggcaggcctaatacatgcaagtcgaacggtaagtattttagcaataggatacgagagtgacgtacgggtgcgtaacacgtatgcaacctacccaaaacaggaggatagctcagggaaacttggattaaccctccataagatcgtgccttggcatcagggagcgataaaaaccgcgaggtggttttggatgggcatgcgcatgattagttagttggtagtgtaacggactaccaagacgatgatcattaggggacctgagagggtgatcccccacactggcactgagatacgggccagactcctacgggaggcagcagtagggaatattggtcaatggatggaagtctgaaccagccatgccgcgtgcaggaagacggccttctgggttgtaaactgcttttgccaggggataaaaggcccatgcgtgggacattgaaggtacctggtgaataagcca

SEQ ID NO: 3131 - DNA, 490 bp, Unknown
  Ascusbbf_1226096, encodes 16S rRNA
agagtttgatcctggctcaggatgaacgctagcggcaggcctaacacatgcaagtcgagggctagacatcttcggatgttgagaccggcgcacgggtgcgtaacgcgtatgcaatctaccttttactaagggatagcccagagaaatttggattaataccttatagtatgtttgaatggcatcgtttagacattaaagatttattggtaaaagatgagcatgcgtcccattagttagttggtaaggtaacggcttaccaagacgatgatgggtaggggtcctgagagggagatcccccacactggtactgagacacggaccagactcctacgggaggcagcagtgaggaatattggtcaatggaggcaactctgaaccagccatgccgcgtgcaggatgacggtcctatggattgtaaactgcttttgtacaggaagaaaaagagtcacgtgtggcttattgacggtactgtaagaataaggatcggcta

SEQ ID NO: 3132 - DNA, 490 bp, Unknown
  Ascusbbf_130070, encodes 16S rRNA
agagtttgatcctggctcaggatgaacgctagcggcaggcttaacacatgcaagtcgaggggcagcgagatgtagcaatacattgtcggcgaccggcagacgggtgcgtaacgcgtatgcaacctacccaccacaggggtatagcccggcgaaagccggaataatcccccatggttccaacccaccgcatgatgagttggataaacccgcgagggggtgatggatgggcatgcgtggcattaggcagttggcggggtaacggcccaccaaaccgacgatgcctaggggtcctgagagggaggtcccccacattggaactgagacacggtccaaactcctacgggaggcagcagtgaggaatattggtcaatgggcgagagcctgaaccagccatgccgcgtgcaggaagacggccttatgggttgtaaactgcttttattggggacgagcatgagtacgcgtactcaaatgacggtacccgatgaataag

SEQ ID NO: 3133 - DNA, 490 bp, Unknown
  Ascusbbf_113777, encodes 16S rRNA
agagtttgatcatggctcaggatgaacgctggcggcgtgcctaatacatgcaagtcgatcgcactacttcggtagtgagaggcgaacgggtgagtaacacgtaggtaacatgtccatatgacgaggataacggttggaaacgactgctaagactggataggagtagaggaggcatctcttctactttaaaggactcgaaagagtacgcgtatggagtgacctgcggcgcattagttagttggtggggtagaggcctaccaagacgatgatgcgtagccggactgagaggttgaacggccacattgggactgagacacggcccagactcctacgggaggcagcagtagggaattttcggcaatggggggaaccctgaccgagcaacgccgcgtgaatgacgaagtacttcggtatgtaaagttcttttattaaggaagaaagtgcagtggaaaaactgtatagacggtacttattgaataagccccggcta

SEQ ID NO: 3134 - DNA, 490 bp, Unknown
  Ascusbbf_723739, encodes 16S rRNA
agagtttgatcatggctcaggatgaacgctggcggcgtgcctaacacatgcaagtcgaacggagatagaacgctgtcgagacttcggtcaaaacttgttttatcttagtggcggacgggtgagtaacgcgtggagaacctgcctcgtactgggggataacagttggaaacgactgataataccgcataagcccacgagaccgcatggtcatgagggaaaagatttatcggtacgagatggatccgcgtctgattagccagttggcggggtaacggcccaccaaagcgacgatcagtagccggcctgagagggcggacggccacattgggactgagacacggcccaaactcctacgggaggcagcagtgggggatattgcacaatgggggaaaccctgatgcagcgacgccgcgtgagtgaagaagtatttcggtatgtaaagctctatcagcagggaagaaaggcctcgcaagaggagatgacggtacct

SEQ ID NO: 3135 - DNA, 490 bp, Unknown
  Ascusbbf_467110, encodes 16S rRNA
agagtttgatcatggctcaggacgaacgctggcggcgtgcctaatacatgcaagtcgagcgaatgattagagaagcttgcttctctctgatttagcggcggacgggtgagtaacacgtgggtaacctaccctatagactgggataacttcgggaaaccggagctaataccggataatacttcgaaacacatgttttgaagttgaaagatggtttcggctatcactataggatggacccgcggcgcattagctagttggtgaggtaacggctcaccaaggcaacgatgcgtagccgacctgagagggtgatcggccacactgggactgagacacggcccagactcctacgggaggcagcagtagggaatcttccacaatggacgaaagtctgatggagcaacgccgcgtgagtgaagaaggatttcggttcgtaaaactctgttgcaagggaagaacaagtagcgtagtaactggcgctaccttgacggta

SEQ ID NO: 3136 - DNA, 490 bp, Unknown
  Ascusbbf_678003, encodes 16S rRNA
agagtttgatcatggctcaggatgaacgctggcggcgtgcttaacacatgcaagtcgaacggtgaaagaagagcttgctcttctggatcagtggcgaacgggtgagtaacacgtgagcaacctgcccttcactctgggataacacttggaaacaggtgctaataccggatacaagcctcggaggcatctccagaggctggaaagaacctcggtgagggatgggctcacggcctatcaggtagttggtgaggtaaaggctcaccaagccgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcaaggaagaagcgaaagtgacggtacttgcagaaaaagcgccggctaactacgtgcc

SEQ ID NO: 3137 - DNA, 490 bp, Unknown
  Ascusbbf_1542555, encodes 16S rRNA
agagtttgatcctggctcaggacgaacgctggcggcgcgcctaacacatgcaagtcgaacggaactagtgaccagaggctagaattgatctggtctgtggtcactagttcagtggcggacgggtgagtaaagcatgagcaacctgcctaatagagggggatagcttttggaaacagaagataataccgcatgaatcagagatttcgcatgaagtttttggaaaaggagcaatccgctattagatgggctcatgtccgattagctagttggtgaggtaatggcttaccaaggcgacgatcggtagccgtactgagaggttcaacggccacattgggactgagacacggcccagactcctacgggaggcagcagtgaggaatattgcgcaatggaggaaactctgacgcagcgacgccgcgtgaaggaagaaggtcttcggattgtaaacttctgtcctcagggaagaaacaaatgacggtacctgaggagg

SEQ ID NO: 3138 - DNA, 490 bp, Unknown
  Ascusbbf_1334350, encodes 16S rRNA
agagtttgatcctggctcaggacgaacgctggcggcgtgcttaacacatgcaagtcgaacgaagcactgaaattgatttcttcggaatgatttttctttgactgagtggcggacgggtgagcaacacgtgagcaacctgcctttcagagcgggatagcagttggaaacgactgataataccgcatgacatgttttctccgcatgaggaaaacatcaaatgatttttcgctgaaagatgggctcgcgtccgattaggtagttggtgaggtaacggctcaccaagccgacgatcggtagccggactgagaggtcgatcggccacattgggactgagacacggcccagactcctatgggaggcagcagtgggggatattgcacaatgggcgcaaggctgatgcagcaacgccgcgtgagggaggacggtcttcggattgtaaagctctgttgtcggggacgaaggggcagatcaggaaatgggtgtgcttaga

SEQ ID NO: 3139 - DNA, 490 bp, Unknown
  Ascusbbf_114578, encodes 16S rRNA
agagtttgatcatggctcaggacgaacgctggcggcgtgcttaacacatgcaagtcgaacgaggttattggagagcttgctcgaagataaccgagtggcggacgggtgagtaacgcgtgaacaatctgtctcacacaggggaataacgcatcgaaagatgtgctaataccgcataggaccacagcatcgcatggtgcagaggtgaaaggagcaatccggtgtgaggtgagttcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgcaagcctgacccagcaacgccgcgtgaaggaagaaggttttcggatcgtaaacttctgtcctatgagaagatagtgacggtatcataggaggaagccccggctaactacgtg

SEQ ID NO: 3140 - DNA, 490 bp, Unknown
  Ascusbbf_72445, encodes 16S rRNA
agagtttgatcctggctcaggatgaacgctggcggcgcgcctaacacatgcaagtcgaacggtgaagtcccttcgggggctgatcagtggcggacgggtgagtaacgcgtgaggaacctgcccttatgagcggaataacgtcgggaaactgacgctaataccgcataatgcatcaccggggcatcgcggtgatgccaaagcttcggcgcataaggatggactcgcgtcccattagatagttggcggggcaacggcccaccaagtcagcgatgggtagccggactgagaggttgaacggccacattggaactgagagacggtccagactcctacgggaggcagcagtggggaatattgggcaatgggcggaagcctgacccagcgacgccgcgtgagcgaagaaggtcttcggattgtaaagctctgtgtacagggacgataatgacggtacctgtatagaaagccacggctaactacgtgccagcagccg

SEQ ID NO: 3141 - DNA, 490 bp, Unknown
  Ascusbbf_455769, encodes 16S rRNA
agagtttgatcatggctcaggatgaacgctggcggcgtgcctaatacatgcaagtcgaacgaattaccttcgggtagttagtggcgaacgggtgagtaacacgtagataacctacctttaactcgaggataactttgggaaaccggagctaatactggataggatgtgcttatgaaaaaaacacatttaaagattaatcggtttaagaggggtctgcggcgcattagttagttggtggggtaaaggcctaccaagacaatgatgcgtagccggactgagaggtctaccggccacattgggactgagaacggcccaaactcctacgggaggcagcagtagggaattttcggcaatggggggaaccctgaccgagcaacgccgcgtgaacgacgaagtacttcggtatgtaaagttcttttatatgggaagaaaaagcaattattgacggtaccatatgaataagccccggctaactatgtgccagcagccg

SEQ ID NO: 3142 - DNA, 488 bp, Unknown
  Ascusbbf_601589, encodes 16S rRNA
agagtttgatcctggctcagaacgaacgctggcggcaggcttaacacatgcaagtcgagcgccccgcaaggggagcggcagacgggtgagtaacgcgtgggaatctacccatctctacggaataactcagggaaacttgtgctaataccgtatacgcccttcgggggaaagatttatcggagatggatgagcccgcgttggattagctagttggcggggtaacggctcaccaaggcaacgatcagtaggggttctgagaggaaggtcccccacattggtactgagacacggaccaaactcctacgggaggcagcagtgaggaatattggtcaatgggcgcaagcctgaaccagccaagtagcgtgcaggatgactgccctatgggttgtaaactgcttttatacggggataaagtcagggtcgtgaccctgtttgcaggtaccgtatgaataaggaccggctaattccgtgccagcagccgcggtaat

SEQ ID NO: 3143 - DNA, 490 bp, Unknown
  Ascusbbf_562234, encodes 16S rRNA
agagtttgatcctggctcaggatggacgctagcggcaggcttaacacatgcaagtcgaggggcagcactggtagcaatacttggtggcgaccggcgcaagggtgcgtaacgcgtgagcaacatgcccgtatcagggggataatccagggaaacttggtctaataccccatagtaagtttttgaggcatctcaaggattttaaagctttggtggatacggattggctcgcgtgacattagctagatggtaaggtaacggcttaccatggctacgatgtctaggggttctgagaggaaggtcccccacactggaactgagacacggtccagactcctacgggaggcagcagtgaggaatattggacaatggatggaaatctgatccagccatgccgcgtgcaggaagacggccctatgggttgtaaactgcttttgtatgggagcaataagatctacgtgtagattgatgagagtaccatacgaataagcac

SEQ ID NO: 3144 - DNA, 490 bp, Unknown
  Ascusbbf_1371795, encodes 16S rRNA
agagtttgatcatggctcaggatgaacgctggcggcgtgcttaacacatgcaagtcgaacggagttatctcgctgaggagagcttgctcaaatcttgagataacttagtggcggacgggtgagtaacgcgtggataacctgccttataccgggggataacacttagaaataggtgctaataccgcataagcgcacgatcccgcatgggaaagtgtgaaaaactccggtggtataagatcgatccgcttctgattagatagttggtgaggtaacggccaaacaagtcaacgatcagtagccgggctgagaggatgaacgacaacattgggactgagaaacggcccaaaatcctacgggaggaagcagtggggaagagtgcacaatgggggaaaccctgctgcagcgacgccgcgtgagtgaagaagtatttcggtatgtaaagctctatcagcaaggaagaaaaaaatgacggtacttgactaagaagccc

SEQ ID NO: 3145 - DNA, 490 bp, Unknown
  Ascusbbf_1331, encodes 16S rRNA
agagtttgatcatggctcaggacgaacgctggcggcgtgcctaacacatgcaagtcgaacggagcgaaaagagcttgctcttggagcttagtggcggacgggtgagtaacacgtgagcaacctgcctttcagagtggaataatgtttggaaacggacactaataccgcataacatattgaatctgcatggatttaatatcaaaggagcaatccgctgaaagatgggctcgcgtctgattagccagttggcggggtaacggcccaccaaagcgacgatcagtagccggactgagaggttgaacggccacattgggactgagacacggcccagactcctacgggaggcagcagtgggggatattgcacaatgggggaaaccctgatgcagcaacgccgcgtgcaggatgacggtcttcggattgtaaactgttgtcctctgtgacgataatgacggtagcagaggaggaagccacggctaactacgtgccag

SEQ ID NO: 3146 - DNA, 490 bp, Unknown
  Ascusbbf_32719, encodes 16S rRNA
agagtttgatcatggctcagaacgaacgctggcggcgcgtcttaagcatgcaagtcgagcggtaagacagtagcttgctactgtcctagagcggcggactggtgagtaacgcgtgggtgacgtaccctgaggacggggatagcctgtggaaacacagggtaataccggataagctcgtatgtgtcagaggcatacgaggaaaggttcttttgaaccgccttaggagcggcccgcgggctattagctagttggcggggtaacggcccaccaaggcgacgatagctacccggcctaagagggtgaacgggcacattgggactgagatacggcccagactcctacgggaggcagcagctaagaatattccgcaatgggggaaaccctgacggagcgacgccgcgtggatgatgaaggccggaaggttgtaaaatccttttggaagcgaggaataattaaagtgagagaaacgctttgaggtgacggtagcttc

SEQ ID NO: 3147 - DNA, 490 bp, Unknown
  Ascusbbf_49230, encodes 16S rRNA
agagtttgatcctggctcaggatgaacgctagcggcaggcttaacacatgcaagtcgaggggcagcgggtccagcaatggatgccggcgaccggcgaaagggtgagtaacgcgtgagcaacatgcccgacactgggggatagtcgatggaaacgtcgcgtaataccccgtaacacaggaggccgcatgaccttctgttgaaagattcattggtgtcggattggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggatgaatgccctatgggttgtaaaccgcttttgccggggagcaataaggtccacgtgtggaccgacgagagtacccggcgaataagcatc

SEQ ID NO: 3148 - DNA, 490 bp, Unknown
  Ascusbbf_456340, encodes 16S rRNA
agagtttgatcctggctcaggatgaacgctggcggcgtgcttaacacatgcaagtcgaacggagtatatgtgaaacttacgttgatcatatacttagtggcggacgggtgagtaacgcgtgggtaacctacctcacacagggggataacagttggaaacgactgctaaaaccgcataacatggcgataccgcatgacattgccatcaaatatttataggtgtgagatgggcccgcgtctgattagctagttggtgaggtaacggcccaccaaggcgacgatcagtagccggcttgagagagtgaacggccacattgggactgagacacggcccaaactcctacgggaggcagcagtgggggatattggacaatgggggaaaccctgatccagcgacgccgcgtgagtgaagaagtatttcggtatgtaaagctctatcagcagggaagaaaaagcgcaagcattgactgtacctgactaagaagccccgg

SEQ ID NO: 3149 - DNA, 490 bp, Unknown
  Ascusbbf_188521, encodes 16S rRNA
agagtttgatcatggctcaggatgaacgctggcggcaggcttaatacatgcaagtcgaacggtaaggtccgaggtagcaataccgaggatacacgagtggcgcacgggtgcgtaacgcgtatgcaacctacctttgactggaacataacgttgagaaatcggcgctaatattccatgtggttatgacccggcatcgggatgtaactaaagatttattggtcaaggatgggcatgcgtatcattagctagttggcggggtaacggcccaccaaggcgacgatgattaggggttctgagaggattaccccccacactggaactgagacacggtccagactcctacgggaggcagcagtagggaatattgggcaatggaggcaactctgacccagccatgccgcgtgcaggaagacggccctatgggttgtaaactgcttttgtcatggagtaaggcgggggacgtgtcccccgttgcaagtacatgacgaat

SEQ ID NO: 3150 - DNA, 490 bp, Unknown
  Ascusbbf_251630, encodes 16S rRNA
agagtttgatcctggctcagattgaacgctagcgggatgccttacacatgcaagtcgaacggcagcataagagagcttgctctcttgatggcgagtggcgaacgggtgagtaatgtatcggaacgtgcccagtagcgggggataactacgcgaaagcgtagctaataccgcatacgccctacgggggaaaggaggggatccgcaaggacctttcactattggagcggccgatatcggattagctagttggtgaggtaagggctcaccaaggcgacgatccgtagctggtttgagaggacgaccagccacactgggactgagacacggcccagactcctacgggaggcagcagtggggaattttggacaatgggggaaaccctgatccagccatctcgcgtgtgcgatgaaggccttcgggttgtaaagcacttttgtcagggaagaaaagttttttgctaataccagaaaacgctgacggtacctgaaga

SEQ ID NO: 3151 - DNA, 490 bp, Unknown
  Ascusbbf_510118, encodes 16S rRNA
agagtttgatcatggctcaggatgaacgctagcggcaggcttaacacatgcaagtcgaggggcagcgcggggtagcaatactctggcggcgaccggcggaagggtgagtaacgcgtgagcaacatgcccgtaagcgggggatagtcggtggaaacgccgcgtaataccccgtaacacttgaggcggcatcgcctgaagttgaaagattaatcgcttacggattggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgacggaatgaggccctacgggtcgtaaacgtcttttagtcgggagcaataaggggcacgcgctgtcccgatgagagtaccgattgaataagc

SEQ ID NO: 3152 - DNA, 474 bp, Unknown
  Ascusbbf_118302, encodes 16S rRNA
agagtttgatcctggctcagagtgaacgctggcggcatgcttaacacatgcaagtcgtgcggggggtttcggcccctagcggcggacgggtgagtaacgcgtagggatgtgtccagaggtgggggataacgctgggaaactggcgctaataccgcatgcgggctgaggcccaaagccttcgggcgcctttggagtaacctgcgtccgattagctagttggtggggtaaaggcctaccaaggcgacgatcggtagctggtctgagaggacgatcagccacactgggactgagacacggcccagactcctacgggaggcagcagtggggaatattggacaatgggcgcaagcctgatccagcaatgccgcgtgggtgaagaaggtcttcggatcgtaaagccctttcggcggggacgatgatgacggtacccgcagaagaagccccggctaacttcgtgccagcagccgcggtaat

SEQ ID NO: 3153 - DNA, 490 bp, Unknown
  Ascusbbf_1535975, encodes 16S rRNA
agagtttgatcatggctcaggacgaacgctggcggcgtgcttcatacatgcaagtcgaacgataaggtctcttcggagatacataagtggcggacgggtgagtaaaatgtagagaatctaccttcaagagggggacaacgattggaaacgatcgctaataccccatatgcgcgtacctgagatggtattcgtgaaagctccggtgcttggagatgagtctgcatctgattagctagttgagggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgatcgagacgcttttcggagtgtaaagatctgtcaatagggacgaacaaatgacggtacctatagaggaagcaccggctaactccgtgccagcagccgcg

SEQ ID NO: 3154 - DNA, 490 bp, Unknown
  Ascusbbf_388160, encodes 16S rRNA
agagtttgatcatggctcaggatgaacgctagcggcaggcctaatacatgcaagtcggacggtattcccccttcgggggggagagagtggcgcacgggtgcgtaacgcgtatgcaacctgccccttactgggggatagcccggggaaacccggattaataccccatgttgcggagctccggcatcggaattccgccaaaggcctcggccggtaagggatgggcatgcgtaggattagctagttggcggtgtaacggaccaccaaggcttcgatccttaggggttctgagaggaaggtcccccacactggcactgagatacgggccagactcctacgggaggcagcagtagggaatattgggcaatgggcggtagcctgacccagccatgccgcgtgcaggaagacggcgttctgcgttgtaaactgcttttatacgggaagaaaaggcccatgcgtgggacattgccggtaccgtatgaataagcaccgg

SEQ ID NO: 3155 - DNA, 490 bp, Unknown
  Ascusbbf_556388, encodes 16S rRNA
agagtttgatcctggctcaggatgaacgctggcggcgtgcctaacacatgcaagtcgagcgggaatctgttgattgaaacttcggtcgaaagaagcagaggatggcggcggacgggtgagtaacgcgtaggtaacctgccccttacacagggatagcctcgggaaactgggattaatacctgataaagcgtcggagtcacatggctctgacgccaaagatttatcggtgagggatggacctgcgtctgattagctggttggtgaggtaacggcccaccaaggcaacgatcagtagccgacctgagagggtaatcggccacattggaactgagacacggtccaaactcctacgggaggcagcagtagggaatattgcacaatgggcgcaagcctgatgcagcaacgccgcgtgagcgaagaaggtcttcggatcgtaaagctctgtcctgaggaacgaagaagtgacggtacctcgggaggaagccccggc

SEQ ID NO: 3156 - DNA, 490 bp, Unknown
  Ascusbbf_671375, encodes 16S rRNA
agagtttgatcctggctcaggatgaacgctagctacaggcttaacacatgcaagtcgaggggcatcatggcggtggcttgccaccgccgatggcgaccggcgcacgggtgagtaacgcgtatccaacctgcccccaaccgcggcacagcccgccgaaaggcggattaattccgcatgtggtcgtgatgtgacatcttttcacgactaaaggttcactccggttggggatggggatgcgtccgattaggcagcaggcggggtgacggccacctggccgacgatcggtaggggttctgagaggaaggtcccccacactggtactgagacacggaccagactcctacgggaggcagcagtgaggaatattggtcaatgggcggaagcctgaaccagccaagtagcgtgagggatgacggccctacgggttgtaaacctctttttcgcggggataaacttcgggacttgtcccgttttgcaggtaccgcgtgaa

SEQ ID NO: 3157 - DNA, 490 bp, Unknown
  Ascusbbf_639488, encodes 16S rRNA
agagtttgatcatggctcaggatgaacgctagcggcaggcttaacacatgcaagtcgaggggcaacgcgagtagcaatacttggcggcgaccggcgcaagggtgcgtaacgcgtgagcaacatgcccgtatcagggggataatccagggaaacttggtctaataccccatagtaattttgtaaggcatcttataagatttaaagctttggtggatacggattggctcgcgtgacattagctggatggtaaggtaacggcttaccatggctatgatgtctaggggttctgagaggaaggtcccccacactggaactgagacacggtccagactcctacgggaggcagcagtgaggaatattggacaatggatggaaatctgatccagccatgccgcgtgaaggaagaaggtcctatggattgtaaacttcttttgtatgggagcaataaggcctacgagtaggttgatgagagtaccatacgaataagcac

SEQ ID NO: 3158 - DNA, 362 bp, Unknown
  Ascusbbf_1635522, encodes 16S rRNA
agagtttgatcctggctcaggatgaacgctagcggcaggcttaatacatgcaagtcgaacggtaacatagagtagcaatactctgatgacgagtggcggatgggtgcgtaacgcgtatgtgacctacccatattcgggacaaaacatcgagaaattggtgctaatatcctatatgtctacgagctgcatggtttgtagatgaaagtcgcgagatgaatatggatgggcatgcgtgccattagctagttggtaaggtaacggcttaccaaggcgacgatggctaggggctctgagaggattaccccccacattggaactgagacacggtccaaactcctacgggagccagcagccgcggtaat

SEQ ID NO: 3159 - DNA, 490 bp, Unknown
  Ascusbbf_659346, encodes 16S rRNA
agagtttgatcatggctcaggatgaacgctagcggcaggcctaacacatgcaagtcgaggggtatttggagcttgctccaaagagaccggcgcacgggtgcgtaacgcgtatgcaatctaccttatactaagggatagcccggagaaatccggattaataccttatagttaatttggttggcatcagccgaattataaagatttatcggtataagatgagcatgcgtcccattagttagttggtgtggtaacggcataccaagacgatgatgggtaggggtcctgagagggagatcccccacactggtactgagacacggaccagactcctacgggaggcagcagtgaggaatattggtcaatggaggcaactctgaaccagccatgccgcgtgcaggaagaatcatctatggtgtgtaaactgcttttgtacgggaagaaaaagaattacgagtaatttattgacggtaccgtaagaataaggatcggc

SEQ ID NO: 3160 - DNA, 490 bp, Unknown
  Ascusbbf_1377159, encodes 16S rRNA
agagtttgatcatggctcaggatgaacgctagcgataggccttacacatgcaagtcgaggggcagcacaaagaatcgtagcaatacaatttttggtggcgaccggcgcacgggtgagtaacgcgtatgcaacctacctactactttggcatagctcgttgaaagacgaattaataccttataatacaggggctccgcatggagatatttgttaaagatttatcggtagtagatgggcatgcgttccattagttagttggcgaggtaacggctcaccaagacaacgatggataggggaactgagaggattgcaccccacactggaactgagacagggtccagactcctacgggaggcagcagtgaggaatattggtcaatggaggagactctgaaccagccaagtcgcgtgaaggatgactgccctacgggttgtaaacttcttttttaagggaataaagtgagctacgtgtagctttttgcaagtacctt

SEQ ID NO: 3161 - DNA, 490 bp, Unknown
  Ascusbbf_1558216, encodes 16S rRNA
agagtttgatcctggctcaggatgaacgctagcggcaggcttaacacatgcaagtcgaggggcagcggggtagcaataccgccggcgaccggcaaacgggtgcggaacacgtacgcaacttaccctaaactggtgaatagccttcggaaacgaagattaatacaccgtaaaatagttgagtggcatcacttgattataatagctccggcggtttaggatgggcgtgtgtcccattagctagttggtaaggtaacggcttaccaaggcgacgatgggtaactggtgtgagagcacgaccagtcacacgggcactgagacacgggcccgactcctacgggaggcagcagtgaggaatattggtcaatggacgcaagtctgaaccagccatgccgcgtgaaggatgaaggcgttctgcgttgtaaacttcttttatctgggaagaaacctccgatttctattggagccgacggtaccagaggaataagcaccg

SEQ ID NO: 3162 - DNA, 490 bp, Unknown
  Ascusbbf_1270773, encodes 16S rRNA
agagtttgatcatggctcaggatgaacgctagcgataggcttaacacatgcaagtcgaggggcagcattggcgtagtttactacaacagatggcgaccggcggatgggtgagtaacgcgtatgcaacctaccctctacagggggatagcccgaagaaattcggattaacaccgcataataatttagggtcgcatgattttagatttaaaaatttattggtagaggatgggcatgcgttccattagttagttggtaaggtaacggcttaccaagacatcgatggataggggaactgagaggtttatcccccacactggaactgagatacggtccagactcctacgggaggcagcagtgaggaatattggtcaatgggcgaaagcctgaaccagccaagtcgcgtgaaggaagacggttctatggattgtaaacttcttttataagagagtaaaggacggtacgcgtactgttttgcaagtatcttatgaat

SEQ ID NO: 3163 - DNA, 490 bp, Unknown
  Ascusbbf_18828, encodes 16S rRNA
agagtttgatcatggctcaggatgaacgctggcggcgtgcctaatacatgcaagtcgaacgcatatcttcgggtatgagtggcgaacgggtgagtaacacgtaggtaacctgcccataagacgaggataactactggaaacggtagctaatactggatagtatatagaatcgcatgattttatatttaaagatgcctcaaagcatcacttatggatggacctgcggtgcattagctagttggtgagataacggcccaccaaggcgacgatgcatagccggactgagaggttgaacggccacattgggactgagacacggcccagactcctacgggaggcagcagtagggaattttcggcaatggacgcaagtctgaccgagcaacgccgcgtgagtgatgaagttcttcggaacgtaaaattcttttatttggaaaaaacgtatagtgtaggaaatgacattatagtgatggtaccaaatgaataagccc

SEQ ID NO: 3164 - DNA, 490 bp, Unknown
  Ascusbbf_33524, encodes 16S rRNA
agagtttgatcatggctcaggatgaacgctggcggcgtgcctaatacatgcaagtcgaacgggagtgcttgcactccagtggcgaacgggtgagtaacacgtaggtaatctagcattaagacgaggatagcttctagaaatgggagataatactggataggaaattttcctgcatggggaaatttttaaagatttatcgcttaatggggagcctgcggtgcattagctagatggtgagggtaacggcccaccatggcgatgatgcatagccggtctgagaggacgaacggccacattgggactgagaacggcccaaactcctacgggaggcagcagtagggaattttcggcaatgggcggaagcctgaccgagcaacgccgcgtgattgaagaagtatttcggtatgtaaaaatcttttatttgggacgaaaaaatcaaaattgacggtaccaaatgaataagccccggctaactacgtgccagcagccg

SEQ ID NO: 3165 - DNA, 490 bp, Unknown
  Ascusbbf_725231, encodes 16S rRNA
agagtttgatcctggctcagaacgaacgctggcggcgtgcttaacacatgcaagtcgaacggagtattcctcccgcagattgaagaagcttgcttctgattgaagcatttggaatacttagtggcggacgggtgagtaacgcgtgggtaacctgcctcacactgggggatagcagttggaaacgactgataataccgcataagcgcacagtaccgcatggtatggtgtgaaaaactccggtggtgtgagatggacccgcgtctgattagctagttggtgaggtaacggcccaccaaggcgacgatcagtagccggcctgagagggtgtacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgac

SEQ ID NO: 3166 - DNA, 490 bp, Unknown
  Ascusbbf_259579, encodes 16S rRNA
agagtttgatcatggctcagaacgaacgctggcggcgcgtcttaaccatgcaagtcgagcgggaatatggggcttgccctatatgagagcggcggactggtgagtaacacgtgggtgatgtacctttcggacggggacagcccgcagaaatgcggggtaataccggatacgatccgtagtgtaaaggctatggaagaaaggagcttcggctccgccgaaagatcggcctgcgacccatcagctagacggcggggtaacggcccaccgtggcaacaacgggtatccggcctgagagggcggacggacacattgggactgagatacggcccagactcctacgggaggcagcaggtaagaatattccgcaatgggggaaaccctgacggagcgacgccgcgtgtgcgaagaaggccggaaggttgtaaagcactttggtggtcgaagaataaagtgggtagggaatgacctacagatgacggtagaccaagaa

SEQ ID NO: 3167 - DNA, 490 bp, Unknown
  Ascusbbf_85872, encodes 16S rRNA
agagtttgatcatggctcagattgaacgctggcggcaggcttaacacatgcaagtcgagcggtaacaggggtagcttgctacccgctgacgagcggcggacgggtgagtaatgcttaggaatctgcccagtagtgggggacaacagtcggaaacggctgctaataccgcatacgccctacgggggaaagcaggggatcttcggaccttgcgctattggatgagcctaagtcggattagctagttggtggggtaaaggcctaccaaggcgacgatccgtagctggtctgagaggatgatcagccacatcgggactgagacacggcccgaactcctacgggaggcagcagtggggaatattggacaatgggggaaaccctgatccagccatgccgcgtgtgtgaagaaggctttcgggttgtaaagcactttcagcgaggaggaaggccttaaagctaatacctttaaggattgacgttactcgcagaagaa

SEQ ID NO: 3168 - DNA, 490 bp, Unknown
  Ascusbbf_115645, encodes 16S rRNA
agagtttgatcatggctcaggataaacgctggcggcgtgcttaacacatgcaagtcgaacggagtggttctcccgaggatcgataaagcttgcttttgaaagactcatttgaatcacttagtggcggacgggtgagtaacgcgtgggtaacctgcctcacactgggggatagcagttggaaacgactgataataccgcataagcgcacagcttcgcatgaagcagtgtgaaaaactccggtggtgtgagatggacccgcgtctgattagctagttggtgaggtaacggcccaccaaggcgacgatcagtagccggcctgagagggtgtacggccacattgggactgagacacggcccaaactcctacgggaggcagcagtggggaatattggacaatgggggcaaccctgatccagcgacgccgcgtgaacgaagaagtatctcggtatgtaaagttctatcagcagggaagataatgacggtacctgac

SEQ ID NO: 3169 - DNA, 490 bp, Unknown
  Ascusbbf_160669, encodes 16S rRNA
agagtttgatcatggctcagattgaacgctagcgggatgctttacacatgcaagtcgaacggcagcgcgagagagcttgctctcttggcggcgagtggcggacgggtgagtaatatatcggaacgtgcccagtagcgggggataactactcgaaagagtggctaataccgcatacgccctacgggggaaagggggggatcgcaagacctctcactattggagcggccgatatcggattagctagttggtggggtaaaggctcaccaaggcaacgatccgtagctggtttgagaggacgaccagccacactgggactgagacacggcccagactcctacgggaggcagcagtggggaattttggacaatgggggaaaccctgatccagccatcccgcgtgtatgatgaaggccttcgggttgtaaagtacttttggcagagaagaaaaggtacctcctaatacgaggtactgctgacggtatctgcagaat

SEQ ID NO: 3170 - DNA, 490 bp, Unknown
  Ascusbbf_715479, encodes 16S rRNA
agagtttgatcatggctcaggatgaacgctggcggcgtgcttaacacatgcaagtcgaacgaagcttgatgaatgattccttcgggatgaattctgatatgacttagtggcggacgggtgagtaacgcgtgaggaacctgcctttcagagggggacaacatttggaaacgaatgctaataccgcataacactttcttatggcatcttagggaagtcaaagatttatcgctgaaagatggcctcgcgtccaattagttagttggcggggtaacggcccaccaagacgacgattggtagccggactgagaggttgaacggccacattgggactgagacacggcccagactcctacgggaggcagcagtggggaatattgcacaatgggcgcaagcctgatgcagcaacgccgcgtgggggaagacggttttcggattgtaaacccctgttcttagtgacgaagaagtgacggtagctaaggagcaagccacg

SEQ ID NO: 3171 - DNA, 490 bp, Unknown
  Ascusbbf_1587830, encodes 16S rRNA
agagtttgatcctggctcaggatgaacgctagctacaggcttaacacatgcaagtcgagcggtaacgcgggggcaaccctggcgacgagcggcgaacgggtgagtaatgcttcggaatctccctagtggtggggaataacttggggaaactcaagctaataccgcatacgacctacgggtgaaagcaggggatcgcaagaccttgcgccattggatgagccgaagtcggattagctagttggtggggtaatggcctaccaaggcgacgatccgtagctggtctgagaggacgaccagccacactgggactgagacacggcccagactcctacgggaggcagcagtggggaatattggacaatgggggaaaccctgatccagcgacgccgcgtgtgtgaagaaggcctgcgggttgtaaagcacttttagtggggatgaaaagccaagggctaataccctttggtcttgacctaacccaaagaaaaagcac

SEQ ID NO: 3172 - DNA, 490 bp, Unknown
  Ascusbbf_257972, encodes 16S rRNA
agagtttgatcatggctcaggataaacgctggcggcgtgcataacacattcaagtcgaacgaagctcctaagcttgcttgcaagcgagggaagacttagtggcggacgggtgagtaacgcgtgagcaatctgcctcggggtgcgggataacgtttggaaacgaacgctaataccgcataacgcatgagagtcgcatggttttcatgccaaagatttattgccctgagatgagctcgcgtccgattagacagttggcggggtaacggcccaccaaatctacgatcggtagccggactgagaggttgaacggccacattggaactgagatacggtccagactcctacgggaggcagcagtggggaatattgggcaatggacgaaagtctgacccagcgacgccgcgtgagggaagaaggtcttcggattgtaaacctctttcagcagggaagaaggaagtgacggtacctgcagaagaagccacggctaact

SEQ ID NO: 3173 - DNA, 490 bp, Unknown
  Ascusbbf_100665, encodes 16S rRNA
agagtttgatcctggctcaggatgaacgctggcggcgtgcttcatacatgcaagtcgaacgtgaagctgacttcggtcagtggaaagtggcggacgggtgagtaatacataggaaatctgcccttagctgggggacaacagttggaaacgactgctaataccgcatatgagcttagttgaaatactaatcttgaaaactccggtggctaaggatgagcctgtgcctgattagctagttggtggtgtaatggactaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgtgtgatgaagcccctaggggtgtaaaacactgtcagtagggacgaattttgacggtacctacagaggaagcaccggctaactccgtgccagcagccgcg

SEQ ID NO: 3174 - DNA, 490 bp, Unknown
  Ascusbbf_1502255, encodes 16S rRNA
agagtttgatcctggctcaggatgaacgctggcggcgtgcctaacacatgcaagtcgagcgggaatcgatggacagaggcttcggccgaagaaagtcgaggagagcggcggacgggtgagtaacgcgtaggtaacctaccttatgcacagggatagccccgggaaactggaattaatacctgataacgcgatggagtcacatggttctatcgccaaagatttatcggcatgagatggacctgcgtctgattagctggttggtgaggtaacggcccaccaaggcgacgatcagtagccgacctgagagggtaatcggccacattggaactgagacacggtccaaactcctacgggaggcagcagtggggaatattacacaatgggcgcaagcctgatgtagcaacgccgcgtgagcgaagaaggtcttcggatcgtaaagctctgtccttggggacgaaggaagtgacggtacccaaggaggaagccccgg

SEQ ID NO: 3175 - DNA, 490 bp, Unknown
  Ascusbbf_977079, encodes 16S rRNA
agagtttgatcatggctcagattgaacgctggcggcaggcctaatacatgcaagtcgaacgataaggttccttcgggaatacataagtggcggacgggtgagtaatatgtagagaatctgccctagagagggggacaacagagggaaacttctgctaataccccatatgcgcgtagttgcgatactattcgtgaaagatttatcgctctaggatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgatcgcagacggccttcgggttgtaaagatctgtcagtagggacgaagaatgactgtacttacagaggaagcaccggctaactccgtgccagcagccgcg

SEQ ID NO: 3176 - DNA, 490 bp, Unknown
  Ascusbbf_958170, encodes 16S rRNA
agagtttgatcctggctcagaatcaacgctggcggcgtgcctcagacatgcaagtcgaacgattaaagctcccttcggggagtgtataaagtggcgcacgggtgagtaacacgtaagtaatctaccttcgagtggggaataacgtccggaaacgggcgctaataccgcataatgcagcggcatcgcaaggtgacagttgttaaagtagcaattcgcttgaagaggagcttgcggcagattagctagttggtagggtaacggcctaccaaggctacgatctgtatccggcctgagagggcggtcggacacactgacactgaataacgggtcagactcctacgggaggcagcagtcgggaattttgggcaatgggggaaaccctgacccagcaacgccgcgtgaaggatgaagtatttcggtatgtaaacttcgaaagaataggaagaataaatgacggtactatttataaggtccggctaactacgtgcca

SEQ ID NO: 3177 - DNA, 490 bp, Unknown
  Ascusbbf_1880805, encodes 16S rRNA
agagtttgatcctggctcagaatgaacgctggcggcatggattaggcatgcaagtcgaacggcagggcagcgatgcccgagagtggcgaaagggtgagcaacgcgtgaggaacctgcccccgggaccggaacaagcctgtgaaaacgggtctgagaccggatgacgccccgcaccgcatggcgcggaggcgaaacattacatggcccggggagggcctcgcgtcccattagcttgttggcggggtgacggcccaccaaggcgacgacgggtaggtggtctgagaggatggtcacccacactgggactgagacactgcccagactcctacgggaggctgcagtcgagaatcttccgcaatgggcgcaagcctgacggagcgatgccgcgtgagggaagaaggccttcgggtcgtaaacctctgtcggacgggacgaaaccaaatgacggtaccgtccaaggaagccacggctaactacgtgccagcagccg

SEQ ID NO: 3178 - DNA, 490 bp, Unknown
  Ascusbbf_1623748, encodes 16S rRNA
agagtttgatcctggctcaggatgaacgctagcggcaggcctaatacatgcaagtcggacgggatccgtcttcgagcttgctcggagatggtgagagtggcgcacgggtgcgtaacgcgtgagcaacctgcccctgtcaggggtatagcctctcgaaagagagattaagaccgcatatgataccgttccggcatcggatcggtatgaaatatttataggacagggatgggctcgcgtgacattagctggttggtggggtaacggcccaccaaggcgatgatgtctaggggctctgagaggagaatcccccacactggtactgagacacggaccagactcctacgggaggcagcagtaaggaatattggtcaatgggcggaagcctgaaccagccatgccgcgtgcaggacgaaggccctacgggtcgtaaactgcttttgtacgggaacaaccgcagttacgtgtaactgtctgagtgtaccgtaagaat

SEQ ID NO: 3179 - DNA, 488 bp, Unknown
  Ascusbbf_67205, encodes 16S rRNA
agagtttgatcctggctcagaacgaacgctggcggcaggcttaacacatgcaagttgaacgggattttatagtagcttgctattatagatgagagtagcgcactggtgagtaacacgtgggaacataccttttggtgggggacaacagttggaaacgactgctaataccgcataagcccggaaggggaaagattaattgccgaaagattggcccgcggaagattaggtagttggtggggtaaaggcctaccaagccgacgatctatagctggtctgagaggacgaacagccacattggaactgagacacggtccagactcctacgggaggcagcagtgaggaatattgggcaatggaggcaactctgacccagccatgccgcgtgagtgaagaaggttttcgaattgtaaagctctttcgggtgtgacgatgatgacggtaacacctaaagaagccccggcaaacttcgtgccagcagccgcggtaat

SEQ ID NO: 3180 - DNA, 490 bp, Unknown
  Ascusbbf_8184, encodes 16S rRNA
agagtttgatcatggctcaggattaacgctggcggcatgcctaatacatgcaagtcaaacgggaagcttcggcttctagtggcgaacgggtgagtaacacgtaggcaatctgtcctaaagattgggataacagctggaaacggctgataataccggataatagaagatatcgcatgataactttttgaaagacgcaattgtgtcactttaggaggagcctgcggcgcattagatagttggtgaggtaacggcccaccaagtcgatgatgcgtagctgcgctgagaggcgaaacagccacattgggactgagaacggcccaaactcctacgggaggcagcagtagggaattttcggcaatgggggaaaccctgaccgagcaatgccgcgtgaatgatgacgatcttcggattgtaaagttctgttgtagaggacgaatggtaggtagagtggaatgctatctatttgacggtactttactagaaagccccg

SEQ ID NO: 3181 - DNA, 490 bp, Unknown
  Ascusbbf_69628, encodes 16S rRNA
agagtttgatcctggctcaggacgaacgctggcggcgtgcttaacacatgcaagtcgaacgagggtgcaggagagcttgctcgaatgcaaccgagtggcggacgggtgagtaacgcgtgaataatctgtctcacacagggggataacgcatcgaaagatgtgctaataccgcgtaggaccacgatggggcatcccattgaggtgaaaggagcaatccagtgtgaggtgagttcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgaaagcctgacccagcaacgccgcgtgaaggaagaaggttttcggattgtaaacttctgtcctatgtgaagagagaaagacggtagcataggaggaagccccggctaactacg

SEQ ID NO: 3182 - DNA, 490 bp, Unknown
  Ascusbbf_119452, encodes 16S rRNA
agagtttgatcatggctcagaacgaacgctggcggcgcgtcttaagcatgcaagtcgaacggcaaggcgggtgcttgcacctgccccagagtggcggactggtgagtaacacgtgggtgacataccccccggacggggatagccggtagaaataccgggtaataccggatacggtcgcgcaggttagagctgcgcgaggaaaggagctgcggctccgccgggggaatggcccgcggcctattagttagttggtggggtaaaggcctaccaaggcgatgacgggtatccggcctgagagggtgagcggacacattgggactgagatacggcccagactcctacgggaggcagcagctaagaatattccgcaatggacggaagtctgacggagcgacgccgcgtgaacgaagaaggccggaaggttgtaaagttcttttggacgtgaggaataagggtctcagggaatgggggcccggtgactgtagcgtct

SEQ ID NO: 3183 - DNA, 490 bp, Unknown
  Ascusbbf_74439, encodes 16S rRNA
agagtttgatcctggctcaggattaacgctggcggcgtgcctaatacatgcaagtcgaatggtaagcttgcttaccatggcgaacgggtgagtaacacgtagataacctatctcaaagacgaggataaccattggaaacgatggataatactggataggacgttataagtcgcatgactaaacgtttaaaggggcaacccactatgagaggggactgcggcgcattagctagttggtgaggtaaaggcccaccaaggcgatgatgcgtagccggactgagaggttgaacggccacaatgggactgagaacggcccatactcctacgggaggcagcagtagggaattttcggcaatggacgaaagtctgaccgagcaacgccgcgtgaacgaaggaatatttcggtatgtaaagttcttttattagagaagaaaaaacaaattgacggtatctaatgaataagctccggctaactacgtgccagcagccgc

SEQ ID NO: 3184 - DNA, 490 bp, Unknown
  Ascusbbf_995495, encodes 16S rRNA
agagtttgatcctggctcaggacgaacgctggcggcatgcctaacacatgcaagtcgaacggagttaagagagcttgctcttttaacttagtggcggacgggtgagtaacgcgtgagcaatctgcctttcagtggggaataatgttctgaaaagagcactaataccgcataatgtacagagaccgcatggtttttgtaccaaagatttatcgctgagagatgagctcgcgtccgattagccagttgatggggtaacggcctaccaaagctacgatcggtagccggactgagaggttgaacggcaacattgagactgagacacggcccagactcctacgggaggcagcagtgggggatattgcgcaatgggggaaaccctgacgcagcaatgccgcgtgatggatgaaggtcttcggattgtaaacttcttttgtcagggacgaaaactgacggtacctgacgaataagctccggctaactacgtgccagc

SEQ ID NO: 3185 - DNA, 490 bp, Unknown
  Ascusbbf_388421, encodes 16S rRNA
agagtttgatcatggctcaggatgaacgctagcggcaggcttaacgcatgcaagtcgaggggtaacagggagtagcaatactccgctgacgaccggcgcacgggtgcgtaacgcgtatgcaacctacctgtaacaggggtataacggagggaaacttccactaatcccccatattgttgtggattcgcatgtctccacaacgaaagctttctgtggttacggatgggcatgcgtgacattagctagttggtaaggtaacggcttaccaaggcgacgatgtctaggggagttgagaggcttatcccccacactggtactgagacacggaccagactcctacgggaggcagcagtgaggaatattggtcaatggacggaagtctgaaccagccatgccgcgtggaggaagaaggtcctatgggttgtaaactccttttgctccagagtaataaggtccctgcgggggtcgatgagagtatggggcgaataag

SEQ ID NO: 3186 - DNA, 490 bp, Unknown
  Ascusbbf_300787, encodes 16S rRNA
agagtttgatcatggctcagattgaacgctggcggcaggcctaacacatgcaagtcgagcggtaacaggggaagcttgcttcccgctgacgagcggcggacgggtgagtaatgtatggggatctgcccgatagagggggataactactggaaacggtagctaataccgcataatctctaaggagcaaagcaggggaacttcggtccttgcgctatcggatgaacccatatgggattagctagttggtgaggtaatggctcaccaaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagttgggaggaaggcgttgatgctaatatcatcaacgattgacgttaccaacagaagaa

SEQ ID NO: 3187 - DNA, 490 bp, Unknown
  Ascusbbf_206438, encodes 16S rRNA
agagtttgatcatggctcaggacgaacgctggcggcgtgcctaatacatgcaagtcgagcggagttgatggggtgcttgcactcctgatgcttagcggcggacgggtgagtaacacgtaggcaacctgccctcaagactgggataactaccggaaacggtagctaataccggataattaaattcgctgcatggcggagttatgaaaggcggagcaatctgtcacttgaggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtctcatagagtaactgctatgagagtgacggta

SEQ ID NO: 3188 - DNA, 490 bp, Unknown
  Ascusbbf_77388, encodes 16S rRNA
agagtttgatcatggctcaggataaacgctggcggcgtgcctaatacatgcaagtcgatcgctggagctcaagcttgcttgagtgaaggagaggcgaacgggtgagtaatacataagcaacctgcccacgaagactgggataatctctggaaacggggactaataccggataggtgacaagatcgcatgatcatgtcattaaagattcaaagcactggtggatgggcttatggcgcattagctggttggtgaggtaacggcccaccaaggcgatgatgcgtagccggcctgagagggtgaacggccacattgggactgagacacggcccagactcctacgggaggcagcagtagggaattttcggcaatgggcgcaagcctgaccgagcaacgccgcgtgagtgaagacggccttcgggttgtaaagctctgttgtaagggaagaacacatctgagagaatcaggtgctgacggtaccttaccagaaagc

SEQ ID NO: 3189 - DNA, 490 bp, Unknown
  Ascusbbf_309449, encodes 16S rRNA
agagtttgatcatggctcaggatgaacgctggcggcatgcctaatacatgcaagtcgaacgaagtgacctctacggaattgtgcttgcacaaggaagaagagattctcacttagtggcgaacgggtgagtaacacgtaggtaacctgcccatctacccgggacaacagttagaaatgactgctaaaaccggataggtaacattgaggcatctcgatgttattaaaggggctacggctctggagatggatggacctgcggtgcattagctagttggtgcggtaacggcgtaccaaggcgacgatgcatagccgacctgagagggcgaccggccacattgggactgagacacggcccaaactcctacgggaggcagcagtagggaattttcggcaatggggggaaccctgaccgagcaatgccgcgtgagcgaagacggtcttcggattgtaaagctctgttgtgagagaaaaaggatgaatatagggaatg

SEQ ID NO: 3190 - DNA, 490 bp, Unknown
  Ascusbbf_732463, encodes 16S rRNA
agagtttgatcctggctcaggatgaacgctggcggcatgcctaagacatgcaagtcgtacgagatggcccattgaagtttgagtgcttgcacaatttccgatttggattttccatctagtggcggacgggtgagtaacacgtgggtgacctacctttgagtttgggataactactggaaacggtagctaataccgaatgatatgcagattcgtttctgtattaaaaggcgctttatagcgtcgctcttagatgggcctgcggcgtattagctagttggtgaggtaatggctcaccaaggcgacgatgcgtagccggactgagaggttgaacggccacattgggactgagacacggcccaaactcctacgggagacagcagttaggaatattcgtcaatgggggaaaccctgaacgagcaatgccgcgtgagtgatgaaggtcctttggattgtaaaactctgttgtatgggaagaatgaccaaactagga

SEQ ID NO: 3191 - DNA, 490 bp, Unknown
  Ascusbbf_157716, encodes 16S rRNA
agagtttgatcatggctcaggatgaacgctggcggcgtgcctaacacatgcaagtcgaacggttaaaccggcttcggccggacataaagtggcgaacgggtgagtaacacgtgaccaacctgccccgcgcaccgggacagccccccgaaagggggattgataccggatgctccgccccctccgcatggcgggggcgggaaagcccaggcggcgcgggatggggtcgcggcccatcaggtagacggccgggtagaggccggccgtgccgacgacgggtagccgggttgagagaccgaccggccacattgggactgagatacggcccagactcctacgggaggcagcagtggggaatattgcgcaatgggggcaaccctgacgcagcaacgccgcgtgcgggacgaaggcactcgtgtcgtaaaccgctttcagcagggaagacatcgacggtacctgcagaagaagccccggctaactacgtgccagcagc

SEQ ID NO: 3192 - DNA, 490 bp, Unknown
  Ascusbbf_343010, encodes 16S rRNA
agagtttgatcatggctcaggatgaacgctggcggcgtgcctaacacatgcaagtcgagcggagataagcaccgagtgaagattcgtctgagctcaccgcttatcttagcggcggatgggtgagtaacacgtggacaacctgcccatgactgggggatagcagctggaaacggctgataataccgcatatgctcacgggaccgcatggtccagggaggaaagatttatcggtcatggatgggtccgcgtcggattaactagttggtgaggtaacggcccaccaaggtgatgatccgtagccggcctgagagggcgaccggccacattgggactgagacacggcccagactcctacgggaggcagcagtgggggatattgcacaatgggcgcaagcctgatgcagcgacgccgcgtgaaggaagaagtactccggtatgtaaacttctatcagcagggaagaagatgacggtacctgactaagaagccccg

SEQ ID NO: 3193 - DNA, 468 bp, Unknown
  Ascusbbf_112865, encodes 16S rRNA
agagtttgatcatggctcagagcgaacgctggcggcaggcttaacacatgcaagtcgaacgccccgcaaggggagtggcagacgggtgagtaacacgtgggaacgtaccttttggttcggaacaactgagggaaacttcagctaataccggataagcccttacggggaaagatttatcgccaaaagatcggcccgcgtctgattagctagttggtggggtaacggctcaccaaggcgacgatcagtagctggtctgagaggatgatcagccacactgggactgagacacggcccagactcctacgggaggcagcagtggggaatcttggacaatgggggaaaccctgatccagccatgccgcgtgagtgatgaaggccctagggttgtaaagctcttttagcagggaagataatgacggtacctgcagaaaaagccccggctaacttcgtgccagcagccgcggtaat

SEQ ID NO: 3194 - DNA, 490 bp, Unknown
  Ascusbbf_1351163, encodes 16S rRNA
agagtttgatcatggctcaggatgaacgctagcggcaggcttaacacatgcaagtcgaggggcagcgggtccagcgatggatgccggcgaccggcgcaagggtgcgtaacgcgtgagcgacatgcccgcgaccgggggataaccgatggaaacgtcgcctaatcccccatataccgatgggtcgcatggtccatgggtgaaaactccggtggtcgcggattggctcgcgtgacattaggtagacggcggggtaacggcccaccgtgccgacgatgtctaggggttctgagaggaaggtcccccacaatggaactgagacacggtccatactcctacgggaggcagcagtgaggaatattggtcaatgggcggaagcctgaaccagccatgccgcgtgcgggacgacggccctacgggttgtaaaccgcttttgagagggagcaataaggtcctcgagcaggatcgatgagagtacctttcgaataagcat

SEQ ID NO: 3195 - DNA, 490 bp, Unknown
  Ascusbbf_1680391, encodes 16S rRNA
agagtttgatcatggctcagaacgaacgctggcggcgcgttttaagcatgcaagtcgagcggcaagggccttcgggcccctagagcggcggacgggtgagtaacacgtggacaatctgccccccggtccgggatagcccagggaaacctggatcaataccggatgcgagcgcggccacataggtggccgcggggaaaggcgcttcggcgccgccgggggatgagtccgcggcccattagctagacggcggggtaaaggcccaccgtggcgacgatgggtagccggcctgagagggtgatcggccacattggaactgagacacggtccagactcctacgggaggcagcagctaagaatcttccgcaatgggcgaaagcctgacggagcgacgccgcgtgaacgatgaaggccgtgaggttgtgaagttcttttcgggagggggaataagggcggcaggcaatggccgcccgatgacgtgaatcccggaata

SEQ ID NO: 3196 - DNA, 490 bp, Unknown
  Ascusbbf_1714637, encodes 16S rRNA
agagtttgatcatggctcaggatgaacgctgacagaatgcttaacacatgcaagtcaatgagaagactactttcgggtagaggttatcatggcggacgggtgagtaacgcgtaaagaacttgccttttagtctgggataacagttggaaacgactgataagactggatataatttagatgttgcctgacatttaaatgaaattaggagctaaaagagagctttgcgtcctattagctagttggtaaggtaacggcttaccaaggcgatgataggtagctggtctgagaggatgaacagccacaaggggactgagatacggcccttactcttacgggaggcagcagtggggaatattggacaatggtcgcaagactgatccagcaattctgtgtgcacgaagacggttttcggattgtaaagtgctttcagttgggaagaaaagatgacggtaccaacagaagaagcgacggctaaatacgtgccagcagc

SEQ ID NO: 3197 - DNA, 490 bp, Unknown
  Ascusbbf_300084, encodes 16S rRNA
agagtttgatcctggctcaggatgaacgctggcggcgtgcttaatacatgcaagtcgaacgagagagtttggatagcttgctatctaaatgatctagtggcgaacgggtgagtaatacataggcaatctgccctaaggactgggataacgattagaaatgatcgctaataccggataggtaataagaaggcatctacttattattaaagttgggtttccaacaccataggatgagcttatgctgtattagcttgttggcgggataacagcccaccaaggcgatgatacatagctggtctgagaggatgaacagccacattgggactgagacacggcccagactcctacgggaggcagcagtaaggaattttcggcaatgggcgcaagcctgaccgagcaacgccgcgtgaaggatgaaggtcttcggatcgtaaacatctgttgtaaaggaagaatgttatattgaggaaatgctatataagtgacggta

SEQ ID NO: 3198 - DNA, 488 bp, Unknown
  Ascusbbf_172721, encodes 16S rRNA
agagtttgatcatggctcagaacgaacgctggtggcaggcctaacacatgcaagtcgaacgggatttatttggagcttgcttcaaataatgagagtggcgcacgggtgagtaacacgtgggaatgtatcatagagtgggggataacagttggaaacgactgctaataccgcatacgccctgaggggtaaagatttatcgctttatgaacagcccgcggaagattaggtagttggtagggtaatggcctaccaagcctacgatctatagctggtctgagaggacgatcagccacactggaactgagacacggtccagactcctacgggaggcagcagtgaggaatattgggcaatgggcgcaagcctgacccagccatgccacgtgagtgatgaaggtcttcggattgtaaagctctttcggatgtgaagatgatgacggtagcatctaaagaagccccggcaaacttcgtgccagcagccgcggtaat

SEQ ID NO: 3199 - DNA, 490 bp, Unknown
  Ascusbbf_1482535, encodes 16S rRNA
agagtttgatcatggctcagaacgaacgctggtggcgtgttttatacatgcaagtcgagcgaggacggtagcaataccgagccgagcggcgaacgggtgagtaacgcgtaagcaatctgccccacaatcgggaacaaccgtgccaacgcgcggctaatgccggatattgtagtctactgcatagtaggccaacgaaagatttattgttgtgggatgagcttgcgtccgattagctagttggcggggtaatagcccaccaaggcgacgatcgatagccggcctgagagggtgatcggccacattgggactgagatacggcccagactcctacgggaggcagcagtagggaatattgcgcaatggggggaaccctgacgcagcaacgccacgtgtgggaagaagcatttcggtgtgtaaaccactgtcggaaaggaataacggaagacttcggtctttatgaatgtacttttagagggagcaccggcaaact

SEQ ID NO: 3200 - DNA, 490 bp, Unknown
  Ascusbbf_413604, encodes 16S rRNA
agagtttgatcctggctcaggatgaacgctggcggcgtgcctaacacatgcaagtcgagcgagaaactgcgaattgacgcttcggttgattttcgcagcggaaagcggcggacgggtgagtaacgcgtaggcaacctgccctttacacagggatagcctctggaaacggggattaagacctgataatccggcatcaacacatgttggagccggcaaagatttattggtaaaggatgggcctgcgtctgattagttagttggtgaggtaacggctcaccaaggcgacgatcagtagccgacctgagagggtgatcggccacattggaactgagacacggtccagactcctgcgggaggcagcagtggggaatattgcacaatgggggaaaccctgatgcagcaacgccgcgtgaaggatgaaggcctttgggtcgtaaacttctgtccttggggaagaaagaaatgacggtacccttggaggaagccccgg

SEQ ID NO: 3201 - DNA, 490 bp, Unknown
  Ascusbbf_1493310, encodes 16S rRNA
agagtttgatcctggctcaggacgaacgctggcggcgcgcctaacacatgcaagtcgaacgggactagtgaccggagattagatgagttctagtttgcgatcactagttcagtggcggacgggtgagtaaagcatgagcaacctggctactagagggggatagcttttggaaacagaagataataccgcataaatcaaagatttcgcatgagatttttggaaaaggagcaatccgctaatagatgggctcatgtccgattagctagttggtggggtaaaggcctaccaaggcgacgatcggtagccgtactgagaggttcaacggccacattgggactgagacacggcccagactcctacgggaggcagcagtgaggaatattgcgcaatggagggaactctggcgcagcgacgccgcgtgagggaagaaggtttttgaattgtaaacctctgtcctcagggaagaaagaaatgacggtacctggggagg

SEQ ID NO: 3202 - DNA, 490 bp, Unknown
  Ascusbbf_1671309, encodes 16S rRNA
agagtttgatcatggctcaggatgaacgctagctacaggcttaacacatgcaagtcgaggggcagcatggcggatgcttgcatctgccgatggcgaccggcgcacgggtgagtaacgcgtatccaacctgccccccaccgcggtataccccggcgaaagccggcctaatcccgcatgcactccgaggatgacatctgacttggaggaaaggtattttttccggtggcggatggggatgcgtctgattagcttgtcggcggggtaacggcccaccgaggcatcgatcagtaggggttctgagaggaaggtcccccacattggaactgagacacggtccaaactcctacgggaggcagcagtgaggaatattggtcaatgggcgcaagcctgaaccagccaagtagcgtgcaggatgacggccctatgggttgtaaactgctttttcgcgggactaactccggggacttgtccccggcctgcatgtaccgcg

SEQ ID NO: 3203 - DNA, 490 bp, Unknown
  Ascusbbf_435761, encodes 16S rRNA
agagtttgatcatggcttaggatgaacgctggcggcgtgcttaacacatgcaagtcgaacgaagcaattttcttgcttgcaagaaagttgacttagtggcggacgggtgagtaacgcgtgggtaacctgcctcatacagggggataacagttggaaacgactgctaagaccgcataacccgctagtgtcgcatgacatggacggaaaatatttataggtatgagatgggcccgcgtctgattagctagttggtaaggtaacggcttaccaaggcgacgatcagtagccgacttgagagagtgatcggccacattgggactgagacacggcccaaactcctacaggaggcagcagtggggaatattggacaatgggggaaaccctgatccagcgacgccgcgtgagtgaagaagtatttcggtatgtaaagctctatcagcagggaagataatgacagtacctgattaagaagccccggctaactacgtgc

SEQ ID NO: 3204 - DNA, 470 bp, Unknown
  Ascusbbf_173817, encodes 16S rRNA
agagtttgatcatggctcagaatgaacgctggcggcaggcctaaaacatgcaagtcgaacgctgtagcaatacagagtggcgcacgggtgagtaacacgtgggaatatgccttttggtacggaacaacttttggaaacgaaagctaataccgtatggtcccttcggggtaaagatttatcgccaaaagattagcccgcgtctgattagctagttggtagggtaaaggcctaccaaggcgacgatcagtagctgttctgagaggaagatcagccacactgggactgagacacggcccagactcctacgggaggcagcagttaggaatattggacaatgggcgcaagcctgatccagccatgccgcgtgaacgatgaaggccttcgggttgtaaagttctttagccgatgattataatgactgtagtcggaaaataagccccggctaacttcgtgccagcagccgcggtaat

SEQ ID NO: 3205 - DNA, 490 bp, Unknown
  Ascusbbf_867828, encodes 16S rRNA
agagtttgatcatggctcaggacgaacgctggcggcgcgcctaacacatgcaagtcgcgcggttaaagctgcttcggcagtgcataaagcggcgaacgggcgagtaacgcgtgggcaacctgcccccctcccgggaatagccgggggaaaccccgggtaaggcccggcgaccccccggaagggcatccttccgggggcatacggaggggagggggatgggcccgcgtccgattagccagacggcggggtgacggcccaccgtggcgacgatcggtagccgggctgagaggccggacggccgcattgggactgagacacggcccagactcctacgggaggcagcagtggggaatattgcgcaatgggcgaaagcttgacgcagcaacgccgcgtgcgggaaggaggccctcgggccgtaaaccgctttcagcggggacgatcatgactgtacccgcagaagaagccccggctaactacgtgccagcagccg

SEQ ID NO: 3206 - DNA, 490 bp, Unknown
  Ascusbbf_1660502, encodes 16S rRNA
agagtttgatcctggctcaggatgaacgctagcggcaggcctaacacatgcaagtcgaggggtagaagctttcgggctttgagaccggcgcacgggtgcgtaacgcgtatgcaatctgccttgtactgagggatagcccagagaaatttggattaatacctcatagtattttttgttggcatcaacagattattaaagagattcggtacaagatgagcatgcgtcccattagctagttggtatggtaacggcataccaaggctacgatgggtaggggtcctgagagggagatcccccacactggtactgagacacggaccagactcctacgggaggcagcagtgaggaatattggtcaatggtcgcaagactgaaccagccatgccgcgtgtaggatgaagcatctatggtgtgtaaactacttttgtacgggaagaaacactccctcgtgagggagcttgacggtaccgtaagaataaggatcggctaa

SEQ ID NO: 3207 - DNA, 490 bp, Unknown
  Ascusbbf_1178020, encodes 16S rRNA
agagtttgatcatggctcaggatgaacgctagcggcaggcctaatacatgcaagtcgaacgggatctatgagtaagcttgcttacttttagtgagagtggcgcacgggtgcgtaacgcgtgagtaacctacccatatcagggggatagccccgagaaatccggattaacaccgcatgacacagcaattcggcatcgaatcactgttaaatatttataggatatggatgggctcgcgtgacattagctagttggtaaggtaacggcttaccaaggctacgatgtctaggggctctgagaggagaatcccccacactggtactgaggaacggaccagactcctacgggaggcagcagtaaggaatattggtcaatggacgcaagtctgaaccagccatgccgcgtgcaggacgactgccctatgggttgtaaactgcttttgtacgggaataaacactggtacgcgtaccagcttgaatgtaccgtaagaat

SEQ ID NO: 3208 - DNA, 490 bp, Unknown
  Ascusbbf_1630380, encodes 16S rRNA
agagtttgatcatggctcaggatgaacgctagcgataggcctaacacatgcaagtcgaggggcagcacaaggggtagcaatacttctggtggcgaccggcggatgggtgagtaacacgtatgcaacctgcctacaacgaggggataactccgggaaatcggtgctaataccctataatacaggggccccgcatggggatatttgttaaagattaatcggttgtagatgggcacgcgttccattagctagttggtgaggtaacggctcaccaaggcaacgatggataggggaactgagaggtttaccccccacactggtactgagacacggaccagactcctacgggaggcagcagtgaggaatattggtcaatggaggcaactctgaaccagccacgtcgcgtgaaggaagacggccctacgggttgtaaacttcttttgtagggaataaagtgtagtacgtgtactattttgcatgtaccttacgaata

SEQ ID NO: 3209 - DNA, 490 bp, Unknown
  Ascusbbf_33968, encodes 16S rRNA
agagtttgatcatggctcaggacgaacgctggcggcgtgcttaacacatgcaagtcgaacggaccgagccccttcgggggcgaaggttagtggcgaacgggtgagtaacgcgtgaggaacctgcctttcagagggggacaacagttggaaacgactgctaataccgcataacacatatgcttcgcatgaaggatatgtcaaagattttatcgctgaaagatggcctcgcgtctgattagatagttggtggggtaacggcccaccaagtcgacgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttaccagggacgaaggatgtgacggtacctggagaaaaagccacggctaactacgtgcca

SEQ ID NO: 3210 - DNA, 490 bp, Unknown
  Ascusbbf_69800, encodes 16S rRNA
agagtttgatcatggctcaggatgaacgctagcggcaggcttaacacatgcaagtcgaggggcagcgggggtagcaatacccgccggcgaccggcgaaagggtgcgtaacgcgtgagcaacttgcccgtatccgggacataagcggtggaaacgccgtctaatttcccataacaacagaggctgcatgacctttgtttgaaagatccgtcggatacggatgggctcgcgagacattagctggttggtgaggtaacggcccaccaaggcgacgatgtctaggggttctgagaggaaggtcccccacactggaactgagacacggtccagactcctacgggaggcagcagtgaggaatattggtcaatggacgcaagtctgaaccagccatgccgcgtgaaggattgaggccctatgggtcgtaaacttcttttgtggtggagcaataaggcgtacgtgtacgccgatgagagtacatcacgaataagcatc

SEQ ID NO: 3211 - DNA, 490 bp, Unknown
  Ascusbbf_1285152, encodes 16S rRNA
agagtttgatcctggctcagagcgaacgctggcggcatgcttaacacatgcaagtcgcacgaaggtttcggccttagtggcggacgggtgagtaacgcgtaggtatctatccatgggtgggggataacactgggaaactggtgctaataccgcatgacacctgagggtcaaaggcgcaagtcgcctgtggaggagcctgcgtttgattagctagttggtggggtaaaggcctaccaaaccgatgatctctagctggtttgagaggacaatcagccacattggaattgagaaacggaccaaactcctacgggaggcagcagtggggagtattgcacaatgggggaaaccctgatgcagccatgccgcgtgtgtgaagaaggccttcgggttgtaaagcacttttgcattcgaggaagacggcgtataaataaatgcgctatttgacgttagagtgtgaataagcaccggcaaactccgtgccagcagccgc

SEQ ID NO: 3212 - DNA, 490 bp, Unknown
  Ascusbbf_325, encodes 16S rRNA
agagtttgatcctggctcagaacgaacgctggcggcgcgtcttaagcatgcaagtcgagcgggaggggcagcgatgccccgagagcggcggacgggtgagtaacgcgtggacaaccgaccctccggtgggggatagccgagcgaaagcgcggataataccgcatgagacggagcgggggcggccctgttccgggaaagcgcctgcgggcgcgccgggggacgggtctgcgtcccatcagctagacggcggggtgaaggcccaccgtggcgacgacgggtagccggcctgagagggtggacggccacattgggactgggaacggcccagactcctacgggaggcagcagctaaggatcttccgcaatgggcgaaagcctgacggagcgacgccgcgtggacgatggaggccggaaggttgtgaagtccttttctcgggggggaacaaccgtgccagggaatgggcgcggggtgacgcggaccgaggaataa

SEQ ID NO: 3213 - DNA, 490 bp, Unknown
  Ascusbbf_31934, encodes 16S rRNA
agagtttgatcatggctcaggacgaacgctggcggcgtgcctaacacatgcaagtcgaacgaagcactggaaatgattccttcgggttgattttcctttgactgagtggcggacgggtgagtaacacgtgagcaacctgcctttcagagcgggatagcagttggaaacgactgataataccgcatgacatgtctcttccgcatgagagagacatcaaatgatttttcgctgaaagatgggctcgcgtccgattaggtagttggtgaggcaacggctcaccaagccgacgatcggtagccggactgagaggtcgatcggccacatgaggactgagacacggcccagactcctacgggaggcagcagtgggggatattgcacaatgggcgcaagcctgatgcagcaacgccgcgtgagggaggacggtcttcggattgtaaacctctgtccttggggaagaaacaaatgacggtacccttggaggaagccac

SEQ ID NO: 3214 - DNA, 490 bp, Unknown
  Ascusbbf_4804, encodes 16S rRNA
agagtttgatcctggctcaggataaacgctggcggcatgcctaatacatgcaagtcgaacggtctagcttgctagacagtggcgaacgggtgagtaacacgtaggtaatccatcccaaggacgaggatagcttctggaaacggaaggtaaaactggatagtatagaatagggcatcctaatctatttaaaagagcaatctaccctgggaagagcctgcggcgcattagctagttggtgaggtaatggcccaccaaggcgatgatgcgtagccggactgagaggtcgaccggccacattgggactgagacacggcccagactcctacgggaggcagcagtagggaattttcggcaatgggcggaagcctgaccgagcaatgccgcgtgaatgatgaagtatttcggtatgtaaagttcttttattagggacgaaaaaacaaattgacggtacctaatgaataagctccggctaactacgtgccagcagccg

SEQ ID NO: 3215 - DNA, 490 bp, Unknown
  Ascusbbf_122423, encodes 16S rRNA
agagtttgatcatggctcaggacgaacgctggcggtatgcttaacacatgcaagtcgaacgagaagctttttattgatccttcgggtgatttagaaagcagacagtggcgaacgggtgagtaacgcgtgggcaacctgcctttcggagcggaatagcctcgggaaaccgggagtaaagccgcataacattgttttttcgcatgaagaaacaatcaaaactccggtgccgaaagatgggcccgcgtcctattagctggttggtgaggcaacggctcaccaaggcgacgataggtagccggtctgagagggcgaacggccacactggaactgagacacggtccagactcctacgggaggcagcagtggggaatattgcgcaatgggggcaaccctgacgcagcaataccgcgtgagtgatgaaggttttcggatcgtaaaactctgttattggggaagaagaagtgacggtacccaatgaggaagtcccggc

SEQ ID NO: 3216 - DNA, 490 bp, Unknown
  Ascusbbf_457392, encodes 16S rRNA
agagtttgatcatggctcaggacgaacgctggcggcgtgcttaacacatgcaagtcgaacggtaaggccctttcgggggtacacgagtggcgaacgggtgagtaacacgtgggtaatctgccctgcacttcgggataagcctgggaaactgggtctaataccggatattcagctttcatcgcatggtgtttgttggaaagtttttcggtgcaggatgagtccgcggcctatctgcttgtcggtggggtaatggcctaccaaggcgacgacgggtagccggcctgagagggtgatcggccacactggggctgagacacggcccagactcctacgggaggcagcagtggggaatattgcacaatgggcgaaagcctgatgcagcgacgccgcgtgggggatgacggtcttcggactgtaaacccctttcagtagggacgaagcgcaagtgacggtacctgcagaagaagcaccggccaactacgtgccagca

SEQ ID NO: 3217 - DNA, 490 bp, Unknown
  Ascusbbf_79293, encodes 16S rRNA
agagtttgatcatggctcaggatgaacgctggcggcgtgcttaacacatgcaagtcgaacgaagcatcccgcccgagaaaatggagtgcttgcacaaagtggactcaattgggatgactgagtggcggacgggtgagtaacgcgtgggtaacctgccctatacagggggatagcagttggaaacgactgataataccgcataagcgcacggtatcgcatgatacagtgtgaaaaactccggtggtataggatggacccgcgtctgattagctagttggtgaggtaacggctcaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgacgaagtatttcggtatgtaaagctctatcagcagggaagataatgacggtacctga

SEQ ID NO: 3218 - DNA, 490 bp, Unknown
  Ascusbbf_27036, encodes 16S rRNA
agagtttgatcctggctcaggatgaacgctagctacaggcttaacacatgcaagtcgaggggcagcgagaagaaagcttgctttctttgtcggcgaccggcgcacgggtgcgtaacgcgtatccaatctaccctattctcagggatagccttgcgaaagtaagattaatacctgatggtctcacgctaccgcatgagggtgtgagtaaagattcatcggaatgggatgaggatgcgtccgattagcttgacggcggggtaacggcccaccgtggctacgatcggtaggggttctgagaggaaggtcccccacactggaactgagacacggtccagactcctacgggaggcagcagtgaggaatattggtcaatggtcgggagactgaaccagccaagtagcgtgagggaagactgccctatgggttgtaaacctcttttgtttgggaataaagtgccgtacgtgtacggttttgtatgtaccttacgaat

SEQ ID NO: 3219 - DNA, 490 bp, Unknown
  Ascusbbf_52695, encodes 16S rRNA
agagtttgatcatggctcaggacgaacgctggcggcgtgcctaacacatgcaagtcgaacggagctgagaagcttgcttttcagcttagtggcggacgggtgagtaacgcgtgagtaacctgcctccgagagtggaataacgttttgaaaagaacgctaataccgcataacgtatcagtatcgcatggtattgataccaaagattatatcgctcggagatggactcgcgtccgattagttagttggtgaggtaacggctcaccaagaccgcgatcggtagccggactgagaggttgatcggccacattgggactgagacacggcccagactcctacgggaggcagcagtgggggatattgcgcaatggggggaaccctgacgcagcaacgccgcgtgaaggatgaaggttttcggattgtaaacttcttttatcagggacgaaaaacgacggtacctgatgaataagctccggctaactacgtgccagca

SEQ ID NO: 3220 - DNA, 490 bp, Unknown
  Ascusbbf_53009, encodes 16S rRNA
agagtttgatcatggctcaggatgaacgctagcggcaggcctaatacatgcaagtcgtacgggatctccccttcgggggagtgagagtggcgcacgggtgcgtaacgcgtatgcaaccaaccctcatccgggggacagccggtggaaacgccgggtaataccccataccgattcctgtgggcatccacggggattgaaagacttaggtcggaggaggacgggcatgcgtcccattagctagtcggcggggtgacggcccaccgaggcgacgatgggtaggggatctgagaggacggtcccccacactggtactgagacacggaccagactcctacgggaggcagcagtaaggaatattgggcaatggggggaaccctgacccagccatgccgcgtgagggaagtaggccctacgggtcgtgaacctcttttgtccagggacaaggacggcgtcgtgaacgtcgtttgagggtactggaagaataagcatc

SEQ ID NO: 3221 - DNA, 490 bp, Unknown
  Ascusbbf_223712, encodes 16S rRNA
agagtttgatcctggctcagaacgaacgctggcggcaggcctaacacatgcaagtcgagcgtgaaaggggcttcggccctgagtaaagcggcgcacgggtgagtaacacgtgaataatctgcccctccgaccgggataacagaccgaaaggactgctaataccggataagcccacaagccaaccgggcgtgcgggaaaagtacgggatccttcgggaccgtatgcggaaggatgagttcgcgttccattagatagttggtgaggtaatggcccaccaagtcgacgatggatagctggtctgagaggatgatcagccacactggaactgagacacggtccagactcctacgggaggcagcagtggggaatcttgcgcaatgggggaaaccctgacgcagccatgccgcgtgagtgatgaaggccttcgggttgtaaagctctgtctaaggggacgaatggcacatagaacaagacattatgtgcgtgacgg

SEQ ID NO: 3222 - DNA, 490 bp, Unknown
  Ascusbbf_62890, encodes 16S rRNA
agagtttgatcctggctcaggacgaacgctggcggcgtgcttaacacatgcaagtcgaacgatgatgaccggagcttgctttggttggattagtggcgaacgggtgagtaacacgtgagtaacctgcccccttcttcgggataaccattggaaacggtggctaataccgggtatgacatcggatcgcatggtttggtgtggaaaggttttttctggtgggggatgggctcgcggcctatcagcttgttggtggggtgatggcctaccaaggctttgacgggtagccggcctgagagggcgaccggccacactgggactgagacacggcccagactcctacgggaggcagcagtggggaatattgcacaatgggggaaaccctgatgcagcgacgccgcgtgggggatgaaggccttcgggttgtaaacccctttcagtaaggaacaaggccatgattgttgttgtggttgagggtacttgcagaagaagc

SEQ ID NO: 3223 - DNA, 490 bp, Unknown
  Ascusbbf_725657, encodes 16S rRNA
agagtttgatcatggctcagattgaacgctggcggcaggcttaacacatgcaagttgagcgggattggttgatagcttgctattgaccatgagagcagcgcactggtgagtaacacgtgggaacgtaccttttggtgggggacaacatctggaaacggatgctaataccgcataagccctacgggggaaaggagcgatttgccgaaagatcggcccgcggaagattaggtagtaggtggggcaacggcctacctagccgacgatctatagctggtctgagaggacgatcagccacattggaactgagacacggtccagactcctacgggaggcagcagtgaggaatattgggcaatggagggaactctgacccagccatgccgcgtgagtgaagaaggttttcggattgtaaagctctttcagatgggaagatgatgacggtaccatcagaagaagcaccggctaacttcgtgccagcagccgcggtaat

SEQ ID NO: 3224 - DNA, 490 bp, Unknown
  Ascusbbf_59003, encodes 16S rRNA
agagtttgatcatggctcaggatgaacgctagcggcaggcctaatacatgcaagtcgtacgggatctccccttcgggggagtgagagtggcgcacgggtgcgtaacgcgtatgcaaccaaccctcatccgggggacagccggtggaaacgccgggtaataccccatgtccactttgggaggcatcttctgaggtggaaaggctttggtcggaggaggacgggcatgcgtcccattagctagtcggcggggtgacggcccaccgaggcgacgatgggtaggggatctgagaggacggtcccccacactggtactgagacacggaccagactcctacgggaggcagcagtaaggaatattgggcaatgggggtaaccctgacccagccatgccgcgtgagggaagtaggccctacgggtcgtgaacctcttttgtccagggacaaggacggcgtcgggaacgtcgtttgagggtactggaagaataagcatc

SEQ ID NO: 3225 - DNA, 487 bp, Unknown
  Ascusbbf_1514345, encodes 16S rRNA
agagtttgatcctggctcagaacgaacgctggcggcatggattaggcatgcaagtcgaacgaggtagcaataccgagtggcggaagggtgaggaacacgtgagtaacctgcccccaagttgggaataacagttggaaacgactgctaataccgaatgtggctgttgtattgcatgatgtaacagttaaagatttatcgcttggggatgagctcgcgtcccattagttagttggtgaggtaacggcccaccaagacaatgatgggtagctggtctgagaggatggtcagccacactgggactgagacactgcccagactcctacgggaggctgcagtcgagaatcttgggcaatgcgcgaaagcgtgacccagcaatgccgcgtgtatgatgaagggcttcggattgtaaaatactgtctcccgggacgaaagatgacggtaccggggaaggaagccacggctaactacgtgccagcagccgcgtaat

SEQ ID NO: 3226 - DNA, 490 bp, Unknown
  Ascusbbf_43853, encodes 16S rRNA
agagtttgatcatggctcagaacgaacgctggcggcgcgttttaagcatgcaagtcgagcgggaaccgggggcaactctggggagagcggcggacgggtgagtaacacgtggataatctgtcctttagactgggatagcctgatgaaagtcaggataataccggataagacgtgtgccacacaagtggtatacgggaaaggagctaaggcttcgcttgagggtgagtccgcggcccattagctagatggtggggtaaaggcctaccatggcgatgatgggtagccggcctaagagggtgaacggccacattgggactgagatacggcccagactcctacgggaggcagcagctaagaatattccgcaatggagggaactctgacggagcgacgccgcgtgaatgatgaaggccgtgaggttgtaaagttcttttctggagggagaataaggcttgtagggaatgacaggctgatgacgtgaatccaggaa

SEQ ID NO: 3227 - DNA, 490 bp, Unknown
  Ascusbbf_65408, encodes 16S rRNA
agagtttgatcatggctcaggacgaacgctggcggcgtgcctaatacatgcaagtagaacgctgagcactttagcttgctagggtgtgatgagttgcgaacgggtgagtaacgcgtaggtaacctacctcatagcgggggataactattggaaacgatagctaataccgcataacaatagctgccgcatggcagctatttgaaaggaacaatcgtttcactatgagatggacctgcgttgtattagctagttggtggggtaaaggcctaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgggtgagagagtggaaagttctcacagtgacggtatct

SEQ ID NO: 3228 - DNA, 490 bp, Unknown
  Ascusbbf_81668, encodes 16S rRNA
agagtttgatcatggctcagaacgaacgctggcggcgcgtcttaagcatgcaagtcgaacggcaagttaccttcgggtaacctagagtggcggactggtgagtaacacgtaggtgacgtaccccccggacggggatagctcctagaaataggagataataccggataaggttgcacgggctggaaccgtgtaaggaaaggtgcttcggcaccgccgggggagcggcctgcggcccatcagctggtaggtgaggtaaaggcccacctaggcaatgacgggtatccggcctgagagggtgagcggacacattgggactgagatacggcccagactcctacgggaggcagcagctaagaatattccgcaatgcacgaaagtgtgacggagcgacgccgcgtggacgatgaaggccggaaggttgtaaagtccttttataactgaggaataagccgtgcagggaatggcatggtggtgactgtaggttatgaat

SEQ ID NO: 3229 - DNA, 490 bp, Unknown
  Ascusbbf_410959, encodes 16S rRNA
agagtttgatcatggctcagaacgaacgctggcggcgtgcctaacacatgcaagtcgagcgcgaaaggtgacttcggttgccgagtagagcggcgcacgggtgaggaacacgtgagtaatgtgcccttgaatctggaataacatttcgaaaggagtgctaatgccggataagaccacgacagctgcggctgaagtgggaaaaggctgggatctccgcgaggggaccagttgtttgaggagcagctcgcggcccatcagctagttggcggggtaagagcccaccaaggcgacgacgggtagctggtctgagaggacgatcagccacactggaactgagacacggtccagactcctacgggaggcagcagtggggaattttgcgcaatgggcgaaagcctgacgcagcaacgccgcgtgagcgatgaaggccttcgggtcgtaaagctctttcgacaggaaggaaagggttcaggttaatggcctgagcttt

SEQ ID NO: 3230 - DNA, 490 bp, Unknown
  Ascusbbf_36025, encodes 16S rRNA
agagtttgatcatggctcaggacgaacgctggcggcatgcctaacacatgcaagtcgaacggaggtggaaacaccttagtggcgaacgggtgagtaacacgtgagcaacctgccccatacacagggataacagttagaaatgactgctaataccggataagaccacatctcggcatcgagaaggggtcaaagcgattcagcggtatgggatgggctcgcgtccaattagcttgttggcggggtaacggcccaccaaggcaacgattggtagccgacctgagagggtgatcggccacattggaactgagacacggtccaaactcctacgggaggcagcagtggggaatattgggcaatggaggaaactcttacccagcaatgccgcgtgagtgatgaaggtcttttggattgtaaagctctttgattagggacgaaaaaaatgacggtacctaaagaacaagccccggctaactatgtgccagcagccgcg

SEQ ID NO: 3231 - DNA, 490 bp, Unknown
  Ascusbbf_722794, encodes 16S rRNA
agagtttgatcatggctcagattgaacgctggcggcaggcctaatacatgcaagtcggacgggagcagcaatgctccagtggcgcaagggtgaggaacacgtgaacaacctgccttcgagttggggatagcttctggaaacgggagataataccgaataacatcaccggatcgcatgatttggtgatcaaagcggcaatgcgcttgaagaggggttcgcgtcccattagctagttggtgaggtaacggcccaccaaggcgatgatgggtagctggtctgagaggacgatcagccacattgggactgagatactgcccagactcctacgggaggctgcagtcgagaattttgggcaatggacgaaagtctgacccagcaatgccgcgtgcgggatgaaggtcttcggattgtaaaccgctgtcaagagggacgaaatttgacggtacctctggaggaagccacggctaactacgtgccagcagccgcggta

SEQ ID NO: 3232 - DNA, 490 bp, Unknown
  Ascusbbf_161507, encodes 16S rRNA
agagtttgatcctggctcagagcgaacgttagcggcgcgcctaacacatgcaagtcgcacgagaagggggcaaccctggacagtggcgcacgggtgcgtaacacgtagataacctgcccttcgaagggggataacgttccgaaaggagcgctaataccgcatacagccgttcttggtaagccaagggcgggcaaaggctgggaccggcaacggccagtcgtcgaaggaggggtctgcggcccatcagctagttggtgaggtaatggctcaccaaggcaaagacgggtagctggtctgagaggatgatcagccacactggtactggaacacggaccagactcctacgggaggcagcagtggggaatcttggtcaatgggcgcaagcctgaaccagcgacgccgcgtgagtgatgaaggccttcgggttgtaaagctctgtggggagggaagaaagactaaggtcgaataggccttaggttgacggtacctc

SEQ ID NO: 3233 - DNA, 490 bp, Unknown
  Ascusbbf_211654, encodes 16S rRNA
agagtttgatcatggctcaggatgaacgctagcggcaggcctaatacatgcaagtcgaacgggataggctccttcgggggccttgagagtggcgcacgggtgcgcaacgcgtatgcaaccaacccccgacaggcggatagccggtggaaacgccggataatacgccatggttccgtgggagggcatcctcctgaggataaagccgagaggcggtcggggacgggcatgcgtcccattagatggtaggcggggtgacggcccacctagtccacgatgggtaggggatctgagaggacggtcccccacactggtactgagacacggaccagactcctgcgggaggcagcagtaagggatattggtcaatgggcggaagcctgaaccagccatgccgcgtgagggaatgaggccctacgggtcgtgaacctcttttattcggggacaaggacgcggtcgggaaccgtgtttgagggtaccgaaggaataagcg

SEQ ID NO: 3234 - DNA, 490 bp, Unknown
  Ascusbbf_101402, encodes 16S rRNA
agagtttgatcatggctcaggatgaacgctggcggcgtgcctaacacatgcaagtcgagcgggaaatcgctgattgagatttcggttgattgaagcgatggatagcggcggacgggtgagtaacgcgtaggtaatctgccttcagcacagggatagcctagggaaacctggattaatacctgataatgcagtttggtcacatggccagattgccaaagatttatcggctggagatgaacctgcgtctgattagatagttggtgaggtaacggcccaccaagtcaacgatcagtagccgacctgagagggtgatcggccacattggaactgagacacggtccaaactcctacgggaggcagcagtggggagtattgcacaatgggcgcaagcctgatgcagcaacgccgcgtgagcgatgaaggtcttcggatcgtaaagctctgtcctctgggaagaagaagtgacggtaccagaggaggaagccccggc

SEQ ID NO: 3235 - DNA, 490 bp, Unknown
  Ascusbbf_308079, encodes 16S rRNA
agagtttgatcatggctcagaacgaacgttagcggcgcgcctaagacatgcaagtcgagcgagaaagggcttcggccccagtaaagcggcgcacgggtgagtaacacgtaggttatcaacccccgagtggtggataaccctccgaaaggagggctaatacagcatgacgccggcggtttctctggaatcgtcggtcaaagcgggcctcttcatgaaagctcgcgctcgaggatgagcctgcggcccatcaggtagttggcggagtaacagcccaccaagcctaagacgggtagctggtctgagaggatgaacagccacactggaactgagacacggtccagactcctacgggaggcagcagtcgggaatcttccgcaatgggcgaaagcctgacggagcgacgccgcgtgagtgatgaaggccttcgggttgtaaagctctgtggggagagaagaataagcgtcggcgaatacctggcgtgatgacggta

SEQ ID NO: 3236 - DNA, 490 bp, Unknown
  Ascusbbf_728199, encodes 16S rRNA
agagtttgatcatggctcaggatgaacgctagcggcaggcttaacacatgcaagtcgaggggtaacagggagtagcaatactctgctgacgaccggcgcacgggtgcgtaacgcgtatgcaacctaccttgtacagggggataacggggtgaaaatcccactaatatcccatggtgttggagattcgcatgtttctccaactaaagcttcggtggtacaagatgggcatgcgtgacattagctagttggtagggcaacggcctaccaaggcgacgatgtctaggggagctgagaggcttatcccccacactggtactgagacacggaccagactcctacgggaggcagcagtgaggaatattggtcaatggacggaagtctgaaccagccatgccgcgtggaggaagaaggtcctatgggttgtaaactccttttgttccggagtaataagtgccttgcgaggcacgatgagagtacgggacgaataagc

SEQ ID NO: 3237 - DNA, 490 bp, Unknown
  Ascusbbf_393265, encodes 16S rRNA
agagtttgatcctggctcaggacgaacgctggcggcgtgcttaacacatgcaagtcgaacgaggttatattccggaaggcttcggccggaagggagataaccgagtggcggacgggtgagtaacgcgtgaggaacctgtcttctacagggggataacggtccgaaaggattgctaataccgcataagaccacaccggcgcatgccggaggggtcaaaggagaaatccggtagaaggtggactcgcgtcccattagatagttggtgaggtaacggcccaccaagtcgacgatgggtagccgacctgagagggtgatcggccacattggaactgagatacggtccagactcctacgggaggcagcagtggggaatattgggcaatgggcgaaagcctgacccagcaacgccgcgtgagggaagaaggtcttcgggttgtaaacctctgtccttggtgaaaagaaaggatggtagccaaggaggaagctccgg

SEQ ID NO: 3238 - DNA, 490 bp, Unknown
  Ascusbbf_337064, encodes 16S rRNA
agagtttgatcatggctcaggacgaacgctggcggcgtgcctaacacatgcaagtcgagcgaagcgatcgggaagggagacttcggtcaaacggaacgattgactgagcggcggacgggtgagtaacgcgtgagcaacctggcctttacagggggataacagttggaaacgactgctaataccgcataagaccacgagatggcatcatcagggggtcaaagaattattggtaaaggatgggctcgcgtcccattagttagttggcggggtaacggcccaccaaggcgacgatgggtagccgacctgagagggtgatcggccacattggaactgagacacggtccaaactcctacgggaggcagcagtggggaatattgggcaatgggcgaaagcctgacccagcaacgccgcgtgaaggaagaaggtcttcggattgtaaacttttgttgtcagtgaagaggaaggacagtagctgacgaggaagccccg

SEQ ID NO: 3239 - DNA, 490 bp, Unknown
  Ascusbbf_143981, encodes 16S rRNA
agagtttgatcctggctcagaacgaacgctggcggcgcgtcttaagcatgcaagtcgaacgggaatgcggtgcttgcaccgcacgagagtggcggactggtgagtaacgcgtgggtgacgtaccccccggacggggatagcccttagaaataaggggtaataccggatacggttccgtgtgtcagaggcacggaaggaaaggagcttcggctccgccgggggagcggcctgcgtcccatcagctggttggcggggtaacggcccaccaaggcaatgacgggtatccggcctaagagggtgaacggacacattgggactgagatacggcccagactcctacgggaggcagcagctaagaatattccgcaatgggggaaaccctgacggagcgacgccgcgtggacgatgaaggccggaaggttgtaaagtcctttagtccgtgaggaataacgccggagggaatgccggcggatgactgtagcggaagaat

SEQ ID NO: 3240 - DNA, 490 bp, Unknown
  Ascusbbf_136630, encodes 16S rRNA
agagtttgatcatggctcaggatgaacgctggcggcatgcctaacacatgcaagtcgaacggagttataagatagcttgctattgagtaacttagtggcggacgggtgagtaacgcgtgagtaacctgcctcttagagggggataacattctgaaaagaatgctaataccgcatataatgacgaaaccgcatggttttgtcatgaaaggagcaatccgctaagagatggactcgcgtctgattagctagatggtggggtaacggctcaccatggcgacgatcagtagccggactgagaggttgaacggccacattgggactgagacacggcccagactcctacgggaggcagcagtgggggatattacgcaatgggggaaaccctgacgtagcaatgccgcgtgaaggaagaaggttttcggattgtaaacttcttttgtcagggacgataatgacggtacctgacgaataagctccggctaactatgtg

SEQ ID NO: 3241 - DNA, 490 bp, Unknown
  Ascusbbf_94072, encodes 16S rRNA
agagtttgatcatggctcaggatgaacgctggcggcgtgcataacacattcaagtcgaacggagcggtttccttcgggggatcgcttagtggcggacgggtgagtaacgcgtgagtaacctgccatacacagggggataacgaccggaaacagtcgctaataccgcataacgcatgaaggtcacatggtctttatgccaaagatttatcggtgtatgatggactcgcgtccgattaggcagttggcggggcaacggcccaccaaaccgacgatcggtagccgaactgagaggttgaacggccacattggaactgagatacggtccagactcctacgggaggcagcagtggggaatattgggcaatgggcgcaagcctgacccagcgacgccgcgtgagggaagaaggtcttcggattgtaaacctctttcagcagggaagaagtcaatgacggtacctgcagaagaagtcacggctaactacgtgccagc

SEQ ID NO: 3242 - DNA, 490 bp, Unknown
  Ascusbbf_270131, encodes 16S rRNA
agagtttgatcatggctcaggacgaacgctggcggcatgcctaatacatgcaagtcgagcgaacagataaggagcttgctcctttgacgttagcggcggatgggtgagtaacacgtgggcaacctgccctgcagatggggataactccgggaaaccggggctaataccgaatgatcagtttgttcgcatgaacaaactctaaaagacggtttcggctgtcactgcaggatgggcccgcggcgcattagctagttggtgggataacggcctaccaaggcaacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaaactctgttgtgagggaagaacaagtatgggagtaactgcccgtaccttgacggtacc

SEQ ID NO: 3243 - DNA, 490 bp, Unknown
  Ascusbbf_119086, encodes 16S rRNA
agagtttgatcatggctcaggatgaacgctagctacaggcttaacacatgcaagtcgaggggcagcatgggtgtagcaatacacctgatggcgaccggcgcacgggtgcgtaacacgtatccaatctacccaatgctcggggatagccttccgaaagaaagattaatacccgatggtgtcatttcagggcctcctgtgatgactaaagattcatcggcattggatgaggatgcgtccgattaggtagtaggcggggcaacggcccacctagccgacgatcggtaggggttctgagaggaaggtcccccacactggaactgagacacggtccagactcctacgggaggcagcagtgaggaatattggtcaatgggcgcgagcctgaaccagccaagtagcgtgaaggatgactgccctacgggttgtaaacttcttttgcatgggaataacgtggcccacttgtgggctattgcatgtaccttgcgaataa

SEQ ID NO: 3244 - DNA, 490 bp, Unknown
  Ascusbbf_160406, encodes 16S rRNA
agagtttgatcctggctcaggacgaacgctggcggcatgcctaacacatgcaagtcgaacggaactgtggagcttgctttacagtttagtggcggacgggtgagtaacgcgtgagtaacctgcctttcagtggggaataatattctgaaaagagtactaataccgcataatgtacggaaaccgcatgatttttgtaccaaagatttatcgctgagagatggactcgcgtccgattagccagttggtggggtaacggcctaccaaagcaacgatcggtagccggactgagaggttgaacggccacattgggactgagacacggcccagactcctacgggaggcagcagtgggggatattgtgcaatgggggaaaccctgacacagcaatgccgcgtgaaggatgaaggtcttcggattgtaaacttcttttgtcaaggacgaagttctgacggtacttgacgaataagctccggctaactatgtgccagca

SEQ ID NO: 3245 - DNA, 474 bp, Unknown
  Ascusbbf_57216, encodes 16S rRNA
agagtttgatcctggctcagattgaacgctggcggcatggctaatgcatgcaagtcgaacgcaagcccttcggggcgaaagtggcgaaagggcgagtaacacgatcgaacgtaccccaaggtggaggatagcgtcgagaaatcggcagtaatactccatgtgctcttcggaggaaagctttggcgccttgggagcggcgatcgtcctatcaggtagttggtgaggtaaaggctcaccaagccgaagacgggtagcgggtgtgagagcatgacccgccgcatcggaactgagacactgtccggactcctacgggaggctgcagcgacgaatcttccgcaatgggcgcaagcctgacggagcaatgccgcgtgtgggatgaagcatcttcgatgtgtaaaccactgtcagattctaggaacactgaccagaatcagaggaagggccggctaacctcgtgccagcagccgcggtaat

SEQ ID NO: 3246 - DNA, 490 bp, Unknown
  Ascusbbf_149654, encodes 16S rRNA
agagtttgatcatggctcagaacgaacgctggcggcgcgtcttaagcatgcaagtcgggcgggattacggtgcttgcaccgtatgagagcggcggactggtgagtaacgcgtgggtgacgtaccctccggacggggatagctcctagaaataggaggtaataccggatacggtgcctgctgtcagagggcaggcaggaaagcagcttttgctgcgccgggggagcggcccgcgtgccattagctagtcggcggggtaacggcccaccgaggcgatgatggctacccggcctaagagggtggacgggcacattgggactgagatacggcccagactcctacgggaggcagcagctaagaatattccgcaatgggggaaaccctgacggagcgacgccgcgtggacgatgaaggccggaaggttgtaaagtccttttatgactgaagaataaggagtgtgagagaaacgcattctggtgacggtaggtcatg

SEQ ID NO: 3247 - DNA, 470 bp, Unknown
  Ascusbbf_64342, encodes 16S rRNA
agagtttgatcatggctcagaacgaacgctggcggcaggcctaacacatgcaagtcgaacgctgtagcaatacagagtggcagacgggtgagtaacgcgtgggaattttcccagtggtacggaatagctcagggaaacttggggtaataccgtataagcccttcgggggaaagatttatcgccattggatgagcccgcgttggattagctagttggtgaggtaatggctcaccaaggcgacgatccatagctggtctgagaggatgaccagccacactgggactgagacacggcccagactcctacgggaggcagcagtggggaatattggacaatgggcgcaagcctgatccagccatgccgcgtgagtgacgaaggtcttcggattgtaaagctcttttagcagggacgataatgacggtacctgcagaataagccccggctaacttcgtgccagcagccgcggtaat

SEQ ID NO: 3248 - DNA, 490 bp, Unknown
  Ascusbbf_189176, encodes 16S rRNA
agagtttgatcatggctcaggataaacgctggcggcgtgcataacacattcaagtcgaacggactgattcggaagcttgcttccgatgaaagttagtggcggacgggtgagtaacgcgtgagcaacctgcctttgtgaggggaataacatcgggaaaccggtgctaataccgcatgatgcgtagaggggacatccccattacgccaaagatttatcgcacaaagatgggctcgcgtctgattagctggttggtgaggtaacggcccaccaaggcgacgatcagtagccggactgagaggttgaacggccacattggaactgagagacggtccagactcctacgggaggcagcagtggggaatattgggcaatgggcgcaagcctgacccagcgacgccgcgtgagggaagaaggtcttcggattgtaaacctttgtagacagggacgaaacaaatgacggtacctgtaaagtaagccacggctaactacg

SEQ ID NO: 3249 - DNA, 490 bp, Unknown
  Ascusbbf_82777, encodes 16S rRNA
agagtttgatcatggctcaggatgaacgctagcggcaggcttaacacatgcaagtcgaggggcagcgcgggtagcaatacttggcggcgaccggcgaaagggtgagtaacgcgtgagcaacatacccgttggtgggggataggaggtggaaacgccttgtaataccccataggatacgaagtggcatcacattgtattgaaagattcattgtcaacggattggttcgcgtgccattaggtagacggcggggtaacggcccaccgtgccgacgatggctaggggttctgagaggaaggtcccccacattggaactgagacacggtccagactcctacgggaggcagcagtgaggaatattggtcaatggccggaaggctgaaccagccatgccgcgtgaaggaagaaggccctatgggtcgtaaacttcttttgatgtggagcaataagggccacgcgtggtccgatgagagtacacgtcgaataagcatc

SEQ ID NO: 3250 - DNA, 490 bp, Unknown
  Ascusbbf_724430, encodes 16S rRNA
agagtttgatcatggctcagaacgaacgctggcggcgcgtcttaagcatgcaagtcgaacggcaaggcgggagcttgctcccgccccagagtggcggactggtgagtaacacgtggatgacataccccccggacggggatagccggtagaaataccgggtaataccggatacggccgcacgggctagagccgtgcggggaaaggagccaaggctccgccgggggaatggtccgcggcctaccagcttgttggcggggtaacggcccaccaaggcgatgacgggtatccggcctgagagggggatcggacacattgggactgagatacggcccagactcctacgggaggcagcagctaagaatattccgcaatggacggaagtctgacggagcgacgccgcgtgaacgaagaaggccggaaggttgtaaagttcttttggacgtgaggaataagcgccgcagggaatggcggcgcggtgactgtagcgtct

SEQ ID NO: 3251 - DNA, 490 bp, Unknown
  Ascusbbf_1894233, encodes 16S rRNA
agagtttgatcctggctcagaacgaacgttagcggcgcgcttaacacatgcaagtcgcacgagaaagggcttcggccccggtacagtggcgcacgggtgagtaacacgtgggtaacctgccctcgagcaggggataacattccgaaaggagtgctaataccgcataagaccacgacctcgaaaggggttgaggtaaaagctggcctctatacataagctagcacttgaggatgggcccgcggcgcatcaggtagttggtgaggtaatggctcaccaagccaaagacgcgtagctggtctgagaggatgatcagccacactggaactgagacacggtccagactcctacgggaggcagcagtggggaatcttgcgcaatgggcgaaagcctgacgcagcgacgccgcgtgagtgatgaaggccttcgggttgtaaagctctgtggggcgagacgaataagtgcagcctaatacgttgcatgatgacggtat

SEQ ID NO: 3252 - DNA, 480 bp, Unknown
  Ascusbbf_92575, encodes 16S rRNA
agagtttgatcctggctcagaacgaacgctggcggcaggcctaacacatgcaagtcgaacgagaagccaccttcgggtggtggaaagtggcagacgggtgagtaacacgtgggaacgtgccctttggttcggaacaactctgggaaactggagctaataccggataagcccttcgggggaaagatttatcgccaaaggatcggcccgcgtctgattagctagttggtggggtaatggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgacggccttagggttgtaaagctctttcgccagggacgataatgacggtacctggataagaagccccggctaacttcgtgccagcagccgcggtaat

SEQ ID NO: 3253 - DNA, 490 bp, Unknown
  Ascusbbf_359613, encodes 16S rRNA
agagtttgatcatggctcagattgaacgctggcggcaggcttaacacatgcaagtcgggcggaaacgatgatagcttgctatcaggcgtcgagcggcggacgggtgagtaatgcataggaatctacctagtagtgggggataacattcggaaacggatgctaataccgcataattcctacgggggaaagcaggggatcttcggaccttgcgctattagatgagcctatgtcggattagctagttggtggggtaatagcctaccaaggcgacgatccgtagctggtttgagaggatgatcagccacactgggactgagacacggcccagactcctacgggaggcagcagtggggaatattggacaatgggcgcaagcctgatccagccatgccgcgtgtgtgaagaaggccttagggttgtaaagcactttcattgaggaggaaggctatttggctaatacccaaatagattgacgttactcaaagaagaa

SEQ ID NO: 3254 - DNA, 490 bp, Unknown
  Ascusbbf_715288, encodes 16S rRNA
agagtttgatcatggctcaggacgaacgctggcggcgtgcctaacacatgcaagtcgagcggggatgcgggaagtgagagcttcggcaggaacggaacgtattctagcggcggacgggtgagtaacgcgtgaatgatctgtcccggacagggggataacacttggaaacaggtgctaataccgcatgagaccacagcgtcgcatggcgcaggggtcaaaggagagatccggtttggggtgagttcgcgtctgattagctggttggtgaggtaacggcccaccaaggcgacgatcagtagccgacctgagagggtgatcggccacattggaactgagacacggtccaaactcctacgggaggcagcagtgggaatattgggcaatgggcgaaagcctgacccagcaacgccgcgtgagggaagaaggttttcggattgtaaacctctgttgtggatgacgaaggaagtgacggtaatccacaaggaagccc

SEQ ID NO: 3255 - DNA, 490 bp, Unknown
  Ascusbbf_339667, encodes 16S rRNA
agagtttgatcatggctcaggacgaacgctggcggcgtgcctaacacatgcaagtcgaacggagtaaagagcttcggttttttacttagtggcgaacgggtgagtaacgcgtgagcaacctgactctttgagggggataacagtcggaaacaactgctaataccgcataagaccacgaaccggcatcggtatgaggtcaaaggagcaatccgcagagagaggggctcgcgtcccattagatagttggcggggcaacggcccaccaagtccgcgatgggtagccgagctgagaggctgatcggccacactggaactgagacacggtccagactcctacgggaggcagcagtggggaatattgggcaatgggcgcaagcctgacccagcaacgccgcgtgagggaagaaggctttcgggttgtaaacctctgtccttggtgacgaattctgacggtagccaaggaggaagccccggctaactacgtgccagc

SEQ ID NO: 3256 - DNA, 490 bp, Unknown
  Ascusbbf_172073, encodes 16S rRNA
agagtttgatcctggctcaggatgaacgctggcggcgtgcctaacacatgcaagtcgaacggaactttttacggacaagacttcggtcaagtctgtttcaagtttagtggcggacgggtgagtaacgcgtgagcaacctgcctttcagagggggataacgttcggaaacgatcgctaataccgcataacatagggatatcgcatggtaaccctatcaaagattttatcgctgaaagatgggctcgcgtccgattaggtagttggtgaggtaacggcccaccaagccgacgatcggtagccggactgagaggttgaacggccacattgggactgagacacggcccagactcctacgggaggcagcagtggggaatattgcacaatgggcgcaagcctgatgcagcaacgccgcgtgagggaagacggttttcggattgtaaacctctgttcttagtgacgaagaagtgacggtagctaaggagcaagccac

SEQ ID NO: 3257 - DNA, 490 bp, Unknown
  Ascusbbf_303182, encodes 16S rRNA
agagtttgatcctggctcaggattaacgctggcggcgtgcctaatacatgcaagtcgaatggttagcttgctaaccatggcgaacgggtgagtaacacgtaggcaacctgtctaagagacgaggataaccattggaaacgatggataatactggataggatattggaaggcatcttctgatatttaaagatttatcgctaatagaggggcctgcggcgcattagctagttggtgaggtaacggcccaccaaggcgatgatgcgtagccggactgagaggttgaacggccacaatgggactgagaacggcccatactcctacgggaggcagcagtagggaattttcggcaatggacgaaagtctgaccgagcaacgccgcgtgaacgaagaagtatttcggtatgtaaagttcttttatttgggaagaaaatacattgactgtaccaaatgaataagctccggctaactacgtgccagcagccgcggtaat

SEQ ID NO: 3258 - DNA, 490 bp, Unknown
  Ascusbbf_296087, encodes 16S rRNA
agagtttgatcatggctcaggacgaacgctggcggcgtgcctaacacatgcaagtcgaacgagaaattaagagtagaatcttcggaggaaatgattaatggacagtggcggacgggcgagtaacgcgtgagtaacctgcccataagaaagggatagccgatggaaacgtcgagtaataccttatgacatagatacctcgcatggggaatctatcaaagatttatcgcttatggatggactcgcgtcagattagatagttggagaggtaacggctcaccaagtcgacgatctgtagccgaactgagaggttgaacggccgcattgggactgagacacggcccagactcctacgggaggcagcagtgggggatattgcgcaatggggggaaccctgacgcagcaacgccgcgtgcaggaagaaggtcttcggattgtaaactgttgtcgcaggggaagaagaaagtgacggtaccctgtgagaaagtcacgg

SEQ ID NO: 3259 - DNA, 490 bp, Unknown
  Ascusbbf_1730912, encodes 16S rRNA
aggtttgatcctggctcagagttaacgctggcatcgtgcataacacatgcaagtcgaacgggacttgccttggtagcaataccgaggtaagtttagtggcagacgggtgagtaatgtataagaaacctacctctgagtggggaataacagtccgaaaggattgctaataccccataacataattaagcggcatcgcttgattatcaaagatttatcgcttggagacggtcttatattctatcagctagttggcagtgtaacggactaccaaggcgacgacggatagccggcctgaaagggcgaccggccacaagggcactgagacacgggccctactcctacgggaggcagcagtggggaattttggacaatgggcgcaagcctgatccagcaacgatgcgtggaggatgaaggttctcggattgtaaactccttttgtaagggaagaaaaaaaatgacggtaccttacgaataagccacggctaactac

SEQ ID NO: 3260 - DNA, 490 bp, Unknown
  Ascusbbf_381041, encodes 16S rRNA
agagtttgatcctggctcaggatgaacgctggcggcaggcttaatacatgcaagtcgaacggtaaggccgagcgtagcaatacgtgaggtacacgagtggcgcacgggtgcgtaacgcgtatgcaacctgccccgcaccgggacaaaacagctggaaacggctgctaatatcccatggccacccgaggggacatccccatgggtgtaaagatttatcggtacgggatgggcatgcgtattattaggtagttggcggggtaacggcccaccaagccgacgatgattaggggtcctgagagggttaacccccacactggaactgagacacggtccagactcctacgggaggcagcagtagggaatattgggcaatgggagcaatcctgacccagccatgccgcgtgaaggaagacggccctatgggttgtaaacttcttttgccgcagagtaaacccggtcacgtgtggccggttgagagtatgcggcgaat

SEQ ID NO: 3261 - DNA, 490 bp, Unknown
  Ascusbbf_227504, encodes 16S rRNA
agagtttgatcctggctcaggataaacgctggcggcgcacataagacatgcaagtcgaacggacgagtagaattcttttagttttctacaagttagtggcggactggtgagtaacgcgtgagcaacctacctacaagaggggaacaacggagagaaatttccgctaataccgcataagctgataaaatcgcatgattcagtcagaaaaggagcaatccgcttgtagatgggctcgcgtccgattagctagttggtggggtaaaggcctaccaaggcaacgatcggtagccggactgagaggttgaacggccacattgggactgagatacggcccagactcctacgggaggcagcagtcgggaatattgcgcaatggaggaaactctgacgcagtgacgccgcgtataggaagaaggttttcggattgtaaactattgtcgttagggaagagaaaggacggtacctaaggaggaagccccggctaactatg

SEQ ID NO: 3262 - DNA, 490 bp, Unknown
  Ascusbbf_710925, encodes 16S rRNA
agagtttgatcatggctcaggacgaacgctggcggcgtgcttaacacatgcaagtcgaacgaggcttaagaacggaagtcttcggatggaaggtcataagtcgagtggcggacgggtgagtaacgcgtgagcaacctgtcttatacagggggataacactccgaaaggagcgctaataccgcataagaccacgatgccgcatggcattggggtaaaaggagcgatccggtataaggtgggctcgcgtcccattagatagttggcagggtaacggcctaccaagtcgacgatgggtagccgacctgagagggtgatcggccacattggaactgagatacggtccagactcctacgggaggcagcagtggggaatattgggcaatgggcgaaagcctgacccagcaacgccgcgtgagggatgaaggtcttcgggttgtaaacctctgtcctaagtgaaaaggaaggatggtagcttaggaggaagctccgg

SEQ ID NO: 3263 - DNA, 490 bp, Unknown
  Ascusbbf_299961, encodes 16S rRNA
agagtttgatcatggctcaggatgaacgctggcggcgtgcctaacacatgcaagtcgagcgagaatcatctgaatgaaacttcggtcgaatgacgatgaggaaagcggcggacgggtgagtaacgcgtaggcaacctgccctttgcagagggatagccactggaaacggtgattaaaacctcataacacgggactgagacatctcagacccgccaaagatttatcggcaaaggatgggcctgcgtctgattagctagttggtgaggtaacggcccaccaaggcaacgatcagtagccgacctgagagggtaatcggccacattggaactgagacacggtccaaactcctacgggaggcagcagtggggaatattgcacaatgggggaaaccctgatgcagcaacgccgcgtgaaggatgaaggcctttgggtcgtaaacttctgtcctaggggacgaaacaaatgacggtacccttggaggaagccccgg

SEQ ID NO: 3264 - DNA, 490 bp, Unknown
  Ascusbbf_1465876, encodes 16S rRNA
agagtttgatcatggctcaggacggacgctggcggcgtgcctaatacatgcaagtagaacgctgaaattggtgcttgcaccaatggatgagttgcgaacgggtgagtaacgcgtaggtaacctgcctggtagcgggggataactattggaaacgatagctaataccgcataatagttttggtcgcatgaccgagacttgaaaggagcaactgcttcactaccagatggacctgcgttgtattagctagttggtgaggtaacggctcaccaaggcgacgatacatagccgacctgagagggtgatcggccacactgggactgagacacgacccagactcctacgggaggcagcagtagggaatcttcggtaatgggggcaaccctgaccgagcaacgccgcgtgagtgaagaaggttttcggatcgtaaagctctgttgtaagtcaagaataggtgtgagagtggaaagttcacactatgacggtagctta

SEQ ID NO: 3265 - DNA, 490 bp, Unknown
  Ascusbbf_144397, encodes 16S rRNA
agagtttgatcatggctcaggatgaacgctggcggcgcgcctaacacatgcaagtcgaacggcgacggggcttcggcccctgaacagtggcggacgggtgagtaacgcgtgagtaacctgccccggtgagcggaataacgtccggaaacagacgctaataccgcatgacacattccatcggcatcggagggatgtcaaagatcaatcgcaccgggatggactcgcgtcccattagatagttggcggggcaacggcccaccaagtcagcgatgggtagccggactgagaggttgaacggccacattggaactgagagacggtccagactcctacgggaggcagcagtggggaatattgggcaatgggcgaaagcctgacccagcgacgccgcgtgagcgaagaaggtcttcggattgtaaagctctgttgacagggacgataatgacggtacctgtcgaggaagccacggctaactacgtgccagcagccg

SEQ ID NO: 3266 - DNA, 490 bp, Unknown
  Ascusbbf_771322, encodes 16S rRNA
agagtttgatcatggctcaggatgaacgccggcggtgtgcctaatacatgcaagtcgaacgcgttggcccaactgattgattgtgcttgcacaggattgacgttggtttcccaacgagtggcggacgggtgagtaacacgtaggcaacctgccccgaagcgggggacaacatttggaaacaagtgctaataccgcataacaactttgaccgcctggtcaaagcttaaaagatggtttcggctatcacttcgggatgggcctgcggcgcattagcttgttggtggggtaacggcctaccaaggcgatgatgcgtagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttgaagaagaatgtgcaagagag

SEQ ID NO: 3267 - DNA, 470 bp, Unknown
  Ascusbbf_72134, encodes 16S rRNA
agagtttgatcatggctcagaacgaacgctggcggcaggcctaacacatgcaagtcgaacgctgtagcaatacagagtggcagacgggtgagtaacacgtgggaacctaccctttggttcggaatagctcagggaaacttgaggtaataccggataagcccctagggggaaagattcatcgccgaaggatgggcccgcgtcggattagctagttggtggggtaatggcccaccaaggcgacgatccgtagctggtctgagaggatgatcagccacactgggactgagacacggcccagactcctacgggaggcagcagtggggaatattggacaatgggggcaaccctgatccagccatgccgcgtgagtgacgaaggtcttcggattgtaaagctcttttggcggggacgataatgacggtacccgcagaataagccccggctaacttcgtgccagcagccgcggtaat

SEQ ID NO: 3268 - DNA, 490 bp, Unknown
  Ascusbbf_121678, encodes 16S rRNA
agagtttgatcatggctcaggatgaacgctggcggcgtgcctaatacatgcaagtcgaacggagttaggaaagcttgcttttctgacttagtggcgaacgggtgagtaacacgtaggtaacctgcctttcagcttgggatacccagaggaaactttggctaataccggataacaacaatcgaggcatctcggatgtttgaaaggccctgcaaggggtcactgaaagatggacctgcggcgcattagctagttggtgagataacagcccaccaaggcgaggatgcgtagccgaactgagaggttgatcggccacattggaactgagacacggtccaaactcctacgggaggcagcagtaaggagttttcggcaatgggggaaaccctgaccgagcaacgccgcgtgagtgatgacggccctatgggttgtaaagctctgttgtagagaacgaatggtagcttcaggaaatgggagctatttgacggtactt

SEQ ID NO: 3269 - DNA, 472 bp, Unknown
  Ascusbbf_78798, encodes 16S rRNA
agagtttgatcatggctcagaacgaacgctggcggcatgcctaacacatgcaagtcgaacggatggcttcggccatcagtggcgcacgggtgagtaacgcgtgggaatctgcccagcagtgggggataaccttgggaaactgaggctaataccgcatacgcccctcgggggaaaggcttgccgctgctggaggagcccgcgtcggattaggtagttggtggggtaatggcctaccaagcctgtgatccgtagctggtctgagaggatgatcagccacactgggactgagacacggcccagactcctacgggaggcagcagtggggaatattggacaatgggcgcaagcctgatccagcaatgccgcgtgagtgatgaaggccttcgggttgtaaagctctttcacccacgacgatgatgacggtagtgggagaagaagccccggctaacttcgtgccagcagccgcggtaat

SEQ ID NO: 3270 - DNA, 490 bp, Unknown
  Ascusbbf_271111, encodes 16S rRNA
agagtttgatcatggctcagaacgaacgctggcggtgcgtcttaagcatgcaagtcgaacggcaagatagtagcttgctactatcctagagtggcggactggtgagtaacacgtgggtgacataccctttggctggggatagccggtagaaataccgggtaataccgaataagatccttactgttagagggtgaggatgaaaggagcttcggcttcaccgaaggaatggcccgcgcactattagctagttggtgaggtaacggcttaccaaggcaacgatagttatccggcctaagagggtgatcggacacattgggactgagatacggcccagactcctacgggaggcagcagctaagaatattccgcaatggacgaaagtctgacggagcgacaccgcgtggatgatgaaggccggaaggttgtaaaatccttttatttgcgaagaataatcaatataggtaatgatattgaggtgacggtaacaaat

SEQ ID NO: 3271 - DNA, 490 bp, Unknown
  Ascusbbf_722252, encodes 16S rRNA
agagtttgatcctggctcaggataaacgctggcggcgcacataagacatgcaagtcgaacggaagtcgttgtaatgaaatggacatgaacagagaacttgttcaaagggaatgaaaattgacttacaacaatggctttagtggcggactggtgagtaaaacgtaagcaacctggctattagaggggaacaacagttagaaatgactgctaataccgcatatgccataataaccgcatggttaaagtgggaaaggagaaatccgctgatagatgggcttacggctgattagctagttggtgtggtaaaggcataccaaggcgacgatcagtagccggactgagaggttaaacggccacattgggactgagatacggcccagactcctacgggaggcagcagtcgggaattttgcgcaatggaggaaactctgacgcagtgacgccgcgtgcaggaagaaggttttcggattgtaaactgctttagacaggg

SEQ ID NO: 3272 - DNA, 470 bp, Unknown
  Ascusbbf_664012, encodes 16S rRNA
agagtttgatcatggctcagagcgaacgctggcggcaggcttaacacatgcaagtcgagcgggcccttcggggtcagtggcagacgggtgagtaacgcgtgggaacgtaccctttggttcggaataactcagggaaacttgagctaataccggatacgcccttatggggaaaggcttgctgccgaaggatcggcccgcgtctgattagctagttggtgaggttacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaat

SEQ ID NO: 3273 - DNA, 490 bp, Unknown
  Ascusbbf_1875750, encodes 16S rRNA
agagtttgatcatggctcaggatgaacgctggcggcatgcctaagacatgcaagtcgaacgagatggtccaatgaagatggagtgcttgcacaaagttggatttgggttgccatctagtggcagacgggtgagtaacacgtgggtaatctacctcagagactgggataacggctagaaatggtcgctaataccggatgattcataattagataactagttatgctaaaaggagcttcggcttcactttgagatgagcttgcggtgtattagctagttggtggggtaatggcctaccaaggcaacgatgcatatccgagctgagaggctgatcggacacattggaactgagacacggtccagactcctacgggagacagcagttaggaatattcgtcaatgggggaaaccctgaacgagcaatgccgcgtgagtgatgaaggccctatgggtcgtaaaactctgttgtaaaggaagaacacctaagatagg

SEQ ID NO: 3274 - DNA, 490 bp, Unknown
  Ascusbbf_266530, encodes 16S rRNA
agagtttgatcatggctcaggataaacgctagcggcaggcctaacacatgcaagtcgagcggcagcgggatgtagcaatacattgccggcgagcggcggacgggtgagtaacgcgtatgcaacctgcccaccacacggagatagccgaccgaaaggacgattaaactccgatggcacctcatcaaggcatctttttgaggttaaatatttataggtggtggatgggcatgcgtggcattagttagttggcggggcaacggcccaccaagacgatgatgcctatgggttctaaaaggaagatcccacacatcggtactgagacacggaccgaactcctacgggaggcagcagtgaggaatattggacaatgggggcaaccctgatccagccaaaccgcgtgggggaaggaggccgttaaggtcgtaaaccccttttatatgggagcaatccgtcctacgtgtagggcgttgagagtaccatttgaataagc

SEQ ID NO: 3275 - DNA, 490 bp, Unknown
  Ascusbbf_1809163, encodes 16S rRNA
agagtttgatcatggctcaggacgaacgctggcggcgtgcctaacacatgcaagtcgaacggactgattcgcttcggtgatgaaagttagtggcggacgggtgagtaacgcgtgaggaacctgcctttcagagggggataacgtttggaaacgaacgctaataccgcataacgcatttttatcgcatggtagagatgccaaaggagcaatccgctgaaagatggcctcgcgtctgattagatagttggtggggtaacggcccaccaagtcgacgatcagtagccggactgagaggttgaacggccacattgggactgagacacggcccagactcctacgggaggcagcagtgagggatattgcacaatgggcgaaagcctgatgcagcaacgccgcgtgagggatgacggttttcggattgtaaacctctgtcttcggtgacgaaacaaatgacggtagccggggaggaagccacggctaactacgtgcc

SEQ ID NO: 3276 - DNA, 490 bp, Unknown
  Ascusbbf_723658, encodes 16S rRNA
agagtttgatcatggctcaggatgaacgctagcggcaggcttaacacatgcaagtcgaggggtaacgcggggtagcaataccttggcgacgaccggcgcacgggtgcgtaacgcgtatgcaacctacctgtaacaggggaataacggagggaaacttccactaatgccccatattgacacggaatcgcatgtttctgtgtcgaaagcttcggcggttacggacgggcatgcgtgacattaggtagttggtgaggcgacggctcaccaagccgacgatgtctaggggagctgagaggcttatcccccacactggtactgagacacggaccagactcctacgggaggcagcagtgaggaatattggtcaatggagggaactctgaaccagccatgccgcgtgagggatgaaggccctacgggttgtaaacctcttttgctccggagtaataagggtcctgcggggtccgatgagagtacggggcgaataagc

SEQ ID NO: 3277 - DNA, 490 bp, Unknown
  Ascusbbf_148239, encodes 16S rRNA
agagtttgatcatggctcaggatgaacgctagcggcaggcctaacacatgcaagtcgaggggtagacgtcttcggacgttgagaccggcgcacgggtgcgtaacgcgtatgcaacctgccttccacaaagggatagcccagagaaatttggattaataccttatagtatatcgacccggcatcgggatggtattaaagatttatcggtggaagatgggcatgcgtcccattagcttgttggtaaggtaacggcttaccaaggcaatgatgggtaggggtcctgagagggagatcccccacactggtactgagacacggaccagactcctacgggaggcagcagtgaggaatattggacaatgggcgcaagcctgatccagccatgccgcgtgcaggatgacggtcctatggattgtaaactgcttttatacgggaagaaaccctggctcgtgagccagactgacggtaccgtaggaataaggatcggcta

SEQ ID NO: 3278 - DNA, 490 bp, Unknown
  Ascusbbf_723570, encodes 16S rRNA
agagtttgatcatggctcagaacgaacgctggcggcgcgtcttaagcatgcaagtcgaatggcaagataagagcttgctcttatcctagaatggcggactggtgagtaacgcgtgggtgacgtaccctttagatggggatagctgttagaaatagcagataataccgaataaggtgcattttgttagagggaatgcaggaaaggatcttttgatccgctgaaggaacggcccgcgtactattagctagttggtgaggtaacggcccaccaaggcgatgatagttacccggcctaagagggggatcgggcacattgggactgagatacggcccagactcctacgggaggcagcagctaagaatattccgcaatgcacgaaagtgtgacggagcgacgccgcgtggatgatgaaggccggaaggttgtaaagtccttttaagtatgaagaataagcattgtgagagaaacgcagtgcggtgacggtagtgct

SEQ ID NO: 3279 - DNA, 490 bp, Unknown
  Ascusbbf_716664, encodes 16S rRNA
agagtttgatcctggctcaggatgaacgctggcggcgtgcctaatacatgcaagtcgaacgagttgaagagagcttgctctttgatactagtggcgaacgggtgagtaacacgtaggtaacctgcctttaagcttgggatacccagaggaaactttggctaataccggataacaacagatgaggcatctcaactgtttgaaaggccccttcaagggtcacttaaagatggacctgcggcgcattagctagttggtgagataacagcccaccaaggcgaggatgcgtagccgaactgagaggttgatcggccacattggaactgagacacggtccaaactcctacgggaggcagcagtaaggagttttcggcaatgggggaaaccctgaccgagcaacgccgcgtgagtgatgacggccctatgggttgtaaagctcttttattagagacgaatggtgggattaggaaatgaatcccacttgactgtatct

SEQ ID NO: 3280 - DNA, 490 bp, Unknown
  Ascusbbf_457698, encodes 16S rRNA
agagtttgatcatggctcaggatgaacgctagcggcaggcctaacacatgcaagtcgaggggcagcagggggtagcaataccccgctggcgaccggcggacgggtgcgtaacgcgtatgcaacctacccgtaacaggggaataacggagggaaacctccactaatgccccatatagtcatgggaccgcatggtttcgtgacgaaagcttcggtggttacggacgggcatgcgtggcattaggcggttggcggggtaacggcccaccaaacctacgatgcctaggggagctgagaggctaatcccccacactggtactgagacacggaccagactcctacgggaggcagcagtgaggaatattggtcaatggacggaagtctgaaccagccatgccgcgtgaaggaagacggccctatgggttgtaaacttcttttagccgggagtaataaggcgcacgggctgcgccgatgaaagtaccggcggaataag

SEQ ID NO: 3281 - DNA, 490 bp, Unknown
  Ascusbbf_289700, encodes 16S rRNA
agagtttgatcatggctcaggatgaacgctagcgacaggcctaacacatgcaagtcgaggggcagcgagaggaaagcttgctttctttgtcggcgaccggcgcacgggtgcgtaacgggtgtgcaatctgcccataatcggggcatagcctaacgaaagttggattaattccccatgtgctatggagaggcatctcttcgtagtgaaacgtaaggattatggttgagcacgcttctgattagatagttggtgaggtaacggctcaccaagtcgacgatcagtaggggttctgagaggaaggtcccccacattggaactgagacacggtccaaactcctacgggaggcagcagtgaggaatattggtcaatggacgagagtctgaaccagccaagtcgcgtgaaggaagacggttctatggattgtaaacttcttttgcacaagagtaaagtgtggtacgtgtaccatattgcaagtattgtgtgaataag

SEQ ID NO: 3282 - DNA, 490 bp, Unknown
  Ascusbbf_256283, encodes 16S rRNA
agagtttgatcatggctcaggatgaacgctggcggcgtgcctaacacatgcaagtcgaacgaagcgtcccgcccgaagaagaggagagcttgctcaaatcggactcaattgggacgacttagtggcggacgggtgagtaacgcgtgggtaacctgccgtgtgcagggggataacagttagaaatgactgctaataccgcataagcgcacagtatcgcatgatacagtgtgaaaagccgagacggcacacgatggacccgcgtctgattagccagttggcagggtaacggcctaccaaagcgacgatcagtagccggcctgagagggtgaacggccacattgggactgagacacggcccaaactcctacgggaggcagcagtgggggatattgcacaatgggggaaaccctgatgcagcgacgccgcgtgagtgaagaagtatttcggtatgtaaagctctatcagcagggaagaaaatgacggtacctga

SEQ ID NO: 3283 - DNA, 490 bp, Unknown
  Ascusbbf_725972, encodes 16S rRNA
agagtttgatcatggctcaggatgaacgctagcggcaggcttaacacatgcaagtcgaggggtaacaggggtgcttgcactcgctgacgaccggcgcacgggtgcgtaacgcgtatgcaatctaccttttacagggggatagcccagagaaatttggattaatacctcatagtatatggacttggcatcgagtcgatattaaagatttatcggtaaaagatgagcatgcgttctattagctagatggtaaggtaacggcttaccatggcaacgatagataggggccctgagagggggatcccccacactggtactgagacacggaccagactcctacgggaggcagcagtgaggaatattggacaatgggcgagagcctgatccagccatgccgcgtgcaggaagactgccctatgggttgtaaactgcttttatacaggaagaaacactccctcgtgagggagcttgacggtactgtaagaataaggat

SEQ ID NO: 3284 - DNA, 490 bp, Unknown
  Ascusbbf_652708, encodes 16S rRNA
agagtttgatcctggctcaggatgaacgctggcggcgtgcctaacacatgcaagtcgagcgggaaatacggaaatgaagcttcggtagattttctgtatggagagcggcggacgggtgagtaacgcgtaggcaacctaccccatacacagggatagccacgggaaactgtgattaaaacctgatgatgcgtcgaagtcacatgacattgacgtcaaagatttatcggtgtgggatgggcctgcgtctgattagctggttggtggggtaacggctcaccaaggcgacgatcagtagccgacctgagagggtaatcggccacattggaactgagacacggtccaaactcctacgggaggcagcagtggggaatattgcacaatgggcgaaagcctgatgcagcaacgccgcgtgagcgatgaaggcctttgggtcgtaaagctctgtccttggggaagaaacaaatgacggtacccttggaggaagccccgg

SEQ ID NO: 3285 - DNA, 490 bp, Unknown
  Ascusbbf_718637, encodes 16S rRNA
agagtttgatcatggctcaggacgaacgctggcggcgtgcctaacacatgcaagtcgaacggagtgttgcgctgaaaggaaggtagcttgctaccggaatttcttgtaacacttagtggcggacgggtgagtaacgcgtgagcaacctgccttacagagggggacaacagttggaaacgactgctaataccgcataacataccgattgggcatccagacggtatcaaaggagcaatccgctgtaagatgggctcgcgtccgattagatagttggtgaggtaacggcccaccaagtctgcgatcggtagccggactgagaggttgatcggccacattgggactgagacacggcccagactcctacgggaggcagcagtgggggatattgcacaatgggggaaaccctgatgcagcaacgccgcgtgagggaagaaggttttcggattgtaaacctctgtttttagtgaagaaacaaatgacggtagctaaa

SEQ ID NO: 3286 - DNA, 490 bp, Unknown
  Ascusbbf_738348, encodes 16S rRNA
agagtttgatcatggctcaggataaacgctagcggcaggcctaacacatgcaagtcgagcggcaacgggagtagcaatacttgccggcgagcggcggacgggtgagtaacgcgtatgcaacctgcccgcaacacggagatagccgaccgaaaggacgattaaactccgatggcatcagccccccgcatgagggactgattaaatatttataggttgcggatgggcatgcgtggcattagttagttggcggggcaacggcccaccaagacgatgatgcctatgggttctaaaaggaagatcccacacatcggtactgagacacggaccgaactcctacgggaggcagcagtgaggaatattggacaatgggggcaaccctgatccagccaaaccgcgtgggggaaggaggccgttaaggtcgtaaaccccttttatatgggagcaatccgcttcatgcatggagcgttgagagtaccatttgaataagcat

SEQ ID NO: 3287 - DNA, 490 bp, Unknown
  Ascusbbf_1787356, encodes 16S rRNA
agagtttgatcatggctcaggacaaacgctggcggcgtgcctaacacatgcaagtcgaacgaagcacagaggatagagacttcggtcaatagagcctgtgacttagtggcggacgggtgagtaatgcatgagcaacctgccctggagagggggacaacagctggaaacggctgctaataccgcatgaagttgcgagggggcatccctttgcaaccaaagatttatcgctctgggatgggctcatgtctgattagtttgttggcggggcaacggcccaccaagactacgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttatcagggacgaagaacgtgacggtacctgatgaataagccacg

SEQ ID NO: 3288 - DNA, 490 bp, Unknown
  Ascusbbf_424019, encodes 16S rRNA
agagtttgatcatggctcagaacgaacgctggcggcgcgttttaagcatgcaagtcgaacggcaagggtggagcttgctctacccctagagtggcggactggtgagtaacacgtgggtaatctaccttgaggatggggatagctgttagaaatagcagataataccgaataagcttgatatgttaaatcatgacaaggaaagggagctacggcttcgccttaagaagagcccgcggcccattagctagttggtgaggtaaaggcccaccaaggcgacgatgggtatccgacctgagagggtgatcggacacattgggactgagagacagcccagactcctacgggaggcagcagctaagaatcttccgcaatgggcgaaagcctgacggagcgacgccgcgtgtacgaagaaggccgaaaggttgtaaagtacttttgcatatgaagaataagcgatatagggaatgatattgtgatgacggtaatatgc

SEQ ID NO: 3289 - DNA, 490 bp, Unknown
  Ascusbbf_119194, encodes 16S rRNA
agagtttgatcatggctcaggatgaacgctggcggcgtgcctaacacatgcaagtcgaacggagtacccgagacagcgacttcggtcaaagttttggaatacttagtggcggacgggtgagtaacacgtgagtaacctgcccttcagagggggataacataccgaaaggtatgctaataccgcatgaagtatataatccgcatggaatatatatcaaagatttatcgctgaaggatggactcgcgtctgattaggtagttggtgaggtaacggctcaccaagccgacgatcagtagccggactgagaggttgaacggccacattgggactgagacacggcccagactcctacgggaggcagcagtggggaatattgcgcaatgggggaaaccctgacgcagcgacgccgcgtgaaggaagaaggttttcggatcgtaaacttttgtcatcggggacgagtaaggacggtacccgaggaggaagccacggc

SEQ ID NO: 3290 - DNA, 490 bp, Unknown
  Ascusbbf_726946, encodes 16S rRNA
agagtttgatcatggctcaggatgaacgctggcggcgtgcctaacacatgcaagtcgaacgaagctcttgaagcggagatttcggtcaaagctgatagatgactgagtggcggacgggtgagtaacgcgtgggcaacctgccccatactgggggatagcagttggaaacgactgataataccgcataagcgcacagtaaggcatcttacagtgtgaaaagatttattggtatgggatggacccgcgtctgattagctagttggtgaggtaacggcccaccaaggcgacgatcagtagccggactgagaggtcggacggccacattgggactgagagacggcccaaactcctacgggaggcagcagtgggggatattgcacaatgggggaaaccctgatgcagcgacgccgcgtgagtgaagaagtatttcggtatgtaaagctctatcgacagggaagaaagactccgtaaggagagatgacggtacctg

SEQ ID NO: 3291 - DNA, 490 bp, Unknown
  Ascusbbf_198116, encodes 16S rRNA
agagtttgatcatggctcagagtgaacgctggcggcgtggttaagacatgcaagtcgagcgggatttttcattaagagtcttcggatgattaatgagaatgagagcggcaaacgggtgagtaacacgtaaataacttgccctctagtttgggatagctcgttgaaagacgaattaataccggatgtggttttctttcgtatggaagagatactaaagcttgtgatggcgctaggggagaggtttacggcctatcagcttgttggtaaggtaacggcttaccaaggcaaagacgggtagctggtctgagaggatgatcagccacattggaactgagacacggtccagacacctacgggtggcagcagtttcgaattattcacaatggacgaaagtctgatggtgcaacgccgcgtgggggatgaaggttttcgaattgtaaacccctgtcgctgaggagtaaaggttaggtttatagcctaatttgaatta

SEQ ID NO: 3292 - DNA, 490 bp, Unknown
  Ascusbbf_462587, encodes 16S rRNA
agagtttgatcatggctcaggacgaacgctggcggcgtgcctaacacatgcaagtcgaacgaagcgccttgacgcaagacttcggtcaagctgatgggatgacttagtggcggacgggtgagtaacgcgtgaggaacctgcctttcagtgggggacaacagttagaaatgactgctaataccgcataatgcagcgaaaccgcatgattttgctgccaaagctttatgtgctgaaagatggcctcgcgtctgattagatagttggtggggtaacggcctaccaagtcgacgatcagtagccggattgagaggttgaacggccacattgggactgagatacggcccagactcctacgggaggcagcagtggggaatattgggcaatgggggaaaccctgacccagcaacgccgcgtgaaggaagaaggctttcgggttgtaaacttcttttaccagggacgaaggacgtgacggtacctggagaaaaagcca

SEQ ID NO: 3293 - DNA, 490 bp, Unknown
  Ascusbbf_1425415, encodes 16S rRNA
agagtttgatcatggctcaggacgaacgctggcggcgtgcttaacacatgcaagtcgaacggtaaggccctttcgggggtacacgagtggcgaacgggtgagtaacacgtgagtaacctgcccacttcttcgggataacgctaggaaactggtgctaataccggatatgagctcctgccgcatggtgggggttggaaagtgtttgtggtggtggatggactcgcggcctatcagcttgttggtgaggtagtggctcaccaaggcggtgacgggtagccggcctgagagggtgaccggccacattgggactgagatacggcccagactcctacgggaggcggcagtggggaatattgcacaatgggcggaagcctgatgcagcaacgccgcgtgcgggatgacggccttcgggttgtaaaccgctttcaccaggggcgaaggcatccttttggggtgttgacggtacctggagaagaagcaccggctaact

SEQ ID NO: 3294 - DNA, 490 bp, Unknown
  Ascusbbf_716901, encodes 16S rRNA
agagtttgatcctggctcagaatgaacgctggcggcatggattaggcatgcaagtcgaacgagaaagcccgcaagggcgagtaaagtggcgaaagggtgagtaacacgtgagcaacctgcccccgagaccggaacaagcctgggaaaccgggtctgagaccggatgcggaccgggaagacatcttccctcgtccaaacatttcatggctcggggatgggctcgcgccccattagcttgttggcggggtaacggcccaccaaggctacgacgggtaggtggtctgagaggatggtcacccacactgggactgagacactgcccagactcctacgggaggctgcagtcgagaatcttccgcaatgggcgcaagcctgacggagcgatgccgcgtgggggaagaaggccctcgggttgtaaacccctgtcgcgcgggacgaaaccagatgacggtaccgcgcaagaaagccacggctaactacgtgccagcag

SEQ ID NO: 3295 - DNA, 490 bp, Unknown
  Ascusbbf_1811336, encodes 16S rRNA
agagtttgatcctggctcaggacgaacgctggcggcgtgcctaatacatgcaagtcgtacgcaccgaaggagagcttgctcttctgacgtgagtggcgaacgggtgagtaacacgtgggaaacctacccttcagcgggggataaccatcggaaacgatgactaataccgcatagacgatagaaccgcctggttcaatcgggaaagatggcttcggctatcactgaaggatggtcccgcgctgcattagctagttggtaaggtaacggcttaccaaggccatgatgcatagccgacctgagagggtgatcggccacattgggactgagacacggcccaaactcctacgggaggcagcagtagggaatcttccgcaatggacgcaagtctgacggagcaacgccgcgtgtgtgaagaaggttttcggatcgtaaagcactgttattagagaagaacaaccgatagagtaactgttatcggtctgacggtatc

SEQ ID NO: 3296 - DNA, 469 bp, Unknown
  Ascusbbf_284045, encodes 16S rRNA
agagtttgatcctggctcagaacgaacgctggcggcaggcctaacacatgcaagtcgaacgagatcttcggatctagtggcgcacgggtgagtaacgcgtaggaatctacctgatagttcgggataacagttggaaacggctgctaataccggatacgccctttgggggaaagaatttcgctatcagatgagcctgcgtgacattagctagttggtagggtaatggcctaccaaggcgacgatgtctagctggtctgagaggatgatcagccacactgggactgagacacggcccagactcctacgggaggcagcagtggggaatattgggcaatgggcgcaagcctgacccagccatgccgcgtgagtgatgacggccttagggttgtaaagctctttcagtagtgacgatgatgacagtagctacagaagaagccccggctaacttcgtgccagcagccgcggtaat

SEQ ID NO: 3297 - DNA, 490 bp, Unknown
  Ascusbbf_714643, encodes 16S rRNA
agagtttgatcctggctcagaacgaacgctggcggcgcgttttaagcatgcaagtcgaatggaagttattcttcgggataatggacatggcggactggtgagtaacacgtagataatctacccttgagttggggataccccatggaaacatgggataataccgaatgaagtctaactatcacaagatggaatgatgaaagaggcgattgcctcgcttaaggatgagtctgcggctcattagctagttggtggggtaacggcctaccaaggcgatgatgagtagccggcctgagagggtgaacggccacattgggactgagatacggcccaaactcctacgggaggcagcagctaagaatcttccgcaatggacgaaagtctgacggagcgacgccgcgtgcacgaagaaggcagagatgttgtaaagtgcttttattggggaagaataagggtagcaggaaatggctgcctgatgacaataaccagtgaa

SEQ ID NO: 3298 - DNA, 490 bp, Unknown
  Ascusbbf_984378, encodes 16S rRNA
agagtttgatcatggctcaggatgaacgctggcggcgtgcttaacacatgcaagtcgaacgaagcatttgtacctgatcttttcggagtgaagggacttatgacttagtggcggacgggtgagtaacgcgtgggcaacctgccgtatgcagggggacaacagttggaaacgactgctaataccgcataagcgcacactgtcacatggcagagtgtgaaaagaattatcggcatacgatgggcccgcgttggattaggtagttggtgaggtaacggcccaccaagccgacgatccatagccgacctgagagggtgaccggccacattgggactgagacatggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgcacaagaagccccgg

SEQ ID NO: 3299 - DNA, 490 bp, Unknown
  Ascusbbf_352660, encodes 16S rRNA
agagtttgatcctggctcagattgaacgctggcggcaggcctaacacatgcaagtcgagcggcagcgggaagtagcttgctactttgccggcgagcggcggacgggtgagtaacgcgtgggaatctacccatttgtgggggataacttggggaaacccaagctaataccgcataatccctacgggggaaagcaggggctcttcggaccttgcgcagatggatgagcccgcgtcggattagctagttggtagggtaaaggcctaccaaggcgacgatccgtaactggtctgagaggatgaccagtcacatcgggactgagacacggcccgaactcctacgggaggcagcagtggggaatcttggacaatgggggcaaccctgatccagccatgccgcgtgtgtgaagaaggccctagggttgtaaagcactttcagtagggaggaaggcttcgggttaataccctggagtacttgacgttacctacagaag

SEQ ID NO: 3300 - DNA, 490 bp, Unknown
  Ascusbbf_263872, encodes 16S rRNA
agagtttgatcatggctcaggacgaacgctggcggcgtgcctaacacatgcaagtcgaacgggacttaccggaacgagacttcggtcaagtgaaagtgagtttagtggcggacgggtgagtaacgcgtgagcaacctgcctttcggagggggacaacagctggaaacggctgctaataccgcataatattaccagtaggcatctacaggtaatcaaagatttatcgccgaaagatgggctcgcgtctgattagatagttggtggggtaacggcccaccaagtcaacgatcagtagccggactgagaggttgaacggccacattgggactgagatacggcccagactcctacgggaggcagcagtggggaatattgggcaatgggggcaaccctgacccagcaacgccgcgtgaaggaagaaggctttcgggttgtaaacttctttgacgagggacgaagtaagtgacggtacctcgaaaacaagccacgg

SEQ ID NO: 3301 - DNA, 490 bp, Unknown
  Ascusbbf_483723, encodes 16S rRNA
agagtttgatcatggctcaggatgaacgctggcggcgtgcctaacacatgcaagtcgagcgagaagcccatgatcgatacttcggttgattgattgggtggaaagcggcggacgggtgagtaacgcgtaggcaacctgccccctgcagagggatagcctcgggaaaccgggattaaaacctcataacgcagactgcagacatctgcggtctgccaaagatttatcggcaggggatgggcctgcgtctgattagttagttggtggggtaacggcctaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaaggatgaaggcccttgggtcgtaaacttctgttctaagggaagataatgacggtaccttaggagcaagtcccggcta

SEQ ID NO: 3302 - DNA, 490 bp, Unknown
  Ascusbbf_737873, encodes 16S rRNA
agagtttgatcatggctcaggacgaacgctggcggcgcgcctaacacatgcaagtcgaacggacgagaggagcttgctcctcaagttagtggcggacgggtgagtaacacgtgagcaacctgcctttcagagggggacaacagttggaaacgactgctaataccgcataacgtggcttgggggcatccccgggctaccaaagatttatcgctgaaagatgggctcgcgtctgattagatagttggtgaggtaacggcccaccaagtcgacgatcagtagccggactgagaggttgaacggccacattgggactgagacacggcccagactcctacgggaggcagcagtgggggatattggacaatgggggcaaccctgatccagcgacgccgcgtgagggaagaaggttttcggattgtaaacctctgttgacagggaagaaaatgacagtacctgttcagaaagccacggctaactacgtgccagcagc

SEQ ID NO: 3303 - DNA, 490 bp, Unknown
  Ascusbbf_1357384, encodes 16S rRNA
agagtttgatcatggctcaggacgaacgctggcggcgtgcctaacacatgcaagtcgagcggactgataatgaaagcttgctggatttatcagttagcggcggacgggtgagtaacgcgtgagcaacctgtcctctacagggggataagatctcgaaagggattctaataccgcatgagaccacagtgggacatcccacaggggtcaaaggagcaatccggtagagggtgggctcgcgtccgattagatagttggtgaggtaacggcccaccaagtcgacgatcggtagccgacctaagagggtgatcggccacattgggactgagacacggcccagactcctacgggaggcagcagtggggaatattgggcaatgggggaaaccctgacccagcaacgccgcgtggaggaagaaggtcttcggatcgtaaactcctgtcctaagggaagaggagaagactgtaccttaggaggaagccccggctaacta

SEQ ID NO: 3304 - DNA, 490 bp, Unknown
  Ascusbbf_363802, encodes 16S rRNA
agagtttgatcctggctcaggatgaacgctggcggcgtgcctaacacatgcaagtcgagcggagttatgagaggtgcttgcaccacttttaacttagcggcggacgggtgagtaacacgtgagtaacctgccctcgagtggggaacaacatcgagaaatcggtgctaataccgcataacatctctttaccgcatgatagagagatcaaaggatttattcgcttgaggatggactcgcgtccgattagttagttggtgaggtaacggcccaccaagacatcgatcggtagccgaactgagaggttgatcggccacattgggactgagacacggcccagactcctacgggaggcagcagtggggaatattgggcaatgggcgaaagcctgacccagcaacgccgcgtgaaggatgaaggtcttcggattgtaaacttctttgatcagggacgaaacaaatgacggtacctgaagaacaagccacggctaact

SEQ ID NO: 3305 - DNA, 490 bp, Unknown
  Ascusbbf_456707, encodes 16S rRNA
agagtttgatcctggctcaggatgaacgctggcggcgtgcttaacacatgcaagtcgaacggaacttttctcccgacaaagcggagagcttgctcgaagtagagtcaattgaaaagtttagtggcggacgggtgagtaacgcgtgggtaacctgccatatacagggggataacacttagaaataggtgctaataccgcataagcctacagaatcgcatgattcagtaagaaaaactccggtggtatatgatggacccgcgtctgattagctagttggtgaggtagtggctcaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgac

SEQ ID NO: 3306 - DNA, 490 bp, Unknown
  Ascusbbf_1360754, encodes 16S rRNA
agagtttgatcatggctcaggatgaacgctggcggcgtgcttaacacatgcaagtcgaacgaatttctgacagaatgcggcttcggccaagtgaagacagaagtgagtggcggacgggtgagtaacgcgtgggtaacctaccttacacagggggataacgattggaaacgatcgctaataccgcataagaccacagtgccgcatggtacaggggtaaaagatttatcggtgtaagatggacccgcgtctgattaggcagttggcgaggtaacggctcaccaaacctacgatcagtagccgacctgagagggtgatcggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacggtacctgactaagaagcaccggc

SEQ ID NO: 3307 - DNA, 490 bp, Unknown
  Ascusbbf_259136, encodes 16S rRNA
agagtttgatcatggctcaggatgaacgctggcggcgtgcataacacattcaagtcgaacggacggaagggagcttgctccctgaagttagtggcggacgggtgagtaacgcgtgagcaacctgcctttgcgagcgggataacgacgggaaactgtcgctaataccgcatgacacagcgactccgcatggagatgctgtcaaagattttatcgcgcaaagatgggctcgcgtctgattagatagttggcagggtaacggcctaccaagtctgcgatcagtagccggactgagaggttgaacggccacattggaactgagaaacggtccagactcctacgggaggcagcagtggggaatattgggcaatgggcgcaagcctgacccagcgacgccgcgtgagggaagaaggtcttcggattgtaaacctttgttgacagggacgaagaagatgacggtacctgtcgaggaagccacggctaactacgtgcc

SEQ ID NO: 3308 - DNA, 490 bp, Unknown
  Ascusbbf_404957, encodes 16S rRNA
agagtttgatcatggctcaggacgaacgctggcggcgtgcctaacacatgcaagtcgaacggggaccaagagagcttgctctctgaagtcctagtggcgaacgggtgagtaacacgtgagcaacctgtcccagactcggggataaccaagggaaaccttggctaataccggataccctcttcgggccgcatggcccgatgcggaaagtttttcggtctgggaggggctcgcggcctatcagcttgttggcggggtaacggcccaccaaggctacgacgggtagctggtttgagagaacgatcagccacactggaactgagacacggtccagactcctacgggaggcagcagtggggaatcttgcgcaatgggcgaaagcctgacgcagcaacgccgcgtgcgggaggaaggccttcgggttgtaaaccgctttcagcagggacgaaaatgacggtacctgcagaagaagccccggctaactacgtgccag

SEQ ID NO: 3309 - DNA, 490 bp, Unknown
  Ascusbbf_1566566, encodes 16S rRNA
agagtttgatcatggctcaggacgaacgctggcggcgcgcctaacacatgcaagtcgaacggagatacgctgatagaagcttcggcagaaagaatcgtatcttagtggcgaacgggtgagtaacgcgtgagtaacctgccttcgagagggggacaacagttggaaacgactgctaataccgcatgagcccacactatcgcatgatagagtgagaaaaggagagatccgcttgaagatggactcgcgtctgattagccagttggtgaggtaacggctcaccaaagcgacgatcagtagccggactgagaggttgatcggccacattgggactgagacacggcccagactcctacgggaggcagcagtggggaatattgcacaatggggggaaccctgatgcagcgacgccgcgtggaggaagaaggtattcgtattgtaaactcctgtcgtgtgggacgaagatgacggtaccacacaagaaagcaccggc

SEQ ID NO: 3310 - DNA, 490 bp, Unknown
  Ascusbbf_742548, encodes 16S rRNA
agagtttgatcatggctcaggatgaacgctggcggcgtgcataacacattcaagtcgaacggacgacggggagcttgctccccgaagttagtggcggacgggtgagtaacgcgtgagcaacctgccttgcaaagcgggacaacattgggaaaccggtgctaataccgcatgacatacaagtttcgcatgggacatgtatcaaagattaatcgatgcaagatgggctcgcgtccgattagatagttggtgaggtaacggctcaccaagtcgacgatcggtagccggactgagaggttgaacggccacattggaactgagaaacggtccagactcctacgggaggcagcagtggggaatattgggcaatgggcgaaagcctgacccagcgacgccgcgtgaaggaagaaggtcttcggattgtaaacttttgtcgacagggaagataatgacggtacctgtcaaggaagccacggctaactacgtgccagca

SEQ ID NO: 3311 - DNA, 490 bp, Unknown
  Ascusbbf_156025, encodes 16S rRNA
agagtttgatcatggctcagagttaacgctggcggcgtgcctaacacatgcaagtcgagcgagtgcttgtaaagactagcggcaaacgggtgagtaacacatgggaaaccttccttagaatggggaatatctccgtgaaaacggagctaataccgcataagaccacagtttggcatcgaacaggggtaaaagcagcgatgtgttctaagatggtcctgtgtcctatcagctagttggtggggtagaggcctaccaaggcgaagacgggtatccggcctgaaagggtgaacggacacactggaactgagacacggtccagactcctacgggaggcagcagtggggaattttggacaatgggggaaaccctgatccagcgacgccgcgtggaggatgaaggttttaggattgtaaactccttttggaggggaagaaaaaaatgacggtaccctcagaaaaagccacggctaacttcgtgccagcagccgcgg

SEQ ID NO: 3312 - DNA, 490 bp, Unknown
  Ascusbbf_1875386, encodes 16S rRNA
agagtttgatcatggctcaggatgaacgctggcggcgtgcctaacacatgcaagtcgagcgggaaggcctcaactgaaacttcggtcgaatgcgaggctggatagcggcggacgggtgagtaacgcgtaggtaacctgccccatacagaggaatagcctagggaaacctggattaatgcctcataatgcgagacggccacatggccgattcgccaaagatttatcggtatgggatggacctgcgtctgattagctagttggtgaggtaacggcccaccaaggcaacgatcagtagccgacctgagagggtgatcggccacattggaacagagacacggtccaaactcctacgggaggcagcagtgggggatattgcacaatggagggaactctgatgcagcaacgccgcgtgagcgatgaaggtcttcggatcgtaaagctctgtccttagggacgaagaaagtgacggtacctaaggaggaagccccgg

SEQ ID NO: 3313 - DNA, 490 bp, Unknown
  Ascusbbf_1838940, encodes 16S rRNA
agagtttgatcctggctcaggatgaacgctagctacaggcctaacacatgcaagtcgaggggcagcagatcgaaagcttgcttttgatgctggcgaccggcgaatgggtgagtcacgcgtgtccaacctgccttcagcccggggatagcccttggaaatgaggattaagacccgatacgtgcccgttccgcatggcgcgggcatgaaactggactgaagatggggacgcgtcggattagcttgacggcggggcaatggcccaccgtggcgacgatccgcaggggttctgagaggaaggtcccccacactggcactgagacacgggccagactcctacgggaggcagcagtgaggaatattggtcaatggccgagaggctgaaccagccaagtagcgtgcaggatgacggccctacgggttgtaaactgcttttgcgggaggataaacggcactacgtgtagtgccttgcaggtatcccgtgaataaggac

SEQ ID NO: 3314 - DNA, 490 bp, Unknown
  Ascusbbf_1732768, encodes 16S rRNA
agagtttgatcatggctcaggacgaacgctggcggcgtgcttaacacatgcaagtcgaacgaggtccatggagcttgctccggaagacctagtggcgaacgggtgcgtaacacgtgagaaacctgccctggacttgggaataacagtcggaaacgactgctaataccgaataccttcacaccatcgcatggtgaagtgaagaaagcttttgcggttcaggagggtctcgcggcctatcagcttgttggtgaggtaacggctcaccaaggcatcgacgggtagctggtctgagaggatgatcagccacactgggactgagacacggcccagactcctacgggaggcagcagtggggaatattgcacaatgggcgaaagcctgatgcagcaacgccgcgtgcgggaagaaggccctagggttgtaaaccgctttcagcagggaagaaaatgacggtacctgcagaagaaggtgcggccaactacgtgccagc

SEQ ID NO: 3315 - DNA, 490 bp, Unknown
  Ascusbbf_906056, encodes 16S rRNA
agagtttgatcatggctcaggatgaacgctggcggcgtgcttaatacatgcaagtcgaacgaggtactgcgaatgaaattttcggatggattttgcaataccgagtggcggacaggtgagtaacgcgtgggtaacctgccttacacagggggacaacagagagaaatttctgctaataccgcataacccgcttgggccgcatggccctgacggaaaagatttatcggtgtaagatggacccgcgtctgattagccagttggtggggtaacggcctaccaaagcgacgatcagtagccgaactgagaggttgaccggccacattgggactgagacacggcccagactcctacgggaggcagcagtagggaatattgcacaatggggggaaccctgatgcagcaacgccgcgtgagtgaagaagtatttcggtatgtaaagctctatcagcagggaagagaatgacggtacctgcataagaagccccggcta

SEQ ID NO: 3316 - DNA, 490 bp, Unknown
  Ascusbbf_742003, encodes 16S rRNA
agagtttgatcatggctcaggacgaacgctggcggcgtgcttaacacatgcaagtggtgcgacgaaccagggcttgccctggggcaaagccgcgaacgggtgagtaacacgtgagtaacctgccccgatgaccgggacaacccgaggaaactcgggctaataccggatgtggcgtgcggatgtaagtccgcccgctaaaggaagcttcggcctccgcattgggaggggctcgcggcccattagtttgttggtggggtaacggcctaccaagacttcgatgggtagctggtctgagaggacgatcagccacactgggactgagacacggcccagactcctacgggaggcagcagtggggaatcttgcgcaatgcgcgaaagcgtgacgcagcaacgccgcgtgggggaagacggctttcgggttgtaaacccctttcaggagggacgaaggttcgccggtgaatagccgtgcggattgacggtaccttcag

SEQ ID NO: 3317 - DNA, 490 bp, Unknown
  Ascusbbf_1793296, encodes 16S rRNA
agagtttgatcatggctcaggacgaacgctggcggcgtgcctaacacatgcaagtcgagcgggatccatccagtggcaacactggggaagatctagcggcgaacgggtgagtaacacgtgagaaacttgccccggagtacgggataacccgaggaaactcgagctaataccgtatgccctcttctgatcgcatggtcggatgaggaaagatttatcgctccgggagagtctcgcggcctatcagctagttggtggggtaatggcccaccaaggcatcgacgggtagctggtctgagaggacgatcagccacactgggactgagacacggcccagactcctacgggaggcagcagtggggaatcttgcgcaatgggcgaaagcctgacgcagcaacgccgcgtgcgggatgaaggccttcgggttgtaaaccgctttcagcagggaagaaattgacggtacctgcagaagaagccccggccaactacgtgc

SEQ ID NO: 3318 - DNA, 490 bp, Unknown
  Ascusbbf_442189, encodes 16S rRNA
agagtttgatcatggctcaggacgaacgctggcggcgtgcttaacacatgcaagtcgagcgaggaccgcaccttcgggtgtggagccgagcggcgaacgggtgagtaacacgtgagcaacctacccctggcaccgggatagccccgggaaactgggattaataccggatacgaccacttcccgcatgggatggtggtggaaaggttcccccttgtggggttccggccagggatgggctcgcggcccatcagctagttggcggggtaacggcccaccaaggcgatgacgggtagccggcctgagagggcggtcggccacactgggactgagacacggcccagactcctacgggaggcagcagtggggaatattgcgcaatgggcggaagcctgacgcagcgacgccgcgtgggggatgaaggccttcgggttgtaaacctctttcagcagggacgaagttgacgtgtacctgcagaagaagcgccggccaa

SEQ ID NO: 3319 - DNA, 490 bp, Unknown
  Ascusbbf_481281, encodes 16S rRNA
agagtttgattatggctcagattgaacgctggcggcgtgcctaacacatgcaagtcgagcgatgatcggggaatgagaccttcgggtggatttccctgagattagcggcggatgggtgagtaacgcgtgggcaatctgccctccacagggggataacacagggaaacttgtgctaataccgcacaacatctcggggaggcatctctctgagatcaaaggagcgatccggtgaaggaggagcccgcgtctgattagttggttggtgaggtaacggcccaccaaggcgacgatcagtagccgaactgagaggttgatcggccacattgggactgagacacggcccagactcctacgggaggcagcagtggggaatattgcacaatggaggaaactctgatgcagcaacgccgcgtgaaggatgacggccttcgggttgtaaacttctttggcaggggacgaagacagtgacggtaccctgagaacaagccac

SEQ ID NO: 3320 - DNA, 490 bp, Unknown
  Ascusbbf_723132, encodes 16S rRNA
agagtttgatcctggctcaggatgaacgctggcggcgtgcctaacacatgcaagtcgaacgaagctcttgatgcggagatttcggtcaaagcggatagatgactgagtggcggacgggtgagtaacgcgtgggcaacctgcccttatctgggggatagcagttggaaacgactgataataccgcataagcgcacagtgaggcatctcacggtgtgaaaagatttatcggataaggatggacccgcgtctgattagctagttggtgaggtaacggcccaccaaggcgacgatcagtagccggactgagaggtcggacggccacattgggactgagagacggcccaaactcctacgggaggcagcagtgggggatattgcacaatggggggaaccctgatgcagcgacgccgcgtgagtgaagaagtatttcggtatgtaaagctctatcgacagggaagaaagactccgtaaggagagatgacggtacctg

SEQ ID NO: 3321 - DNA, 490 bp, Unknown
  Ascusbbf_1090356, encodes 16S rRNA
agagtttgatcatggctcagaatgaacgctggcggcgcgtcttaagcatgcaagtcggacggcaggctgccttcgggcagccgagagtggcgaacgggtgagtaacacgtaagtgatctgccctgcagttggggatagcctgtggaaacacagggtaataccggatgagatgtcaatgattgaactatgacatgaaagtggccacggccacgctgcaggatgagcttgcggctcattagctagttgggggtgtaacggaccaccaaggcgacgatgagtagccggcctgagagggtgaacggccacattgggactgagacacggcccagactcctacgggaggcagcagctaagaatattccgcaatggggggaaccctgacggagcgacgccgcgtgaacgatgaaggcagagatgtcgtaaagttcttttatcactgaagaataaggggggcagggaatggccctccgatgacgttaggtgatgaata

SEQ ID NO: 3322 - DNA, 490 bp, Unknown
  Ascusbbf_1401712, encodes 16S rRNA
agagtttgtcctggctcaggatgaacgctggtggcgtgcttaacacatgcaagtcgaacgattaaaccggcttcggccggatatagagtggcgaacgggtgagtaacacgtgaccaacctaccccatactccgggataactcagggaaacttgtgctaataccggatactccgagaggatcgcatgttcttttcgggaaagcctttacggtatgggatggggtcgcggcccattaggtagacggcggggtaacggcccaccgtgccgatgatgggtagccgagctgagaggctgatcggccacattgggactgagatacggcccagactcctacgggaggcagcagtggggaattttgcgcaatgggggaaaccctgacgcagcaacgccgcgtgcgggatgacggccttcgggttgtaaaccgctttcagtggggacgattatgacggtacccacagaagaagctccggctaaatacgtgccagcagcc

SEQ ID NO: 3323 - DNA, 490 bp, Unknown
  Ascusbbf_356490, encodes 16S rRNA
agagtttgatcatggctcaggatgaacgctggcggcgtgcctaacacatgcaagtcgagcgggaaatattgaaatgaaacttcggtagattttcgatatggagagcggcggacgggtgagtaacgcgtaggcaacctgcccctggcagagggatagccactggaaacggtgattaaaacctcataacgcgtaacggttgcataaccgatacgccaaagatttatcggcaagggatgggcctgcgtctgattagctggttggtgaggtaacggctcaccaaggcgacgatcagtagccgacctgagagggcaatcggccacattggaactgagacacggtccaaactcctacgggaggcagcagtggggaatattgcacaatgggggaaaccctgatgcagcaacgccgcgtgaaggaagaaggcctttgggtcgtaaacttctgtccttggggacgaataaagtgacggtacccttggaggaagccccgg

SEQ ID NO: 3324 - DNA, 490 bp, Unknown
  Ascusbbf_1758977, encodes 16S rRNA
agagtttgatcatggctcaggatgaacgctggcggcgtgcataacacattcaagtcgaacgagcgagtgcccttcgggacatgagctagtggcggacgggtgagtaacgcgtgagcaacctgcccctgtgtgcgggataacgtcgggaaactgacgctaataccgcataacacatgagccccgcatggggcatatgtcaaagatttattgcacagggatgggctcgcgtctgattagatagttggcagggtaacggcctaccaagtctgcgatcagtagccggactgagaggttgaacggccacattggaactgggatacggtccagactcctacgggaggcagcagtggggaatattgggcaatgggcgaaagcctgacccagcgacgccgcgtgaatgaagaagatcttcgggttgtaaagttcttttatatgggacaaaacaaatgacggtaccatatgaataagccacggctaactacgtgccagc

SEQ ID NO: 3325 - DNA, 490 bp, Unknown
  Ascusbbf_304737, encodes 16S rRNA
agagtttgatcctggctcaggacgaacgctggcggcgtgcctaacacatgcaagtcgaacgagaatcacggaccggaagcttcggtggaaggactgtgaggaaagtggcggacgggtgagtaacgcgtgagcaacctgcccttcggagggggacaacagttggaaacgactgctaataccgcatgacatacacgggaggcatctcttgtgtatcaaagatttatcgccgagggatgggctcgcgtctgattagatagttggtagggtaacggcctaccaagtcgacgatcagtagccggactgagaggttgaacggccacattgggactgagatacggcccagactcctacgggaggcagcagtggggaatattgggcaatgggggcaaccctgacccagcaacgccgcgtgaaggaagaaggctttcgggttgtaaacttctttgaccggggacgataatgacggtacccggaaaacaagccacggcta

SEQ ID NO: 3326 - DNA, 490 bp, Unknown
  Ascusbbf_736468, encodes 16S rRNA
agagtttgatcatggctcaggacgaacgctggcggcgtgcctaacacatgcaagtcgaacggagatcaggagcttgcttctgatcttagtggcggacgggtgagtaacgcgtgagtaacctgccttgcagagggggatagccattggaaacgatggataataccgcataacgtatgctggtcgcatggtcggcataccaaaggagcaatccgctgcaagatggactcgcgtccgattagatagttggtgaggtaacggcccaccaagtcgacgatcggtagccggactgagaggttgaacggccacattgggactgagacacggcccagactcctacgggaggcagcagtgagggatattgcacaatgggcgaaagcctgatgcagcaacgccgcgtgagggatgacggttttcggattgtaaacctctgtcttcggtgaagatcatgacattagccgaggaggaagccacggctaactacgtgccagca

SEQ ID NO: 3327 - DNA, 490 bp, Unknown
  Ascusbbf_1822539, encodes 16S rRNA
agagtttgatcatggctcaggataaacgctggcggcgtgcttaacacatgcaagtcgaacggagtagtcctcccgtgactgaagaagcttgcttccgaggaaacaattggactacttagtggcggacgggtgagtaacgcgtgggtaacctgcctcacactgggggatagcagttggaaacgactgataataccgcataagcgcacagcatcgcatgatgcagtgtgaaaaactccggtggtgtgagatggacccgcgtctgattagctagttggcgaggtaacggcccaccaaggcgacgatcagtagccggcctgagagggtgtacggccacattgggactgagacacggcccaaactcctacgggaggcagcagtggggaatattggacaatgggggaaaccctgatccagcgacgccgcgtgagcgatgaagtatttcggtatgtaaagctctatcagcagggaagataatgacggtacctgacta

SEQ ID NO: 3328 - DNA, 490 bp, Unknown
  Ascusbbf_742825, encodes 16S rRNA
agagtttatcctggctcaggatgaacgctggcggcgtgcttaacacatgcaagtcgaacggagatagcgagaagcttgcttctttctatcttagtggcggacgggtgagtaacgcgtgggcaacctaccctgtacagggggatagcagctggaaacggctgataaaaccgcataaaacggcagtaccgcatggtacaaccgtcaaatattcataggtacaggatgggcccgcgtctgattagccagttggtggggtaacggcctaccaaagcgacgatcagtagccggcctgagagggtgaacggccacattgggactgagacacggcccaaactcctacgggaggcagcagtggggaatattggacaatgggggaaaccctgatccagcgacgccgcgtgagtgaagaagtatctcggtatgtaaagctctatcagcagggaagatgatgacggtacctgactaagaagcaccggctaacttcgtgcca

SEQ ID NO: 3329 - DNA, 490 bp, Unknown
  Ascusbbf_335690, encodes 16S rRNA
agagtttgatcctggctcaggatgaacgctggcggcgtgcttaacacatgcaagtcgaacgagaaagcaacttcggttgtgagtagagtggcgaacgggtgagtaacacgtgagcaacctgcccttcacttcgggataactcagggaaacttgtgctaataccgaatactccgattagatcgcatggtcttttcgggaaagcttttacggtgaaggatgggctcgcggcccattaggtagttggtagggtaacggcctaccaagccgacgatgggtagccgggttgagagaccgaccggccacattgggactgagacacggcccagactcctacgggaggcagcagtggggaattttgcgcaatgggcgaaagcctgacgcagcaacgccgcgtgcgggatgaaggccttcgggttgtaaaccgctttcagtagggaagaaattgacggtacctacagaagaagctccggctaactacgtgccagcagcc

SEQ ID NO: 3330 - DNA, 490 bp, Unknown
  Ascusbbf_1692725, encodes 16S rRNA
agagtttgatcctggctcaggacgaacgctggcggcgcgcctaacacatgcaaatcgagcgatgaagacataaccgacgccttcgggaagaagttgagttggattagcggcggacgggtgagtaacacgtgagtaacctgcctttgacacggggatagccaccggaaacggtgattaatacccgatgaaatcgtaatgacacatgtcataacgatcaaagtgaattagcggtcaaagatggactcgcgtctgattaattagttggtgaggtaacggctcaccaagatagcgatcagtagccggcctgagagggtgaacggccacattggaactgagaaacggtccaaactcctacgggaggcagcagtggggaatattgcacaatgggggaaaccctgatgcagcgacgccgcgtgagcgaagaaggatttcgattcgtaaagctctgtcctatgggaagataatgacggtaccataggaggaagccccg

SEQ ID NO: 3331 - DNA, 490 bp, Unknown
  Ascusbbf_1357145, encodes 16S rRNA
agagtttgatcatggctcaggatgaacgctggcggcgtgcataacacattcaagtcgaacgatgaacggacttcggtccgggattagtggcggacgggtgagtaacgcgtgagcaacctgccccggagtgagggataacagacggaaacatctgctaatacctcatatagcatcgggttcgcatgtacctggtatgaaaggtttactgctccgggatgggctcgcgtctgattagatagttggtgaggtaacggcccaccaagtctgcgatcagtagccggactgagaggttgaacggccacattggaactgagatacggtccagactcctacgggaggcagcagtggggaatattgggcaatgggcgaaagcctgacccagcgacgccgcgtgaaggaagaaggtcttcggattgtaaacttctgttaactagggacgaaacaaatgacggtacctagagagaaagccacggctaactacgtgccagca

SEQ ID NO: 3332 - DNA, 490 bp, Unknown
  Ascusbbf_1296671, encodes 16S rRNA
agagtttgatcctggctcaggacgaacgctggcggcgtgcctaacacatgcaagtcgaacgaagctccgtgaagcaagacttcggtcaagcggaacggatgactgagtggcggacgggtgagtaacgcgtgaggaacctgcctttcagtgggggacaacagttggaaacgactgctaataccgcatgaagtacgttgggggcatccccgatgtaccaaagatttattgctgaaagatggcctcgcgtctgattagatagttggtgaggtaacggcccaccaagtcgacgatcagtagccggactgagaggttgaacggccacattgggactgagatacggcccagactcctacgggaggcagcagtggggaatattgggcaatgggggaaaccctgacccagcaacgccgcgtgaaggaagaaggctttcgggttgtaaacttcttttaccagggacgaaggacgtgacggtacctggagaaaaagccac

SEQ ID NO: 3333 - DNA, 490 bp, Unknown
  Ascusbbf_1501531, encodes 16S rRNA
agagtttgatcatggctcaggacgaacgctggcggcgtgcctaacacatgcaagtcgaacgagaatttagtaattgatttcttcggaatgattttactaaaggaaagtggcggacgggcgagtaacgcgtgagtaacctgcccataagagggggataatccttggaaacggggactaataccgcatattgtagctttaccgcatggtttagttatgaaagatttatcgcttatggatggactcgcgtaagattagatagttggtgaggtaacggctcaccaagtcgacgatctttagccgaactgagaggttgatcggccgcattgggactgagacacggcccagactcctacgggaggcagcagtggggaatattgcgcaatgggggcaaccctgacgcagcaacgccgcgtgcaggaagacggtcttcggattgtaaactgttgtcgcaagggaagaagaaaatgacggtaccttgtgagaaagtcac

SEQ ID NO: 3334 - DNA, 490 bp, Unknown
  Ascusbbf_530869, encodes 16S rRNA
agagtttgatcctggctcagaacgaacgctggcggcgcgtcttaagcatgcaagtcgagcgggattgggggcttgcccccatgagagcggcggactggcgaggagcgcgtgggcgacgcgccccccggactggaacagcccgtggaaacacggggtaatgccggatggcatgcctttcttggagggagggcatcaaaggggcttcggccccgccgggggagcggcccgcgtcccatcagcttgttggcggggaaaaggcccaccaaggctacgacgggtgtccggcctgagagggcgatcggacgcattgggactgagatacggcccagactcctacgggaggcagcagctaagaatattccgcaatgggcgaaagcctgacggagcgacgccgcgtgcacgatggaggccggaaggttgtaaagtgcttttgggagggaagaagaagcccgggaggaaacgcccgggcggcgacggtacctcgcgaata

SEQ ID NO: 3335 - DNA, 490 bp, Unknown
  Ascusbbf_444483, encodes 16S rRNA
agagtttgatcctggctcagaacgaacgctggcggcgtgcttaacacatgcaagtcgcacgagaaacggggcttcggcccccgagtaaagtggcgaatgggtgagtaacacgtgagtaacatgccctggagcgggggataaccattcgaaagggtggctaataccgcataagaccccaccgagttcgctcggagtggtcaaagccttttggcacttcaggattggctcgcggaccattagctagttggtggggtaatggcccaccaaggcagtgatggatagctggtctgagaggacgatcagccacactgggactgggacacggcccagactcctgcgggaggcagcagtggggaatcttgcgcaatgggcgaaagcctgacgcagcaacgccgcgtgtgtgaagaaggccctcgggtcgtaaagcactgtcagaggggaagaacgcctacattgttaggtttgacggtaccctcaaaggaagcaccgg

SEQ ID NO: 3336 - DNA, 490 bp, Unknown
  Ascusbbf_203442, encodes 16S rRNA
agagtttgatcatggctcaggatgaacgctagcggcaggcctaatacatgcaagtcgaacggtaaaatcactttcgggtgattgagagtggcgcacgggtgcgtaacgcgtatgcaacccacccgctgccgggggatagcccggagaaatccgaattaataccccatgaggagaggatgcggcatcgcaaccttttcaaaactttggtggcggcggacgggcatgcgtgccattagatagttggcggggtgacggcccaccaagtcgacgatggctaggggatctgagaggacggtcccccacactggtactgagacacggaccagactcctacgggaggcagcagtaagggatattggtcaatggggggaaccctgaaccagccatgccgcgtgagggaataaggccctacgggtcgtaaacctcttttgccgggggataaggatacctacgcgtaggtatttgaaggtacccggagaataagcatcgg

SEQ ID NO: 3337 - DNA, 490 bp, Unknown
  Ascusbbf_1851777, encodes 16S rRNA
agagtttgatcctggctcagaacgaacgctggcggcgcgtcttaagcatgcaagtcgagcgggattacctagcttgctaggtgtgagagcggcggactggtgagtaacgcgtgggtgacgtacccttctgacggggatagccggtagaaataccgggtaataccggatacgttctcctgccttggaagcaggagaagaaaggagccacggctccgcaggaggaacggcccgcgtcccatcagctggttggcggggaaaaggcccaccaaggcgatgacgggtatccggcctcagagggtgaccggacacattgggactgagatacggcccagactcctacgggaggcagcagctaagaatattccgcaatggggggaaccctgacggagcgacgccgcgtggacgatgaaggccggaaggttgtaaagtcttttttttgtgcgaggaataagtacggaagggaatgtccgtgcggtgactgtagcacagg

SEQ ID NO: 3338 - DNA, 490 bp, Unknown
  Ascusbbf_728253, encodes 16S rRNA
agagtttgatcctggctcaggacgaacgctggcggcgtgcctaacacatgcaagtcgaacgaagcttgattgatgaactcttcggagtgattcaagatatgactgagtggcggacgggtgagtaacgcgtgagcaacctgcccatcggagggggatagtgtctggaaacggacagtaataccgcataaagtacggagatggcatcatcatcgtaccaaagatttatcgccgatggatgggctcgcgtctgattagatagttggtggggtaacggcctaccaagtcgacgatcagtagccggactgagaggttgaacggccacattgggactgagacacggcccagactcctacgggaggcagcagtggggaatattgcacaatgggcgcaagcctgatgcagcaacgccgcgtggaggaagacggttttcggattgtaaactcctgttcttagggaagaagacagtgacggtacctaaggagcaagccac

SEQ ID NO: 3339 - DNA, 490 bp, Unknown
  Ascusbbf_982905, encodes 16S rRNA
agagtttgatcatggctcaggatcaacgctggcggcgtgcctaatgcatgcaagtcgaacggggtcgccttcgggcggctcacgtggcggacgggtgaggaacacgtgggcgatctgccccgaggcgggggatagccaccagaaatggtgggtaagaccgcatgagctcattggcttacgggccagtgaggaaaacgcagcaatgcgtaccttgggaggagcctgcggcggattagctagttggtggggtaacggcctaccaaggcgatgatccgtagctggtctgagaggatggccagcaacaggggaactgagacacggtccccactcctacgggaggcagcagcaaggaattttccgcaatgggcgaaagcctgacggagcaacgccgcgtgggggatgacgcttttcggagtgtaaaccccttttcccagggaagaacacaatgacggtacctggggaataaggaccggctaactacgtgccagca

SEQ ID NO: 3340 - DNA, 490 bp, Unknown
  Ascusbbf_1807592, encodes 16S rRNA
agagtttgatcctggctcaggatgaacgctggcggcgtgcctaacacatgcaagtcgaacgggtctatcgtcttggaggcttcggccaaagaggctttagattagtggcggacgggtgagtaacgcgtggagaacctgccctgtactgggggataacagtgagaaatcactgctaataccgcataagcgcacgaggccgcatggccctgtgtgaaaaactccggtggtacaggatggctccgcgttggattagccagttggcggggtaacggcccaccaaagcgacgatccatagccggcctgagagggtgaacggccacattgggactgagacacggcccagactcctacgggaggcagcagtggggaatattgcacaatggggggaaccctgatgcagcgacgccgcgtgaaggatgaagtatctcggtatgtaaacttctatcagcagggaagatgatgacggtacctgtctaagaagccccggcta

SEQ ID NO: 3341 - DNA, 490 bp, Unknown
  Ascusbbf_711190, encodes 16S rRNA
agagtttgatcatggctcaggatgaacgctggcggcgtgcttaatacatgcaagtcgaacggagcttgccggacaaagcccttcggggcagcgtctggcatgtcttagtggcggacgggtgagtaacgcgtggataacctgcctcatgcagggggacaacagctggaaacggctgctaataccgcataagcgcacagcaccgcatggtgcagggcgaaaagatttatcggcatgagatggatccgcgtccgattagccagttggcggggtaacggcccaccaaagctacgatcggtagccggcttgagagagtgaccggccacattgggactgagacacggcccagactcctacgggaggcagcagtagggaatattgcacaatgggggaaaccctgatgcagcgacgccgcgtgggtgatgaagtatttcggtatgtaaagccctatcagcggggaagatagtgacggtacccgcacaagaagccccgg

SEQ ID NO: 3342 - DNA, 490 bp, Unknown
  Ascusbbf_288710, encodes 16S rRNA
agagtttgatcatggctcaggattaacgctggcggcgtgcataacacattcaagtcgaacggagaaggggcttcggccccggatcagtggcggacgggtgagtaacgcgtgagtaacctgcctgtgtgaggggaataacagatcgaaaggcctgctaataccgcatgacgtacgactgtcgcatggcagaggtaccaaagatttatcgcacacagatggactcgcgttggattagacagttggcggggtaacggcccaccaaatcaacgatccatagccggactgagaggttgaacggccacattggaactgagaaacggtccagactcctacgggaggcagcagtggggaatattgggcaatgggcgaaagcctggcccagcgacgccgcgtgagggaagaaggtcttcggattgtaaacctctttcagcagggaagaagacagtgacggtacctgcagaagaagccacggctaactacgtgccagcag

SEQ ID NO: 3343 - DNA, 490 bp, Unknown
  Ascusbbf_408908, encodes 16S rRNA
agagtttgatcatggctcaggacgaacgctggcggcgtgcttaacacatgcaagtcgagcggaaaggccctttcgggggtactcgagcggcgaacgggtgagtaacacgtgagtaacctgccttcagcttcgggataaccccgggaaaccggggctaataccgggtattcacattgtttcgcatgggatggtgtggaaagggtttaccggctggggatggactcgcggcctatcagcttgttggtggggtagtggcctaccaaggcgacgacgggtagccggcctgagagggcgaccggccacactgggactgagacacggcccagactcctacgggaggcagcagtgggaatattgcgcaatgggcggaagcctgacgcagcgacgccgcgtgggggatgacggccttcgggttgtaaacctctttcagcagggacgaagcggaagtgacggtacctgcagaagaagctccggctaactacgtgccagc

SEQ ID NO: 3344 - DNA, 490 bp, Unknown
  Ascusbbf_709767, encodes 16S rRNA
agagtttgatcatggctcagaacgaacgctggcggtgcgttttaagcatgcaagtcgagcggcagtagtagcaatactatgagagcggcggacgggtgagtaacacgtggataatctaccttgaagtttgggatataccgtggaaacacggagtaataccggatacgacggttactggagacagtgattgggaaaggtgctacggcaccgctttgagatgagtccgcggcccattagttagacggcggggtaaaggcccaccgtgacgatgatgggtagccggcctgagagggtgtacggccacattgggactgagacacggcccagactcctacgggaggcagcagctaagaatcttccgcaatggacgaaagtctgacggagcgacaccgcgtgaacgatgaaggccgaaaggttgtaaagttcttttcagttggaggaataagcttttgagggaatgcgagagtgatgacgttaaaactggaataag

SEQ ID NO: 3345 - DNA, 490 bp, Unknown
  Ascusbbf_446062, encodes 16S rRNA
agagtttgatcctggctcaggacgaacgctggcggcgtgcctaacacatgcaagtcgaacggaatccatggtgtgcttgcacaccggaagatttagtggcgaacgggtgagtaacacgtgagaaacctgccccaaactctgggataactcaaggaaacttgtgctaataccggataccctcatttcatcgcatggtggtttgaggaaagtttttcggtttgggagggtctcgcggcctatcagcttgttggtggggtaatggcctaccaaggcgacgacgggtagctggtttgagagaacgatcagccacactggaactgagacacggtccagactcctacgggaggcagcagtggggaatcttgcgcaatgggcgaaagcctgacgcagcaacgccgcgtgcgggatgaaggccttcgggttgtaaaccgctttcagcagggacgaagatgacggtacctgcagaagaagctccggctaactacgtgcc

SEQ ID NO: 3346 - DNA, 490 bp, Unknown
  Ascusbbf_1833768, encodes 16S rRNA
agagtttgatcctggctcaggatgaacgctggcggcgtgcttaacacatgcaagtcgaacgaagcatttacgacggactggagagcttgctcaaaggaaagatgtgaatgactgagtggcggacgggtgagtaacgcgtgggtaacctgcctcacacagggggataacagttagaaatgactgctaataccgcataataggaactgccgcatgacagtttcttgaaaactccggtggtgtgagatgggcccgcgtttgattagctagttggtgaggtaacggcccaccaaggcgacgatcaatagccggcttgagagagtgaacggccacatcgggactgagtcacggcccaaactcctacgggaggcagcagtggggaatattgcacaatgggggaaaccctgatgcagcgacgccgcgtgagtgaagaagtatttcggtatgtaaagctctatcagcagggaagataatgacggtacctgactaagaa

SEQ ID NO: 3347 - DNA, 490 bp, Unknown
  Ascusbbf_1828480, encodes 16S rRNA
agagtttgatcatggctcaggacgaacgctggcggcgtgcttaacacatgcaagtggagcgacgaaccggggcttgccccggggcagagccgcgaacgggtgagtaacacgtgggtcacctgcctcgatgaccgggacaacccgaggaaactcgggctaataccggatgtgctcttcggaggaaaggtagcttcggcttccgcatcgagatgggcccgcggcgcattagcttgttggtggggtaacggcctaccaaggcgacgatgcgtagctggtctgagaggacgatcagccacactgggactgagacacggcccagactcctacgggaggcagcagtggggaatcttgcgcaatgcgcgaaagcgtgacgcagcaacgccgcgtgggggaagaaggccttcgggttgtaaacctctttcagttgggacgaagcttccagggtgaatagccctgcggagtgacggtaccttcacaagaagccccggct

SEQ ID NO: 3348 - DNA, 490 bp, Unknown
  Ascusbbf_332691, encodes 16S rRNA
agagtttgatcctggctcagaacgaacgctggcggcgcgttttaagcatgcaagtcgaacggtaacaggccttcgggcgctgacgagtggcgaacgggtgagtaacacgtaggtgatctgcccataggttggggatatactgtggaaacacagggtaataccgaatacgttcttgttgttttgacgacaagaagaaaggggcttcggcctcgcctgtggatgagcctgcggctgattagctagttggtggggtaagagcctaccaaggcgacgatcagtagccggcctgagagggtgatcggccacactgggactgagatacggcccagactcctacgggaggcagcagctaagaatcttccgcaatggacgcaagtctgacggagcgacgccgcgtgggtgaagaaggcggaaacgttgtaaagcccttttatagatgaggaataagtgtgggaggaaatgcctgcatgatgacgttagtctatgaata

SEQ ID NO: 3349 - DNA, 490 bp, Unknown
  Ascusbbf_427567, encodes 16S rRNA
agagtttgatcctggctcaggataaacgctggcggcgtgcttaacacatgcaggtcgaacgaggcattgaagacaaatcttcggaagcgtttttgatgccgagtggcggacgggtgagtaacgcgtgggtaacctgcccggaagagggggacaacagttggaaacgactgctaataccgcataagccgacggggccgcatggccctgccggaaaaggagtgatccgcttccggatggacccgcgtctgattagccggttggcggggtaacggcccaccaaagcgatgatcagtagccggactgagaggttgaacggccacattgggactgagacacggcccaaactcctacgggaggcagcagtggggaatattgcacaatggaggaaactctgatgcagcgacgccgcgtgagtgaagaagtgtttcggcatgtaaagctctatcagcagggaagaaaatgacggtacctgactaagaagccccggcta

SEQ ID NO: 3350 - DNA, 490 bp, Unknown
  Ascusbbf_1897530, encodes 16S rRNA
agagtttgatcatggctcaggatgaacgctagcggcaggcctaacacatgcaagtcgaacggtaacagcacttcggtggctgacgagtggcgcacgggtgcgtaacgcgtatgcaacctacctcttacagtgggatagcccagggaaacttggattaataccgcatagtatacctggccagcattggcctggtattaaacattcatgggtaagagatgggcatgcgtcctattagttagttggagtggtaacggcaccccaagacggcgataggtaggggccctgagagggggatcccccacactggtactgagacacggaccagactcctacgggaggcagcagtgaggaatattggacaatgggcgggagcctgatccagccatgccgcgtgcaggaagacggccctatgggttgtaaactgcctttgtacgggaagaaacaccccctcgtgagggggcctgacggtaccgtaagaataaggatcggc

SEQ ID NO: 3351 - DNA, 490 bp, Unknown
  Ascusbbf_1838019, encodes 16S rRNA
agagtttgatcatggctcagattgaacgctggcggcaggcctaacacatgcaagtcgagcgcgaaagccttcgggtgagtagagcggcggacgggtgagtaacgcgtgggaatctacctggtagagggggacaactcggggaaacccgagctaataccgcatacgccctacgggggaaaggaggggatcttcggacctttcactatcagaagagcccgcgtcggattagctagttggtggggtaaaggcctaccaaggcaacgatccgtagctggtctgagaggatgatcagccacactggaactgagacacggtccagactcctacgggaggcagcagtggggaatattgcacaatgggggaaaccctgatgcagccatgccgcgtgtgtgaagaaggctttcgggttgtaaagcactttcagtagggaggaagggttgctggctaatatccagcagcattgacgttacctacagaagaagcaccggct

SEQ ID NO: 3352 - DNA, 490 bp, Unknown
  Ascusbbf_1625592, encodes 16S rRNA
agagtttgatcctggctcaggatgaacgctggcggcgtgcttaacacatgcaagtcgagcggaaaggcccttcggggtactcgagcggcgaacgggtgagtaacacgtgagcaacctgcccccgactctgggataagcccgggaaactgggtctaataccggatacgacacctccaggcatctggtgggtgtggaaagtcttttcggttggggatgggctcgcggcctatcagcttgttggtggggtagtggcccaccaaggcgacgacgggtagccggcctgagagggcgaccggccacactgggactgagacacggcccagactcctacgggaggcagcagtgggaatattgcacaatgggggaaaccctgatgcagcgacgccgcgtgcgggatgacggccttcgggttgtaaaccgctttcagcagggacgaatcaagacggtacctgcagaagaagcgccggctaactacgtgccagcagccgcg

SEQ ID NO: 3353 - DNA, 490 bp, Unknown
  Ascusbbf_1244376, encodes 16S rRNA
agagtttgatcctggctcaggacgaacgctggcggcgtgcctaacacatgcaagtcgaacgaagcttgatttcagatttcttcggaatgacgaatgatatgacttagtggcggacgggtgagtaacgcgtgagcaacctgcctttcagagggggataacgtttggaaacgaacgctaataccgcataacgtatgactgtggcatcgcagtgataccaaaggagcaatccgctggaagatgggctcgcgtccgattagatagttggcggggtaacggcccaccaagtcgacgatcggtagccggactgagaggttgaacggccacattgggactgagacacggcccagactcctacgggaggcagcagtgggggatattgcacaatggggggaaccctgatgcagcaacgccgcgtgaaggaagaaggtcttcggattgtaaacttttgtctttggtgacgaagaagtgacggtagccaaggaggaagcca

SEQ ID NO: 3354 - DNA, 490 bp, Unknown
  Ascusbbf_1413581, encodes 16S rRNA
agagtttgatcctggctcaggacgaacgctggcggcgtgcttaacacatgcaagtcgaacgatgaagcggtgcttgcaccgtggattagtggcgaacgggtgagtaacacgtgagtgacctgtccttgactctgggataagcctgggaaactgggtctaatactggatattgactggcgatcgcatggttgttggttgaaagatttttcggtcaaggttggactcgcggcctatcagcttgttggtggggtagtggcctaccaaggcagtgacgggtagccggcctgagagggtgaccggccacactgggactgagacacggcccagactcctacgggaggcagcagtggggaatattgcacaatgggcgcaagcctgatgcagcgacgccgcgtgggggatgacggccttcgggttgtaaactcctttcgccattgacgaagcccttcggggtgacggtaggtggagaagaagcaccggctgactacgt

SEQ ID NO: 3355 - DNA, 490 bp, Unknown
  Ascusbbf_326265, encodes 16S rRNA
agagtttgatcatggctcagattgaacgctggcggcaggcctaacacatgcaagtcgagcggaaacaggggagcttgctcccgctgtcgagcggcggacgggtgagtaacgcgcaggaatctacctggtagtgggggatagctcggggaaactcgaattaataccgcatacgtcccaagggagaaagtgggggatcttcggacctcacgctatcagaagagcctgcgtaggattagctagttggtagggtaaaggcctaccaaggcgacgatccttaactggtctgagaggatgatcagtcacaccggaactgagacacggtccggactcctacgggaggcagcagtggggaatattggacaatgggggcaaccctgatccagccatgccgcgtgtgtgaagaaggccttcgggttgtaaagcactttaagttgggaggaaggccttgaagctaataactttgaggattgacgttaccaacagaataagc

SEQ ID NO: 3356 - DNA, 490 bp, Unknown
  Ascusbbf_1575052, encodes 16S rRNA
agagtttgatcatggctcaggatgaatgctggcggcgtgcctaatacatgcaagtcgagcggtaacagggcttcaccgtgttcttgacactccgggctgattagcgggaggatcgattcgagagcacagtgaagctgctgacgagcggcggacggctgagtaacgcgtgggaacgtaccctaaagtaagggataactagtcgaaagattagctaataccgtatgtgatcttcggattaaagaatttattcgctttaggaacggcctgcgtacgattagatagttggtgaggtaatggctcaccaagtcaacgatcgttagatggtttgagaggatgatcatccagactgggactgagacacggcccagactcctacgggaggcagcagtagggaatctttcacaatgggcgaaagcctgatggagcaacgccgcgtgcaggatgaaggccttcgggttgtaaactgcttttatatccgagaaatatgatg

SEQ ID NO: 3357 - DNA, 490 bp, Unknown
  Ascusbbf_1861741, encodes 16S rRNA
agagtttgatcctggctcaggacgaacgctggcggcgtgcttaacacatgcaagtcgaacgagggtgtttcgagagcttgctcttgggacagccgagtggcggacgggtgagtaacgcgtgagcaacctgtctcacacagggggataacgcatcgaaagatgtgctaataccgcataagaccacgggggggcatccttctgaggtcaaaggagcaatccggtgtgaggtgggctcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgcaagcctgacccagcaacgccgcgtgagggaagaaggttttcggattgtaaacctctgtcctatatgaagagaaagagacggtagtataggaggaagccccggctaacta

SEQ ID NO: 3358 - DNA, 470 bp, Unknown
  Ascusbbf_708117, encodes 16S rRNA
agagtttgatcatggctcagaacgaacgctggcggcaggcttaacacatgcaagtcgaacgcatccttcggggtgagtggcagacgggtgagtaacgcgtgggaacatgcccttcagtttggaataacccagggaaacttgggctaataccggatacgcccttagggggaaagatttatcgctgaaggagtggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgtccgggacgataatgacggtaccggaagaagaagccccggctaacttcgtgccagcagccgcggtaat

SEQ ID NO: 3359 - DNA, 490 bp, Unknown
  Ascusbbf_224555, encodes 16S rRNA
agagtttgatcctggctcaggatgaacgctggcggcgtgcctaacacatgcaagtcgaacgggattcacatttcgatgtgatgagagtggcgcacgggtgagtaacacgtagcttatctgccctggagagtgggataacgcaccgaaaggtgtgctaataccgcataagctcacgtcctgtagagggaagtgagaaaagatttatcgctctgggatgaggctgcggcccatcagctagttggtgaggtaatggcttaccaaggcaacgacgggtagggggcctgagagggtggccccccacactgggactgagacacggcccagactcctacgggaggcagcagtgaggaatattgcacaatgggggcaaccctgatgcagcgacgccgcgtgggtgaagaagggtttcggctcgtaaagcccttttctgtgtgacgagagaggacggtagcacaggaataagcgtcggctaactacgtgccagcagccg

SEQ ID NO: 3360 - DNA, 490 bp, Unknown
  Ascusbbf_1844915, encodes 16S rRNA
agagtttgatcctggctcagagtgaacgctggcggcgtggttaagacatgcaagtcgaacgtgatttttataaatggatccttcgggtgaagcttataaaatgaaagtggcaaacgggtgcgtaacacgtgagcaatctgccctaaagatcggaatagctcggggaaactcgaattaatgccgaatgtggcacgggaattcatgttcctagtgctaaagcttgtaacggcgctttaggaggagctcgcggcctatcagcttgttggtgaggtaaaggctcaccaaggctaagacgggtagctggtctgagaggatgatcagccacactggaactgagacacggtccagacacctacgggtggcagcagtttcgaatcattcacaatgggggcaaccctgatggtgcaacgccgcgtgagggatgaaggccttcgggtcgtaaacctctgtcaccaaggagcaacaagccggttcatagccggccctgagt

SEQ ID NO: 3361 - DNA, 490 bp, Unknown
  Ascusbbf_1714024, encodes 16S rRNA
agagtttgatcatggctcaggacgaacgctggcggcgtgcctaacacatgcaagtcgagcggggataagaggaacggatgcttcggcggaagggaaacttattccagcggcggacgggtgagtaacgcgtgagcaatctgtccctgacagggggataacacatggaaacaggtgctaataccgcataagaccacggtatcgcatggtacaggggtcaaaggagagatccggtgaggggtgagctcgcgtctgattagatagttggtgaggtaacggcccaccaagtcaacgatcagtagccgacctgagagggtgaacggccacattggaactgagagacggtccaaactcctacgggaggcagcagtggggaatattgggcaatgggcggaagcctgacccagcaacgccgcgtgagggaagaaggttttcggattgtaaacctctgttgtggatgacggaggaagtgacggtaatccacaaggaagcc

SEQ ID NO: 3362 - DNA, 490 bp, Unknown
  Ascusbbf_645959, encodes 16S rRNA
agagtttgatcatggctcaggacgaacgctggcggcgtgcctaacacatgcaagtcgagcggggacataaggaacggaggcttcggcggaagggaaatatgtttcagcggcggacgggtgagtaacgcgtgaacgatctgtccctgacagggggataacacatggaaacaggtgctaataccgcataagaccacggatctgcatggatcaggggtcaaaggaggaatccggtgaggggtgagttcgcgtctgattagatagttggtgaggtaacggcccaccaagtcaacgatcagtagccgacctgagagggtgatcggccacattggaactgagacacggtccaaactcctacgggaggcagcagtgggaatattgggcaatgggcgaaagcctgacccagcaacgccgcgtgagggaagaaggttttcggattgtaaacctctgtccttggtgacgaaggaagtgacggtagccaaggaggaagccc

SEQ ID NO: 3363 - DNA, 490 bp, Unknown
  Ascusbbf_1085236, encodes 16S rRNA
agagtttgatcctggctcaggatgaacgctggcggcgtgcgtaacacatgcaagttgggcgacgacggggctgaagtggagacatggaagttctgagcggagcagcggacgggtgagtaagacatgaggagctgtcctttggagggggacaacgtctggaaacggacgctaataccccataggccgagaggttaaagccgagaggtgccaaggggggtgctcgtggcctatcagctagttggtgaggtaacggctcaccaaggcgacgacgggtagccggcctgagagggcgaccggccacactgggactgagatacggcccagactcctacgggaggcagcagtggggaatagtgggcaatgggagagatcctgacccagcgacgccgcgtggacgaagaaggccttcgggtcgtaaagtccttttatgggggaagaaggaagtgacggtaccccatgaataagccccggctaactacgtgccagcagc

SEQ ID NO: 3364 - DNA, 490 bp, Unknown
  Ascusbbf_1109366, encodes 16S rRNA
agagtttgatcatggctcaggatgaacgctagcggcaggcctaacacatgcaagtcgaggggtagaaagagcttgctcttttgagaccggcgcacgggtgagtaacgcgtatggaacctgccctctacaggggaatagcccagggaaacttggattaatgccccatagcgctgattggcggcattgccattcagctaaagatttatcggtagaggatggccatgcgtcccattagccagttggtgcggtaacggcgcaccaaggctacgatgggtaggggccctgagagggggatcccccacactggtactgagacacggaccagactcctacgggaggcagcagtgaggaatattggacaatgggcgggagcctgatccagccatgccgcgtgcaggaagacagccctatgggtcgtaaactgcttttgtacgggaagaaacacccccacgtgtgggggcttgacggtaccgtacgaataaggaccggc

SEQ ID NO: 3365 - DNA, 490 bp, Unknown
  Ascusbbf_1005728, encodes 16S rRNA
agagtttgatcatggctcaggatgaacgctagcggcaggcctaatacatgcaagtcgaacgggatggtcgccttcgggcggcctgagagtggcgcacgggtgcgcaacgcgtatgcaaccaacccccgacaggcggatagccggtggaaacgccggataatacgccatggttccggtggagggcatcctctactggataaagctacggcggtcggggacgggcatgcgtcccattagatggtaggcggggtgacggcccacctagtccgcgatgggtaggggatctgagaggacggtcccccacactggtactgagacacggaccagactcctgcgggaggcagcagtaagggatattggtcaatgggggtaaccctgaaccagccatgccgcgtgagggaatgaggccctacgggtcgtgaacctcttttattcggggacaaggacggcgtcgtgaacgccgtttgagggtaccgaaggaataagcatc

SEQ ID NO: 3366 - DNA, 490 bp, Unknown
  Ascusbbf_509924, encodes 16S rRNA
agagtttgatcatggctcaggacgaacgctggcggcgtgcttaacacatgcaagtcgaacgaagatatatcatttgaagttttcggacggaaaaagatatagactgagtggcggacgggtgagtaacgcgtgagcaatctgcctttaagagggggacaacagttggaaacgactgctaataccgcataagaccacactgacgcatgtcagaggggtcaaaggaaagaaccgcttaaagatgagctcgcgtcccattagttagttggcggggtaaaggcccaccaagacgacgatgggtagccgacctgagagggtgatcggccacactggaactgagacacggtccagactcctacgggaggcagcagtggggaatattgggcaatgggcgcaagcctgacccagcaacgccgcgtgaaggaagaaggtcttcggattgtaaacatctgtcctatgggacgaaggaagtgacggtaccataggaggaagc

SEQ ID NO: 3367 - DNA, 490 bp, Unknown
  Ascusbbf_1577913, encodes 16S rRNA
agagtttgatcatggctcaggacgaacgctggcggcgtgcttaacacatgcaagtcgaacgctgaagctcccagcttgctgggggtggatgagtggcgaacgggtgagtaacacgtgagtaacctgcccatcactccgggataagcgctggaaacggtgtctaatactggatatgcacaatggccgcatggtctgttgtgggaaagatttatcggtggtggatggactcgcggcctatcagctagatggtgaggtaatggctcaccatggcgacgacgggtagccggcctgagagggtgaccggccacactgggactgagacacggcccagactcctacgggaggcagcagtggggaatagtgcacaatgggcgaaagcctgatgcagcaacgccgcgtgagggatgaatgccttcgggttgtaaacctcttttagtagggaagaagcgcaagtgacggtacctgcagaaaaagcaccggctaactacgt

SEQ ID NO: 3368 - DNA, 490 bp, Unknown
  Ascusbbf_1322126, encodes 16S rRNA
agagtttgatcctggctcaggatgaacgctagcggcaggcttaacacatgtaagtcgaggggtaacgcggggtagcaatactctggcgacgaccggcgcacgggtgcgtaacgcgtatgcaacctacctgtaacaggggtataacggagagaaatttccactaatcccccatattgttattctttcgcaagttaggataacgaaagcttcggtggttacggacgggcatgcgtgacgcttgctagttggtaaggtaacgccttaccaaggcgacgatgtctaggggggctgagaggcttatccgacacatgggtactgagacacggaccagacacctacgggaggcagcagtgaggaatattggtcaatggacggaagtctgaaccagccatgccgcgtggaggaagaaggtcctatgggttgtaaactccttttgtacgagagtaataagaggcttgcgagcctcgatgagagtatcggacgaataagc

SEQ ID NO: 3369 - DNA, 490 bp, Unknown
  Ascusbbf_1887142, encodes 16S rRNA
agagtttgatcatggctcaggacgaacgctggcggcgtgcctaacacatgcaagtcgagcggtgacaggaggaacggaggcttcggccgaggggagttctgttatagcggcggacgggtgagtaacgcgtgaacgatctgtccctgacagggggataacacatggaaacaggtgctaataccgcataagaccacagagctgcatggctcaggggtcaaaggagagatccggtgaggggtgagttcgcgtctgattagatagttggtgaggtaacggcccaccaagtcaacgatcagtagccgacctgagagggtgatcggccacattggaactgagagacggtccaaactcctacgggaggcagcagtggggaatattgggcaatgggcgaaagcctgacccagcaacgccgcgtgagggaagaaggttttcggattgtaaacctctgtcctaggtgacgaaggaagtgacggtagccaaggaggaagcc

SEQ ID NO: 3370 - DNA, 490 bp, Unknown
  Ascusbbf_1646735, encodes 16S rRNA
agagtttgatcatggctcagaataaacgctagcggcaggccttatacatgcaagtcgaggggtaacatgatatagcaatatattgatgacgaccggcgtacgagtgagtaatatatacataacttaccttatcttaagtaatagcctcaagaaattgggattaataacttatatgttgtaagttgaaatgcttacaatgaaagatttttcgagataaaataggtgtatattctattagttagttggtagggtaaaggcttaccaagacgaagatagatagtggctttaagagaaggttcaccacgttgacactgaaacacgggccaaacttctacggaaggcagcagtagggaatattggtcaatgggcgaaagcctgaaccagccatgtcgcgtgcaggattaatgtcttttagactgtaaactgcttttattttgtagcaataagaatttcatgaaattttatgatctacattaagaaaatgtaccgg

SEQ ID NO: 3371 - DNA, 490 bp, Unknown
  Ascusbbf_866474, encodes 16S rRNA
agagtttgatcatggctcagaatgaacgttggcggcatggattaggcatgcaagtcgcacgagaagctaagtagcttgctacgaagcggagagtggcgaaagggagagtaacgtgtggttacataccctcaggaccaggataacgtcgggaaactgacggtaatactggatgatatctacggattaaatggtgagattccgcctggggattggactgcatactattagcttgttggtggggtaaaggctcaccaaggctgcgatggttaccgggtgtgagagcatggcccggctcactgggattgagacactgcccagacatctacggatggctgcagtcgagaatcttcggcaatggacgaaagtctgaccgagcgatgccgcgtgcgggatgaaggccctcgggttgtaaaccgctgtcagttgggaggaaatgctatggggcaatccctgtagcttgactaatcttcagaggaaggacgggctaagt

SEQ ID NO: 3372 - DNA, 490 bp, Unknown
  Ascusbbf_718081, encodes 16S rRNA
agagtttgatcatggctcaggacgaacgctggcggcgtgcttaacacatgcaagtcgagcggtaaggctccttcgggagtacacgagcggcgaacgggtgagtaacacgtgagcaatctgcccttctcttcggaataaccattggaaacgatggctaatgccgaatatgacctcggatcacatgttctgaggtggaaagctccggcggagaaggatgagctcgcggcctatcagcttgttggtgaggtaatggctcaccaaggcattgacgggtagccggcctgagagggtgaccggccacactgggactgagacacggcccagactcctacgggaggcagcagtggggaatattggacaatgggcgaaagcctgatccagcaacgccgcgtgagggatgacggccttcgggttgtaaacctctttcagcagggacgaagcgaaagtgacggtacctgcagaagaaggaccggccaactacgtgccagca

SEQ ID NO: 3373 - DNA, 490 bp, Unknown
  Ascusbbf_1825986, encodes 16S rRNA
agagtttgatcatggctcaggatgaacgctggcggcgtgtttaacacatgcaagtcgagcgagaagtccttcagttgattcttcggatgaaaacagaaggatggaaagcggcggacgggtgagtaacgcgtaggcaacctgccccctgcagagggatagcctcgggaaaccgggattaaaacctcataacgcgcaactgagacatctcagatgcgccaaagatttatcggcaggggatgggcctgcgtctgattagttagttggtggggtaacggcctaccaaggcgacgatcagtagccgacctgagagggtgatcggccacattggaactgagacacggtccaaactcctacgggaggcagcagtggagaatcttgcacaatgggcgcaagcctgatgcagcaacgccgcgtgaaggatgaaggcccttgggtcgtaaacttctgttctaagggaagatagtgacggtaccttaggagcaagtcccgg

SEQ ID NO: 3374 - DNA, 490 bp, Unknown
  Ascusbbf_1783926, encodes 16S rRNA
agagtttgatcctggctcaggatgaacgctggcggcgtgcttaacacatgcaagtcgaacgaacggagaagagcttgctcttcgaagttagtggcggacgggtgagtaacgcgtgggtaacctgcctcatgcagggggataacgtttggaaacgaacgctaataccgcataaactatggattgccgcatggcaattatagcaaagattttatcggcatgagatggacccgcgttggattagctagttggtgagataacagcccaccaaggcgacgatccatagccggcctgagagggtgaacggccacattgggactgagacacggcccaaactcctacgggaggcagcagtggggaatattgcacaatgggcgcaagcctgatgcagcgacgccgcgtgaaggatgaaggtcttcggattgtaaacttctatcagcagggaagaataaatgacggtacctgactaagaagctccggctaactacgtgcc

SEQ ID NO: 3375 - DNA, 490 bp, Unknown
  Ascusbbf_467719, encodes 16S rRNA
agagtttgatcatggctcaggacgaacgctggcggcgtgcttaacacatgcaagtcgaacgatgaactccagcttgctggggggattagtggcgaacgggtgagtaacacgtgagtaacctgccctgaactttgggataacttcgagaaatcggagctaatactggataggacttcgcatcgcatggtgtggggtggaaagtttttcggtttgggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgggggatgacggccttcgggttgtaaacctcttttgtccaggaagaagccggcttgccggtgacggtactgggagaaaaagcaccggctaactacgt

SEQ ID NO: 3376 - DNA, 490 bp, Unknown
  Ascusbbf_1579994, encodes 16S rRNA
agagtttgatcctggctcaggatgaacgctagcggcaggcctaatacatgcaagtcgaacggtaaatgtcccttcggggacatgagagtggcgcacgggtgcgtaacgcgtatgcaacccacccgctgccgggggatagcccggagaaatccgaattaataccccatgaggagtgagggaggcatcttcttcatttcaaaactacggtggcggcggacgggcatgcgtgccattagatagttggcggggtgacggcccaccaagtcgacgatggctaggggatctgagaggacggtcccccacactggtactgagacacggaccagactcctacgggaggcagcagtaagggatattggtcaatggggggaaccctgaaccagccatgccgcgtgagggattaaggccctacgggtcgtaaacctcttttgccgggggataaggacagtcacgtgtggctgtttgaaggtacccggagaataagcatcgg

SEQ ID NO: 3377 - DNA, 490 bp, Unknown
  Ascusbbf_1215130, encodes 16S rRNA
agagtttgatcctggctcaggatgaacgctagcggcaggcctaatacatgcaagtcggacgggagtcccccttcggggggacgagagtggcggacgggtgcgcaacgcgtatgcaacccaccccgacccggggcatagccggtggaaacgccgggtaatgcgccatgagccgcgcagggggcatcccccgcgtggcaaagcgagagcgggacgggacgggcatgcgtcccattagcttgttggcggggtgaaggcccaccaaggctacgatgggtaggggatctgagaggacggtcccccacactggtactgagacacggaccagactcctgcgggaggcagcagtaagggatattggtcaatggccggaaggctgaaccagccatgccgcgtgagggaatgaggccctacgggtcgtgaacctcttttattcggggacaacgtcggcgtcgcgaacgccgtgtgagggtaccgaaggaataagcgtcgg

SEQ ID NO: 3378 - DNA, 490 bp, Unknown
  Ascusbbf_1466709, encodes 16S rRNA
agagtttgatcctggctcaggacgaacgctggcggcgtgcttaacacatgcaagtcgaacggaaagctcttttcggagagactcgagtggcgaacgggtgagtaacacgtgggtgatctgccctgcactttgggataagcctgggaaactgggtctaataccgaataggaccacggcatgcatgtgctgttgtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacccctttcagtaccgacgaagcgtgagtgacggtaggtacagaagaagcaccggccaactacgtgccagca

SEQ ID NO: 3379 - DNA, 490 bp, Unknown
  Ascusbbf_1896164, encodes 16S rRNA
agagtttgatcatggctcaggacgaacgctggcggcgtgcctaatacatgcaagtcgagcggaccaaagaagagcttgctcttcggcggttagcggcggacgggtgagtaacacgtaggcaacctgcctgtacgactgggataactccgggaaaccggagctaataccggatacgtttttcagaccgcatggtctgaaagagaaagacctttggtcacgtacagatgggcctgcggcgcattagctagttggtggggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaaccgccgggatgacctcccggtctgacggtacctaacgagaa

SEQ ID NO: 3380 - DNA, 490 bp, Unknown
  Ascusbbf_767802, encodes 16S rRNA
agagtttgatcctggctcaggatgaacgctagctacaggcttaacacatgcaagtcgaggggcagcatatggtttgcttgcaaaccatgatggcgaccggcgcacgggtgagtaacgcgtatccaacctacccataactaagggataaccggtggaaatgccgcctaataccttatgtattccaaaagagtcctcttttttggaagaaagattaatcggttatggatggggatgcgtccgattaggcagttggcggggtaacggcccaccaagcccgcgatcggtaggggttctgagaggaaggtcccccacataggaactgagacacggtcctaactcctacgggaggcagcagtgaggaatattggtcagtggacgagagtctgaaccagccaagtagcgtgcaggaagacggccctatgggttgtaaactgcttttatacgggaataaatgtgatcacgtgtggttatttgcatgtaccgtatgaat

SEQ ID NO: 3381 - DNA, 490 bp, Unknown
  Ascusbbf_766441, encodes 16S rRNA
agagtttgatcctggctcaggacgaacgctggcggtgtgcttaacacatgcaagtggtgcgacgaaccaggcttcggcctggggcaaagccgcgaacgggtgagtaacacgtgggtaatctgccccgatgaccgggacaacccgaggaaactcgggctaataccggatgttgtgaacggacataagtctgttcattaaaggtagcttcggcttccgcattgggaggggcccgcggcccattagcttgttggtggggtcaaggcctaccaaggcaacgatgggtagctggtctgagaggacgatcagccacactgggactgagacacggcccagactcctacgggaggcagcagtggggaatcttgcgcaatgcgcgaaagcgtgacgcagcaacaccgcgtgagggaagacagccttagggttgtaaacctctttcagatgggacgaaggtcatccggtgaatagccgaggtggttgacagtaccgtcag

SEQ ID NO: 3382 - DNA, 490 bp, Unknown
  Ascusbbf_1799656, encodes 16S rRNA
agagtttgatcctggctcaggacgaacgctggcggcgtgcctaacacatgcaagtcgagcgggagacttcggtctccagcggcggacgggtgagtaacacgtgggtaacctgcctcatagagggggatagcctcccgaaagggagattaataccgcataacatcacagtactgcatggtacagtgattaaaggagtaatccgctatgagatggacccgcggcgcattagctagttggtgaggtaacggctcaccaaggccacgatgcgtagccgacctgagagggtgatcggccacattggaactgagacacggtccagactcctacgggaggcagcagtggggaatattgcacaatgggcgaaagcctgatgcagcaacgccgcgtggaggatgaaggccttcgggttgtaaactcttgtcttctgggacgataatgacggtaccagaggaggaagccacggctaactacgtgccagcagccgcggtaa

SEQ ID NO: 3383 - DNA, 490 bp, Unknown
  Ascusbbf_1193960, encodes 16S rRNA
agagtttgatcatggctcaggacgaacgctggcggcgtgcctaacacatgcaagtcgaacgaagttaagagaaagcttgcttcctcttaacttagtggcggacgggtgagtaacgcgtgagtaacctgcctttcagagggggataacgtctggaaacggacgataataccgcataacatttcggagctgcatggttctgaaatcaaaggagtaatccactggaagatggactcgcgtccgattagctagttggtgagataatagcccaccaaggcgacgatcggtagccgggttgagagactgaacggccacattgggactgagacacggcccagactcctacgggaggcagcagtgggggatattgcacaatggaggaaactctgatgcagcaacgccgcgtgagggaagacggttttcggattgtaaacctctgtcttcagggaagattatgacggtacctgaagaggaagctccggctaactacgtg

SEQ ID NO: 3384 - DNA, 490 bp, Unknown
  Ascusbbf_1780555, encodes 16S rRNA
agagtttgatcctggctcaggacgaacgctggcggcgtgcttaacacatgcaagtcgaacgaggatcaaggaagagcttgctctgagatgatccgagtggcggacgggtgagtaacgcgtgaacaatctgtctcacacaggggaataacgcatcgaaagatgtgctaataccgcataggaccacgggagggcatcctcttgaggtgaaaggagcaatccggtgtgaggtgagttcgcgtctgattagatagttggtggggtaacggctcaccaagtcaacgatcagtagccgacctgagagggtgatcggccacattgggactgagacacggcccagactcctacgggaggcagcagtggggaatattgggcaatgggcgaaagcctgacccagcaacgccgcgtgaaggaagaaggttttcggatcgtaaacttctgtccttgttgaagagcgaaagacggtaggcaaggaggaagccccggctaacta

SEQ ID NO: 3385 - DNA, 490 bp, Unknown
  Ascusbbf_1193755, encodes 16S rRNA
agagtttgatcctggctcagaacgaacgctggcagcgtggattaggcatgcaagtcgaacgggatcagctggttagcaataattggctgtgagagtggcggattggggaggaacacgtgagcaacctgcccttgggacggggaaaaccgttggaaacgacggctaataccggatgcggcgtcgcgggacatcccgcgaacgtcaaagggggccgcaaggctcccgcccgaggaggggctcgcgcaccatcagcttgttggcggggtaacggcccaccaaggcttacggttagctggtctgagaggatggccagccccactgggactgagatactgcccagactcctacgggaggctgcagtcgaggatcattcgcaatgggcgaaagcctgacgatgcgacgctgcgtggaggatgaaggccttcgggtcgtaaactcctgtcatgggggaaaaggcgaggggagctaacacctcccttagttgatggta

SEQ ID NO: 3386 - DNA, 489 bp, Unknown
  Ascusbbf_1064135, encodes 16S rRNA
agagtttgatcctggctcaggattaacgctggcggcgtgcctaatacatgcaagtcgaatggtagcaataccatggcgaacgggtgagtaacacgtaggtaacctatctaaaagacgaggataaccactggaaacggtggataatactggataggacatttgaaggcatctttggatgtttaaagatttatcactttaagaggggcctgcggcgcattagctagttggtagggtaatagcctaccaaggcgatgatgcgtagccggactgagaggttgaacggccacaatgggactgagaacggcccatactcctacgggaggcagcagtagggaattttcggcaatgggcggaagcctgaccgagcaacgccgcgtgaacgaagaagtatttcggtatgtaaagttcttttatttgggacgaaaaggtttgactgacggtaccaaatgaataagctccggctaactacgtgccggcagccgcggtaat

SEQ ID NO: 3387 - DNA, 490 bp, Unknown
  Ascusbbf_1578175, encodes 16S rRNA
agagtttgatcctggctcaggacgaacgctggcggcgtgcctaacacatgcaagtcgaacggacgagaggagcttgctcctcaagttagtggcgaacgggtgagtaacgcgtgagcaacctgcccttcagagggggacaacagctggaaacggctgctaataccgcatgacatttttccgaggcatctcggggatatcaaagatttatcgctgaaggatgggctcgcgtctgattagatagttggcggggcaacggcccaccaagtcgacgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttctttgacgagggacgaaggaaatgacggtacctcgaaaacaagccacggctaactacgtgccagc

SEQ ID NO: 3388 - DNA, 490 bp, Unknown
  Ascusbbf_729188, encodes 16S rRNA
agagtttgatcatggctcaggatgaacgctggcggcgtgcttaacacatgcaagtcgaacggagaaccctggaaagagttttcggacaatggaaaggaattcttagtggcggacgggtgagtaacgcgtgaggaacctgccttggagtggggaataacacagagaaatttgtgctaataccgcatgaagcagttgggtcgcatggctctgactgccaaagatttatcgctctgagatggcctcgcgtctgattagctggttggcggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggccctcgggttgtaaacttcttttcttcgggacgaaggaagtgacggtaccgaaggaataagccac

SEQ ID NO: 3389 - DNA, 490 bp, Unknown
  Ascusbbf_1495492, encodes 16S rRNA
agagtttgatcatggctcaggataaacgctggcggcgcacataagacatgcaagtcgaacggaggtcgttacaaaacggattgaagatttatctgagagaagttaagtaacaaaggccttagtggcggactggtgagtaacacgtaagcaacctacctataagaggggaataacactgagaaatcagtgctaataccgcataagctagaggtatcgcatgatacagctagaaaaggagcaatccactaatagatgggcttgcggctgattagctagttggtggggcaacggcctaccaaggcaacgatcagtagccggactgagaggttgaacggccacattgggactgagatacggcccagactcctacgggaggcagcagtcgggaatattgcgcaatggagggaactctgacgcagtgacgccgcgtataggaagaaggttttcggattgtaaactattgtcgttagggaagaaaaggacagtacct

SEQ ID NO: 3390 - DNA, 490 bp, Unknown
  Ascusbbf_1050926, encodes 16S rRNA
agagtttgatcatggctcaggatgaacgctggcggcgtgcctaacacatgcaagtcgagcgagaaatcacggaacagagattcgtcaacgggaagtggtggacagcggcggacgggtgagtaacgcgtaggtaacctaccttatactgaaggatagcctagggaaacctggattaatacttcataatgcattaatatcacatggtgtaaatgccaaagatttatcggtataagatggacctgcgtctgattagatagttggtgaggtaacggcccaccaagtcaacgatcagtagccgatctgagaggataatcggccacattggaactgagacacggtccaaactcctacgggaggcagcagtggggaatattgcacaatgggcgaaagcctgatgcagcaacgccgcgtgagcgatgaaggtcttcggattgtaaagctctgtcctctgggacgaagaaagtgacggtaccagaggaggaagccccgg

SEQ ID NO: 3391 - DNA, 490 bp, Unknown
  Ascusbbf_1806688, encodes 16S rRNA
agagtttgatcctggctcaggacgaacgctggcggcgtgcctaatacatgcaagtcgaacgggtgacctcttggtggcaacaccttgagtgatccagtggcgaacgggtgagtaacacgtgagaaacctaccccgaagaccgggataaccagaggaaactctggctaataccggatacccccttcggaccgcatggtctgatgaggaaatggattccgcttcgggagggtctcgcggcctatcagcttgttggtggggtaacggcctaccaaggcttcgacgggtagctggtctgagaggacgatcagccacactgggactgagacacggcccagactcctacgggaggcagcagtagggaatcttgcgcatgggcgaaagcctgacgcagcaacgccgcgtgcgggatgaaggccttcgggttgtaaaccgctttcagcagggacgaaaatgacggtacctgcagaagaagccccggccaactacgtgc

SEQ ID NO: 3392 - DNA, 490 bp, Unknown
  Ascusbbf_181676, encodes 16S rRNA
agagtttgatcctggctcagattgaacgctggcggcaggcctaatacatgcaagtcgaacggtaacataagaaaagcttgcttttcttgatgacgagtggcggacgggtgagtaacatttgggaaactacctgatagagggggacaacagttggaaacgactgctaataccgcatacagcctaagggtgaaagaagcaattcgctatcagatgtgcccaaacgggattagctagtaggcggggtaagagcccacctaggcgacgatctctagctggttttagcggatgatcagccacattggaactgagacacggtccaaactcctacgggaggcagcagtagggaatattgcacaatggagggaactctgatgcagccatgccgcgtgtgtgaagaaggccttcgggttgtaaagcactttagttttcgagaaagggtgcaattcgaatagggttgtattcagatgttagaaaaagaataagtaccggc

SEQ ID NO: 3393 - DNA, 490 bp, Unknown
  Ascusbbf_30642, encodes 16S rRNA
agagtttgatcatggctcaggatgaacgctagcggcaggcttaacacatgcaagtcgaggggcagcatgggagcgtggcaacacattcccgatggcgaccggcgcaagggtgcgtaacgcgtgagcaacttgcccgcatcaggggcataatcggtggaaacgccgtctaactccccataacatattttgcggcatcgcagaatattgaaatccttggaggatgcggatgggctcgcgtggcattaggcagttggcggggtaacggcccaccaaaccgacgatgcctaggggaactgagaggttagtcccccacactggaactgagacacggtccagactcctacgggaggcagcagtgaggaatattggacaatggagggaactctgatccagccatgccgcgtgcaggataaggtcctatggattgtaaactgcttttgtacgggagcaataaggcccacgcgtgggtcgatgagagtaccgtacgaat

SEQ ID NO: 3394 - DNA, 490 bp, Unknown
  Ascusbbf_17087, encodes 16S rRNA
agagtttgatcatggctcaggatgaacgctggcggcgtgcataacacattcaagtcgaacggacgaggccccttcggggaccaagtcagtggcggacgggtgagtaacgcgtgagcaacctgcctatgcgagggggataacagttggaaacgactgctaataccgcataacgcacggaggaggcatctcttccatgccaaagatatattgcgcatagatgggctcgcgtccgattagatagttggtgaggtaacggcccaccaagtcgacgatcggtagccggactgagaggttgaacggccacattggaactgagagacggtccagactcctacgggaggcagcagtggggaatattgggcaatgggcgaaagcctgacccagcgacgccgcgtgagtgaagaaggtcttcggattgtaaagcttagttatcggggaagaaggaagtgacggtacccgaagagaaagccacggctaactacgtgccagc

SEQ ID NO: 3395 - DNA, 490 bp, Unknown
  Ascusbbf_12806, encodes 16S rRNA
agagtttgatcatggctcaggataaacgctggcggcgcgcataacacatgcaagtcggacgagaaacttggcttcggtcaaggatctagtggcggacgggtgagtaacacgtggacaacttgtcttatagaggggaatagccggaagaaatttcgattaataccgcataatgtggcgatattgcatgatattgccaagaaagatgaaaatcgctatgagagaggtctgcgtctgattagctagttggagtggtaatggcacaccaaggcgacgatcagtagccggtttgagagaatgaacggccacattgggactgagatacggcccagactcctacgggaggcagcagtggggaatattgcgcaatgggggaaaccctgacgcagcgacgccgtgtaagggaagaaggttttcggatcgtaaacctatatcgattgtgaaaagcaaggatggtagcaaagtaagaagccccggctaactacgtgccagc

SEQ ID NO: 3396 - DNA, 490 bp, Unknown
  Ascusbbf_126697, encodes 16S rRNA
agagtttgatcatggctcaggatgaacgctggcggcaggcttaatacatgcaagtcgaacggtaaggccgagcgtagcaatacgcgaggtacacgagtggcgcacgggtgcgtaacgcgtatgcaacctgcccccttccgggacaaaacgtcgagaaattggcgctaatatcccatggcgaccttatgaggcatctcgttgggtccaaagattcattggaaggggatgggcatgcgtatcattagcttgttggcggggtaacggcccaccaaggcgacgatgattaggggttctgagaggaaagtcccccacactggaactgagacacggtccagactcctacgggaggcagcagtagggaatattgggcaatgggagcaatcctgacccagccatgccgcgtgaaggaatacggccctacgggtcttaaacttcttttgccgcggagtaaccgccgggacgcgtcccggcctgagagtacgcggcgaat

SEQ ID NO: 3397 - DNA, 490 bp, Unknown
  Ascusbbf_1818538, encodes 16S rRNA
agagtttgatcctggctcaggatgaacgctagcggcaggcttaacacatgcaagtcgaggggcagcataagagcgtagcaatacattcttgatggcgaccggcgcaagggtgcgtaacgcgtgagcaacttgcccgcatcaggggcataatcggtggaaacgccgtctaactccccataacatagagagtggcatcactttttattgaaatccttggaggatgcggatgggctcgcgtgacattaggcagttggcggggtaacggcccaccaaaccaacgatgtctaggggaactgagaggttaatcccccacactggaactgagacacggtccagactcctacgggaggcagcagtgaggaatattggacaatggagggaactctgatccagccatgccgcgtgcaggataaggtcctatggattgtaaactgcttttgtacgggagcaataagggctacgcgtagcctgatgagagtaccgtacgaat

SEQ ID NO: 3398 - DNA, 490 bp, Unknown
  Ascusbbf_151755, encodes 16S rRNA
agagtttgatcctggctcaggatgaacgctagcggcaggcttaacacatgcaagtcgaggggcagcgcggggtagcaatactctggcggcgaccggcgaaagggtgagtaacgcgtgagcaacatgcccgtagttgggggatagtcattggaaacgatgcgtaataccccgtaacaacagaccccgcatgaggtttgtttaagagatttattgtctacggattggctcgcgtcccattagctagttggcggggtaacggcccaccaaggcgacgatgggtaggggttctgagaggaaggtcccccacattggaactgagacacggtccagactcctacgggaggcagcagtgaggaatattggacaatggccgggaggctgatccagccatgccgcgtgcgggaggacggccctatgggttgtaaaccgcttttgtcggggagcaataaggtccacgtgtggactgatgagagtacccggcgaataagca

SEQ ID NO: 3399 - DNA, 490 bp, Unknown
  Ascusbbf_237674, encodes 16S rRNA
agagtttgatcctggctcagaacgaacgctggcggcatggattaggcatgcaagtcgaacgctcatcttcggatgggagtggcggaagggtgaggaacgcgtgagtaatctgcccccaagttgggaataacagttggaaacgactgctaataccgaatgtggctggacgggcgcatgtctgtttggctaaagatttatcgcttggggatgagctcgcgtcccattagctggttggtgaggtaacggctcaccaaggcgacgatgggtagctggtctgagaggatggtcagccacactgggactgagacactgcccagactcctacgggaggctgcagtcgagaatcttgggcaatgcgcgcaagcgtgacccagcaatgccgcgtgcgggatgaaggtcttcggattgtaaaccgctgtcactcgggacgaacacaatgacggtaccgagggaggaagccacggctaactacgtgccagcagccgcggta

SEQ ID NO: 3400 - DNA, 490 bp, Unknown
  Ascusbbf_118470, encodes 16S rRNA
agagtttgatcatggctcaggatgaacgctagctacaggcctaacacatgcaagtcgaggggcagcatgaagaaagcttgctttctttgatggcgaccggcgaatgggtgagtcacgcgtgtccaacctgcccccggcccggggatagcccttggaaatgaggattaagacccgatacgtggagtttccgcatggcggctccatgaaaccggcaggggatggggacgcgtcggattagcttgacggcggggcgacggcccaccgtggcgacgatccgcaggggttctgagaggaaggtcccccacactggcactgagacacgggccagactcctacgggaggcagcagtgaggaatattggtcaatgggcgagagcctgaaccagccaagtagcgtgcaggacgacggccctacgggttgtaaactgcttttgcgggaggataaacggcgccacgtgtggcgccctgcaggtatcccgtgaataaggacc

SEQ ID NO: 3401 - DNA, 490 bp, Unknown
  Ascusbbf_614570, encodes 16S rRNA
agagtttgatcatggctcagattgaacgctggcggcatgctttacacatgcaagtcgaacggtaacaggggcttcggtccgctgacgagtggcgaacgggtgagtaatgcgtcggaacgtgccgagtaatgggggataacgcatcgaaaggtgtgctaataccgcatacgctctgaggaggaaagctggggatcgaaagacctggcgttattcgagcggccgacgtctgattagctagttggtgaggtaaaggctcaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgttagggagcaagtcctgcaggttaagagccagtagggatgagagtacctaaagaataagcac

SEQ ID NO: 3402 - DNA, 467 bp, Unknown
  Ascusbbf_617937, encodes 16S rRNA
agagtttgatcatggctcagaacgaacgctggcggcaggcttaacacatgcaagtcgagcgcctcgcaagaggagcgggagacgggtgagtaacacgtgggaacataccctttactacggaacaactccgggaaactggagctaataccgtatgtgccctttgggggaaagatttatcggtaaaggattggcccgcgttggattagctagttggtggggtaaaggcctaccaaggcgacgatccatagctggtctgagaggatgatcagccacattggaactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagcgcggtaat

SEQ ID NO: 3403 - DNA, 490 bp, Unknown
  Ascusbbf_942523, encodes 16S rRNA
agagtttgatcatggctcaggacgaacgctggcggcgtgcctaatacatgcaagtcgagcggagctgaggagaagcttgcttctctgaagcttagcggcggacgggtgagtaacacgtaggcaacctgcctgcaagaccgggataactgacggaaacgtgagctaataccggataggcggacttctcgcatgaggggttcgggaaaggcggcgcaagctgtcacttgcagatgggcctgcggcgcattagctagttggtggggtaacggctcaccaaggcgacgatgcgtagccgacctgggagggtgatcggccacactgggactgagacacggcccagactcctacgggaggcagcagtagggaatcttccgcaatggacgaaagtctgacggagcaacgccgcgtgagtgaggaaggccttcgggtcgtaaagctctgttgccagggaagaacgccaaggagagtaactgctctttgggtgacggta

SEQ ID NO: 3404 - DNA, 490 bp, Unknown
  Ascusbbf_525292, encodes 16S rRNA
agagtttgatcctggctcaggacgaacgctggcggcgtggattaggcatgcaagtcgagcgatatctaaccttcgggttagtgaaagcggcgaacgggtgagtaacacgtggacaacctgccctcacattccggataatagaccgaaaggtcttgtaatacgggcgaggattctcctgaggcatctcgggggaagggaaggcgcaagccgtgcgaggaggggtccgcgaattatcaggtagatggtggggtaatggcctaccatgcctacgacgattagctggtctgagaggatggtcagccacactgggactgagacactgcccagactcctacgggaggctgcagtcgagaatcttgcacaatgcgcgaaagcgtgatgcagcgacgccgcgtgaaggatgaaggcccttgggtcgtaaacttcttttatcggggaagaataaatgacggtacccgatgaataagccacggctaactacgtgccagca

SEQ ID NO: 3405 - DNA, 490 bp, Unknown
  Ascusbbf_505899, encodes 16S rRNA
agagtttgatcctggctcaggatgaacgctggcggcgtgcctaacacatgcaagtcgagcgagaagccgtgaagtggagattcgtcaaagcgacatggtggatagcggcggacgggtgagtaacgcgtaggtaacctgccccttacacagggatagcctcgggaaaccgggattaatacctgataaagcggagggaacacatgtttccatcgccaaagatttatcggtgagggatggacctgcgtctgattagctggttggtgaggtaacggcccaccaaggcaacgatcagtagccgacctgagagggtaatcggccacattggaactgagacacggtccaaactcctacgggaggcagcagtggggaatattgcacaatgggcgcaagcctgatgcagcaacgccgcgtgagcgaagaaggtcttcggatcgtaaagctctgtcctatggaacgaagaagtgacggtaccatgggaggaagccccggc

SEQ ID NO: 3406 - DNA, 490 bp, Unknown
  Ascusbbf_516058, encodes 16S rRNA
agagtttgatcatggctcaggatgaacgctggcggcgcgcataacacatgcaagtcgaacggagtcacattgaaacctagtgatttgtgacttagtggcggacgggtgagtaacgcgtgggtaacctgcctggtattgggggacaacagttagaaatgactgctaataccgcatacgacgtcggggaggcatctccctgacgggaaaggaattatccgatatcagatggacccgcgtctgattagctagttggtgaggtaacggcccaccaaggcgacgatcagtagccgaactgagaggttgaccggccacattgggactgagacacggcccaaactcctacgggaggcagcagtggggaatattgcacaatgggggaaaccctgatgcagcgacgccgcgtgagtgatgaagtatttcggtatgtaaagctctatcgatggggaagaaaatgacggtacccaagtaagaagccccggctaactacgtg

SEQ ID NO: 3407 - DNA, 490 bp, Unknown
  Ascusbbf_1446159, encodes 16S rRNA
agagtttgatcctggctcaggatgaacgctagctacaggcttaacacatgcaagtcccggggcatcgcgaagggtagcaatactctttggcggcgaccggcggatgggtgagtaacgcgtatccaacctggccctatctcgggcacagcccctcgaaagagggattaattcccgatgttcccgttagttcgcatgttctttcgggcaaagatatttatcggatagggatggggatgcgttccattaggcagtcagcggggtaacggcccaccgagccttcgttggataggggttctggggggattgccccccacactgggacgtgaactcggcccagactcctacgggaggcagcagtgaggaatattggtcaatggcggtaacgctgaaccagccaagtagcgtgagggattacggccctacgggtcttaaacctcttttgttggggagcaacctgtgccacctgtggcacactgcgagtacccttcga

SEQ ID NO: 3408 - DNA, 490 bp, Unknown
  Ascusbbf_543007, encodes 16S rRNA
agagtttgatcatggctcaggacgaacgctggcggcgtgcttcacacatgcaagtcgaacggaaaggcccagcttgctgggtgctcgagtggcgaacgggtgagtaacacgtgagtaatctgcctttggctttgggataagcctcggaaacggggtctaatactggatatgacttctgcctgcatgggtgggagtggaaaggttttccggctggagatgggctcgcggtctatcagcttgttggtggggtaatggctcaccaaggctttgacggatagccggcctgagagggcgaccggccacactgggactgagacacggcccagactcctacgggaggcagcagtggggaatattgcgcaatgggcgaaagcctgacgcagcgacgccgcgtgagggatgacggccttcgggttgtaaacctctttcagcagggacgaagtgcgaatgacggtacctgcagaagaagcgccggctaactacgtgccag

SEQ ID NO: 3409 - DNA, 490 bp, Unknown
  Ascusbbf_686377, encodes 16S rRNA
agagtttgatcatggctcaggatgaacgctagcggcaggcctaacacatgcaagtcgaggggtagaggaagcttgcttccttgagaccggcgcacgggtgcgtaacgcgtatgcaatctaccttatactaagggatagcccagagaaatttggattaataccttatggttaatttgtttggcatcattcgaattataaagatttattggtataagatgagcatgcgtcccattagttagttggtaaggtaacggcttaccaagacgatgatgggtaggggtcctgagagggagatcccccacactggtactgagacacggaccagactcctacgggaggcagcagtgatgaatattggtcaatggaggcaactctgaaccagccatgccgcgtgcaggatgacggtcctatggattgtaaactgcttttgtacaggaagaaaacatgctacgtgtagcaacttgacggtactgtaagaataaggatcggc

SEQ ID NO: 3410 - DNA, 490 bp, Unknown
  Ascusbbf_604861, encodes 16S rRNA
agagtttgatcatggctcaggatgaacgctagcggcaggcctaatacatgcaagtcgaacgggattggggagcttgcttcccatgagagtggcgtacgggtgcgtaacgcgtgagcaacctaccgttgtcagggggatagcccggagaaatccggattaataccgcataacatcagcgaatagcattattttctgatcaaacatttatgggacaacgatgggctcgcgtgacattagctagttggagtggtaacggcacaccaaggcgacgatgtctaggggatctgagaggatgaccccccacactgggactgagacacggcccagactcctacgggaggcagcagtaaggaatattggtcaatggaggcaactctgaaccagccatgccgcgtgcaggaagaatgccctctgggttgtaaactgcttttaccagggaataaacccttctacgtgtaggaggctgaatgtacctgaggaataaggatcg

SEQ ID NO: 3411 - DNA, 490 bp, Unknown
  Ascusbbf_628613, encodes 16S rRNA
agagtttgatcctggctcaggatgaacgctagctacaggcttaacacatgcaagtcgaggggcagcatgcgggttgcttgcaacccgtgatggcgaccggcgcacgggtgagtatcgcgtatccaacctgcccataagtagggaataaccggtagaaatgccgactaatgccctatgtggttcgatgaggacatctgagtcgaattaaagattcatcgcttatggatggggatgcgtccgattagcttgttggcggggtaacggcccaccaaggcgacgatcggtaggggttctgagaggaaggtcccccacataggaactgagacacggtcctaactcctacgggaggcagcagtgaggaatattggtcaatgggcgcgagcctgaaccagccaagtagcgtgcaggatgacggccctatgggttgtaaactgcttttatgcggggataaagtcgcccacgtgtgggcgtttgcaggtaccgcatgaat

SEQ ID NO: 3412 - DNA, 490 bp, Unknown
  Ascusbbf_446559, encodes 16S rRNA
agagtttgatcatggctcaggatgaacgctagcgataggcctaacacatgcaagtcgaggggcagcacatgaggtagcaatacttctggtggcgaccggcgcacgggtgagtaacacgtatgcaacctaccttcaacaggcggataaccccgggaaatcggggctaatacgccataacacagggatcccgcatgggaatatttgttaaagatttatcggttgtagatgggcatgcgttccattagctagttggtgaggtaagggctcaccaaggcaacgatggataggggaactgagaggtttatcccccacactggtactgagacacggaccagactcctacgggaggcagcagtgaggaatattggtcaatggaggcaactctgaaccagccacgtcgcgtgaaggaagacggccctacgggttgtaaacttcttttgcaagggaataaagtgagtcacgtgtgactttttgcatgtaccttgcgaat

SEQ ID NO: 3413 - DNA, 490 bp, Unknown
  Ascusbbf_1681137, encodes 16S rRNA
agagtttgatcatggctcaggatgaacgctggcggcgtgcctaatacatgcaagtcgaacgctcgacttcaaacaagcttgcttgaatgaagaagagagtggcgaacgggtgagtaatacataagtaatctgcccctgcaactgggataaccattggaaacgatggctaataccggatagttcaatttatggcatcatgaattgattaaagatgggatacatcgagcagggatgagcttatggtgcattagctagttggtaaggtaatggcttaccaaggccgtgatgcatagccgacctgagagggtgaccggccacactgggactgagacacggcccagactcctacgggaggcagcagtagggaattttcggcaatgggggcaaccctgaccgagcgacgccgcgtgagtgaagaaggccttcgggttgtaaagctctgttgtaagggaagaatggcaccagcagggaatggctggtgattgacggt

SEQ ID NO: 3414 - DNA, 490 bp, Unknown
  Ascusbbf_616120, encodes 16S rRNA
agagtttgatcctggctcaggatgaacgctagcgacaggcctaacacatgcaagtcgaggggtagcagagatgtagcaatacatttgctgacgaccggcgcacgggtgagtaacgcgtatgcaacctacctactacagggggatagcccgaagaaattcggattaacaccgcataatactattttttcgcatggaattatagttaaaaatttattggtagtagatgggcatgcgttccattagccagttggtgaggtaacggctcaccaaagcaacgatggataggggaactgagaggtttatcccccacactggtactgagacacggaccagactcctacgggaggcagcagtgaggaatattggtcaatggacgagagtctgaaccagccaagtcgcgtgaaggatgactgccctatgggttgtaaacttcttttgtgctagagtaaaaaagagtatgtatactctcttgcaagtatagtacgaataa

SEQ ID NO: 3415 - DNA, 490 bp, Unknown
  Ascusbbf_49855, encodes 16S rRNA
agagtttgatcctggctcaggatgaacgctagcgacaggcttaacacatgcaagtcgaggggcatcatgaggtagcaataccttgatggcgaccggcgcacgggtgagtaacgcgtatgcaacctgcctgataccggggtatagcccatggaaacgtggattaacaccccatagtacttttatcctgcctgggatgtgagttaaatgttcaaggtatcggatgggcatgcgtcctattagttagttggcggggtaacagcccaccaagacgatgataggtaggggttctgagaggaaggtcccccacattggaactgagacacggtccaaactcctacgggaggcagcagtgaggaatattggtcaatggacgagagtctgaaccagccaagtcgcgtgagggaagactgccctatgggttgtaaacctcttttataagggaagaataagttctacgtgtagaatgatgcctgtaccttatgaataagca

SEQ ID NO: 3416 - DNA, 490 bp, Unknown
  Ascusbbf_59917, encodes 16S rRNA
agagtttgatcatggctcaggatgaacgctggcggcgtgcttaatacatgcaagtcgaacgaagcacccctcccgatgatatgacgagcttgctctgaattgaatcacctggggtgactgagtggcggacgggtgagtaacgcgtgggtaacctacctatgacagggggatagcagttggaaacgactgataataccgcataagtgcacagtatcgcatgatacagtgtaaaaaactccggtggtcatagatggacccgcgtctgattagctagttggtgaggtaacggcccaccaaggcgacgatcagtagccgacttgagagagtgatcggccacattgggactgagacacggcccaaactcctacgggaggcagcagtagggaatattgcacaatgggggaaaccctgatgcagcgacgccgcgtgaaggatgaagtatttcggtatgtaaacttctatcagcaaggaagaaaatgacggtacttga

SEQ ID NO: 3417 - DNA, 490 bp, Unknown
  Ascusbbf_211958, encodes 16S rRNA
agagtttgatcctggctcaggatgaacgctggcggcgtgcctaatacatgcaagtcgaacggagtacttcggtacttagtggcgaacgggtgagtaacacataaacaatctaccctgaagactgggataacggttggaaacgaccgctaataccggataggtaacttaaaggcatctttgagttattaaagttgggatacaacactgcaggatgagtttatgtcgcattagctagttggcggggcaacggcccaccaaggcgatgatgcgtagccggtctgagaggatgaacggccacattgggactgagacacggcccagactcctacgggaggcagcagtagggaattttcggcaatgggggaaaccctgaccgagcaacgccgcgtgaacgatgaaggtctttggattgtaaagttctgttacgagggaagaatggtttgtgtagggaatgacacaaacagggacggtacctcgccagaaagccacg

SEQ ID NO: 3418 - DNA, 490 bp, Unknown
  Ascusbbf_660354, encodes 16S rRNA
agagtttgatcctggctcaggacgaacgctggcggcgtgcctaacacatgcaagtcgaacggagctgttttggacggagacttcggtcaaagaccatgacagcttagtggcggacgggtgagtaacgcgtgagtaacctgccgttcagagggggacaacagttggaaacgactgctaataccgcataatgtatataggaggcatcttctgtataccaaaggagcaatccgctgaatgatggactcgcgtccgattagatagttggtggggtaacggcctaccaagtcgacgatcggtagccggactgagaggttgatcggccacattgggactgagacacggcccagactcctacgggaggcagcagtgggggatattgcacaatggaggaaactctgatgcagcaacgccgcgtgagggaagaaggtcttcggattgtaaacctttgtttttggtgacgaacaaatgacggtagccaaagaggaagcca

SEQ ID NO: 3419 - DNA, 490 bp, Unknown
  Ascusbbf_225805, encodes 16S rRNA
agagtttgatcatggctcagaacgaacgctggcggcatggattaggcatgcaagttgaacgaactccttcgggagtgagtagcgaaagggtgaggaacgcgtgagtaatctgcccataagttgggaacaacagttggaaacgactgctaataccgaatgtggctattgacccgcatgggtttttggctaaagatttatcgcttatggatgagctcgcgtcccattagctagttggtgaggtaacggcccaccaaggctacgatgggtagctggtctgagaggatggtcagccacactgggactgagacactgcccagactcctacgggaggctgcagtcgagaatcttgggcaatgcgcgaaagcgtgacccagcaatgccgcgtgcatgatgaaggccctcgggtcgtaaaatgctgtctcccgtgacgaataatgacggtagcggggaaggaagccacggctaactacgtgccagcagccgcggtaat

SEQ ID NO: 3420 - DNA, 490 bp, Unknown
  Ascusbbf_149523, encodes 16S rRNA
agagtttgatcctggctcagaacgaacgctggcggcgcgtcttaagcatgcaagtcgagcgggattgtccagcttgctggacatgagagcggcggactggcgaggagcgcgtgggcgacgcgccccccggactggaacagcccgtggaaacacggggtaatgccggacggcatgggaggcttggaggccttccatcaaaggggcttcggccccgccgggggaacggcccgcgtcccatcagcttgttggcggtgcaagggaccaccaaggctacgacgggtgtccggcctgagagggcgatcggacgcattgggactgagatacggcccagactcctacgggaggcagcagctaagaatattccgcaatgggcgaaagcctgacggagcgacgccgcgtggacgatggaggccggaaggttgtaaagtccttttgggaaagaagaagaagccggggaggaaacgccccggcggcgacggtatttcgcgaa

SEQ ID NO: 3421 - DNA, 490 bp, Unknown
  Ascusbbf_712553, encodes 16S rRNA
agagtttgatcatggctcaggatgaacgctggcggcgtgcctaacacatgcaagtcgaacgggccccagcggcggaactttttcggaggtgaagccgcgaagggctagtggcggacgggtgagtaacgcgtgggcaatctgccctgcaccgggggacaacagggggaaacccctgctaataccgcataagcgcacggcatggcatcatgcagtgtgaaaagctccggcggtgcgggatgagcccgcgtccgattagctggttggcggtgcagcggaccaccaaggcgacgatcggtagccggcctgagagggcggacggccacattgggactgagacacggcccagactcctgcgggaggcagcagtgggggatattgcacaatggggggaaccctgatgcagcgacgccgcgtgggtgaagaagcatttcggtgcgtaaagccctatcgacagggacgataatgacggtacctgggtaagaagccccgg

SEQ ID NO: 3422 - DNA, 490 bp, Unknown
  Ascusbbf_1882268, encodes 16S rRNA
agagtttgatcctggctcaggacgaacgctggcggcgtgcctaatacatgcaagtcgaacgaactgacgctggaacttgttccagttgacgtgagtggcgaacgggtgagtaacacgtggggaacctacccttcagcgggggataaccgtcggaaacgatggctaataccgcataacactttgtaccacatggtacaaagttaaaagacggcttcggctgtcactgaaggatggtcccgcggtgcattagctagttggtagggtaaaggcctaccaaggccatgatgcatagccgacctgagagggtgatcggccacactgggactgagacacggcccagactcctacgggaggcagcagtagggaatcttccgcaatggacgaaagtctgacggagcaacgccgcgtgtgtgaagaaggtcttcggatcgtaaagcactgttattagagaagaacaaccggtagagtaactgttaccggcttgacggta

SEQ ID NO: 3423 - DNA, 489 bp, Unknown
  Ascusbbf_688748, encodes 16S rRNA
agagtttgatcatggctcaggacgaacgctggcggcgtgcctaacacatgcaagtcgaacgatccccctcgggggatagtggcggacgggtgagtaacgcgtgaacaatctgccctgtacaaaggaatagcctcgggaaaccgggattaaaaccgtataacactttagtatcgcatgatacagaagtcaaatatttataggtatgggatgagttcgcgtctgattagctagttggtaaggtaaaggcttaccaaggcgacgatcagtagccggcctgagagggtgaacggccacactggaactgagacacggtccagactcctacgggaggcagcagtggggaatattgcacaatggagggaactctgatgcagcgacgccgcgtgagtgaagaaggtcttcggatcgtaaaactctgtccttggtgaagataatgacggtagccaaggaggaagccccggctaactacgtgccagcagccgcggtaat

SEQ ID NO: 3424 - DNA, 490 bp, Unknown
  Ascusbbf_1221355, encodes 16S rRNA
agagtttgatcctggctcaggatgaacgctggcggcatgcctaatacatgcaagtcgaacggatggataagtacttgtactttgaagtcagtggcgaacgggtgagtaatacatgaacaacctacccctttgactgggataacgttctgaaaagaacgctaataccggataggtgatcttaaggcatcttgagatcattaaaggtgggctacaccacattgggatgggttcatgtcgcattagttagttggcagggtaacggcctaccaagacgacgatgcgtagccggtctgagaggatgaacggccacattgggactgagacacggcccagactcctacgggaggcagcagtagggaattttcggcaatgggcgcaagcctgaccgagcaatgccgcgtgaacgatgaaggtctttggattgtaaagttctgttgcgagggaagaacattatgtatagggaatgatacataactgacggtacctcgcc

SEQ ID NO: 3425 - DNA, 470 bp, Unknown
  Ascusbbf_1842241, encodes 16S rRNA
agagtttgatcctggctcagaacgaacgccggcggcaggcttaacacatgcaagtcgagcgaggacttcggtcctagcggcgaacgggtgagtaacgcgtgggaacgtacccctttcttcggaataactcagggaaacttgaactaataccggatacgcccttcgggggaaagatttatcggtgagggatcggcccgcgttggattaggtagttggtggggtaatggcctaccaagccgacgatccatagctggtttgagaggacgatcagccacactgggactgagacacggcccagactcctacgggaggcagcagtggggaatcttggacaatgggggaaaccctgatccagccatgccgcgtgaacgatgaaggccttagggttgtaaagttctttcagcggggaagataatgacggtacccgcagaagaagccccggctaactccgtgccagcagccgcggtaat

SEQ ID NO: 3426 - DNA, 481 bp, Unknown
  Ascusbbf_1304489, encodes 16S rRNA
agagtttgatcctggctcagaacgaacgctggcggcaggcttaacacatgcaagtcgagcgccccgcaaggggagcggcagacgggtgagtaacgcgtgggaatctaccttttgctacggaataactcagggaaacttgtgctaataccgtatgtgtcccccatagagatatggcgggagaaagatttatcggcaagagatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgacggtcttaggattgtaaagctctttcaccggtgaagataatgacggtaaccggagaagaagccccggctaacttcgtgccagcagccgcggtaat

SEQ ID NO: 3427 - DNA, 490 bp, Unknown
  Ascusbbf_719954, encodes 16S rRNA
agagtttgatcctggctcagaatgaacgctggcggcgtggttaagacatgcaagtcgaacgggtttttcagctgtagcaatacaattgaaaagctagtggcgaacgggtgcgtaacacgtgaacaatttaccttttagtgtggaatagcttgtcgaaaggcaaattaataccgcatgtggttgtgatccgcatggttcacatactaaagcttgggaccgcaaggccaggcgctaatcgaggagttcgcggcctatcagctagttggtgaggtaacggctcaccaaggctaagacgggtagctggtctgagaggatggccagccacactggagctgagacacggtccagacacctacgggtggcagcagtttcgaatcattcacaatgggcgaaagcctgatggtgtgacgccgcgtgggggacgaaggttttcggattgtaaacccctgtcaccggggaagaaacgttcaaagttaatagctttgagcct

SEQ ID NO: 3428 - DNA, 490 bp, Unknown
  Ascusbbf_821484, encodes 16S rRNA
agagtttgatcatggctcaggatgaacgctggcggcgtgcctaatacatgcaagtcgaacgctcgacttttaacaagcttgcttgatttaagaagagagtggcgaacgggtgagtaatacataagtaatctgcccctacaactgggataaccattggaaacgatggctaataccggatagttcaattgatggcatcattgattgattaaagatgggctacatcgagtagggatgagcttatggtgcattagctagttggtaaggtaagagcttaccaaggcgatgatgcatagccgacctgagagggtgaccggccacactgggactgagacacggcccagactcctacgggaggcagcagtagggaattttcggcaatgggggcaaccctgaccgagcgacgccgcgtgagtgaagaaggccttcgggttgtaaagctctgttgtaagggaagaatggtacttgtagggaatgacaagtaattgacggt

SEQ ID NO: 3429 - DNA, 490 bp, Unknown
  Ascusbbf_1478947, encodes 16S rRNA
agagtttgatcctggctcaggatgaacgctagcggcaggcttaacacatgcaagtcgaggggcagcacgggtagcaatacctggtggcgaccggcgcaagggtgcgtaacgcgtgagcaacatgccctatacagggggataaaccagggaaacttggactaataccccatagcatttatttatggcatcatgaataaattaaagcttcggtggtataggattggctcgcgtgacattagctagatggtgaggtaacggctcaccatggcgatgatgtctaggggttctgagaggaaggccccccacactgggactgagacacggcccagactcctacgggaggcagcagtgaggaatattggacaatggatggaaatctgatccagccatgccgcgtgcaggaagacggccctatgggttgtaaactgcttttatacgggagcaataaggtctacgtgtagactgatgagagtaccgtatgaataagcat

SEQ ID NO: 3430 - DNA, 490 bp, Unknown
  Ascusbbf_955124, encodes 16S rRNA
agagtttgatcctggctcaggatgaacgctagcggcaggcctaacacatgcaagtcgaggggcagcggggtagcaatactgccggcgaccggcgcacgggtgagtaacgcgtatgtaacctagttcacaaagagggatagccttccgaaagggagattaataccacatataatactgttattgcatgatgatagtatgaaacatttatggatgtgaaatggacatgcgtctgattagatagtaggcggggtaacggcccacctagtcgacgatcagtaggggttctgagagggagatcccccacattggtactgagacagggaccaaactcctacgggaggcagcagtgaggaatattggtcaatggacggaagtctgaaccagccaagtcgcgtgcaggaagacggccctatgggttgtaaactgcttttgtacgagggtaaaaggcgctatgtatagtgttttgaaagtaccgtacgaataaggatcg

SEQ ID NO: 3431 - DNA, 490 bp, Unknown
  Ascusbbf_456457, encodes 16S rRNA
agagtttgatcatggctcaggacgaacgctggcggcgtgcttaacacatgcaagtcgaacgatgaagctggggcttgctctggtggattagtggcgaacgggtgagtaacacgtgagcaacgtgcccggaactctgggataactaccggaaacggtggctaatactggatatgtgccagggaggcatcttctctggttggaaagagtttttggttccggatcggcttacggcctatcagcttgttggtggggtaatggcctaccaaggcgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagcgtaagtgacggtacctgcagaaaaagcaccggctaactacgtgc

SEQ ID NO: 3432 - DNA, 490 bp, Unknown
  Ascusbbf_1845932, encodes 16S rRNA
agagtttgatcatggctcagattgaacgctggcggcatgcctaacacatgcaagtcgaacggcagcgcggagagcttgctctctggcggcgagtggcggacgggtgaggaatatgtaggaatctacctagaggagggggataacttggggaaactcaaggtaataccacataagccctacgggggaaagcaggggatcttcggaccttgcgccttatgatgagcctacatcggattagcttgttggtggggtaaaggcctaccaaggcgacgatccgtagctggtctgagaggatgaccagccacactgggactgagacacggcccagactcctacgggaggcagcagtggggaatattggacaatgggcgaaagcctgatccagcaatgccgcgtgtgtgaagaaggccttagggttgtaaagcactttcagtggggaggaagggtttaatgctaatatcattgaatcttgacgctacccacagaagaa

SEQ ID NO: 3433 - DNA, 490 bp, Unknown
  Ascusbbf_953725, encodes 16S rRNA
agagtttgatcctggctcaggacgaacgctggcggcgtgcctaatacatgcaagtggaacgcacgattaaaccgtagcttgctacacattaatcgtgagtcgcgaacgggtgagtaacgcgtaggtaacctgcctattagcgggggataactattggaaacgatagctaataccgcataggagagatgatcgcatgatcatagtttaaaagatacaactgtatcgctagtagatggacctgcgttgtattagctggttggtaaggtagtggcttaccaaggcaacgatacatagccgacctgagagggtgaccggccacacggggactgagacacggcccagactcctacgggaggcagcagtagggaatcttcggcaatggggggaaccctgaccgagcaacgccgcgtgagtgaagaaggttttcggatcgtaaagctctgttgtcagagacgaacgtatgtgagagtggaaagttcacatagtgacg

SEQ ID NO: 3434 - DNA, 490 bp, Unknown
  Ascusbbf_34145, encodes 16S rRNA
agagtttgatcatggctcaggataaacgctggcggcgcacataagacatgcaagtcgaacggacttaactcattcttttagattgagagcggttagtggcggactggtgagtaatacgtaagcaacctgcctgttagaggggaacaacagttagaaatgactgctaataccgcatatgccatagataccacatggtatcagtgggaaaggagcaatccgctaacagatgggcttacggctgattagctagttggtggggtaacggcctaccaaggcgacgatcagtagccggactgagaggttcaacggccacattgggactgagatacggcccagactcctacgggaggcagcagtcgggaattttgcgcaatggaggaaactctgacgcagtgacgccgcgtgcaggaagaaggttctaggattgtaaactgctttagacagggaagaaaaaagacagtacctgtagaataagctccggctaactacg

SEQ ID NO: 3435 - DNA, 490 bp, Unknown
  Ascusbbf_723324, encodes 16S rRNA
agagtttgatcatggctcaggacgaacgctggcggcgtgcttaacacatgcaagtcgaacggacggacacccttcggggtgcgagttagtggcggacgggtgagtaacgcgtgagtaacctgccttggagtggggaataacacagggaaacttgtgctaataccgcataatatcatgagatggcatcttcttatgatcaaagatttattgctccaagatgggctcgcgtccgattagatagttggcggtgtaatggcccaccaagtcgacgatcggtagccggactgagaggttggccggccacattgggactgagacacggcccagactcctacgggaggcagcagtgggaatattaggcaatgggggaaaccctgacctagcgacgccgcgtgaaggatgaaggttttcggattgtaaacttctttggcaggggacgataatgacggtaccctgagaacaagccacggctaactacgtgccagcagcc

SEQ ID NO: 3436 - DNA, 490 bp, Unknown
  Ascusbbf_114457, encodes 16S rRNA
agagtttgatcatggctcaggatgaacgctagcggcaggcttaacacatgcaagtcgaggggcagcacgtcttcggatggtggcgaccggcgcacgggtgagttacgcgtatgcaatctaccttttactggggcatagcccggggaaacccggattaatatcccatagtaccataacccggcatcgggaattggttaaagccttggcggtaaaagatgagcatgcgtcctattagcttgatggtaaggtaacggcttaccatggctatgataggtaggggtcctgagagggagatcccccacactggtactgagacacggaccagactcctacgggaggcagcagtgaggaatattggacaatgggcgagagcctgatccagccatgccgcgtgcaggaagacggccctatgggttgtaaactgcttttatacgggaagaaacaccctcttgcgagaggacttgacggtaccgtatgaataaggatcggc

SEQ ID NO: 3437 - DNA, 490 bp, Unknown
  Ascusbbf_220237, encodes 16S rRNA
agagtttgatcatggctcaggacgaacgctggcggcgtgcttaaaacatgcaagtcgaacgggaagttgaaaagcttgctttttaacttctagtggcggacgggtgagtaacgcgtgagcaacctgcctactactggggaataacacagagaaatttgtgctaataccgcataagaccacaggagggcatcctctaggggtcaaaggaagtaattccggtggtagaggggcttgcgtctcattagcttgttggtggggtaacggcctaccaaggcgacgatgagtagccgatctgagaggatgaacggccacactggaactgagaaacggtccagactcctacgggaggcagcagttaggaatattgggcaatggaggaaactctgacccagcaacgccgcgtgaaggatgaaggttttcggattgtaaacttctgatctgagggaaaaagaaaatgatggtacctcaggagaaagccacggctaactac

SEQ ID NO: 3438 - DNA, 490 bp, Unknown
  Ascusbbf_145187, encodes 16S rRNA
agagtttgatcatggctcaggatgaacgctggcggcgtgcttaacacatgcaagtcgaacgaagcatgagctgaaattttcggatggatgcccatgacttagtggcggacgggtgagtaacgcgtgggtaacctgcctcatgcagggggacaacagctggaaacggctgctaataccgcataagaccccgtgagcgcatgctcaagaggtaaaagatttatcggcatgagatggacccgcgttagattagttagttggtggggtaacggcctaccaagacgacgatctatagccgacctgagagggtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaagatgacggtacctgcagaagaagccccggctaact

SEQ ID NO: 3439 - DNA, 490 bp, Unknown
  Ascusbbf_1417270, encodes 16S rRNA
agagtttgatcctggctcaggatgaacgctggcggcgcgcttaacgcatgcaagtcggacggggtgagtaacttcggttatgaattcagtggcggacgggtgagtaacgcgtggataatttgtctttcagtgggggatagctgagagaaatctcaattaataccgcatagtataatttattcgcatgggtgagttattaaaggtgcaaatcgctgagagagaagtctgcgtctgattagctagttggggtggtaatggcacaccaaggcgacgatcagtaatcggtttgagagaatgaacggtcacattgggactgagatacggcccagactcctacgggaggcagcagtggggaatattgcgcaatggaggaaactctgacgcagcgacgccgtgtgaaggatgaaggccttcgggttgtaaacttttatcgattgtgaaaagaagggatggtagcaaagtaagaagctccggctaactacgtgccagc

SEQ ID NO: 3440 - DNA, 490 bp, Unknown
  Ascusbbf_1497557, encodes 16S rRNA
agagtttgatcctggctcaggacgaacgctggcggcgtgcctaatacatgcaagtcgagcggggttagttagaagcttgcttctaaataacctagcggcggacgggtgagtaacacgtaggcaacctgcccacaagacaggaataactaccggaaacggtagctaatacccgatacatccttttcctgcatgggcgaaggaggaaagacggagcaatctgtcacttgtggatgggcctgcggcgcattagctggttggtggggtaaaggcctaccaaggcgacgacgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggta

SEQ ID NO: 3441 - DNA, 490 bp, Unknown
  Ascusbbf_698657, encodes 16S rRNA
agagtttgatcatggctcagattgaacgctggcggcaggcctaacacatgcaagtcgagcgcgaaagttcttcggaatgagtaaagcggcggacgggtgagtaatgcatgggaatctgcctggtagtgggggacaacgtctcgaaagggacgctaataccgcatacgccctacgggggaaagggggggatcttcggacctctcgctatcagatgagcccatgtcggattagctagttggtggggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttagggttgtaaagcactttcagtggggagaaaggttgtttacctaatacgtaagcaaattgatgttacccacagaagaagcaccgg

SEQ ID NO: 3442 - DNA, 490 bp, Unknown
  Ascusbbf_430580, encodes 16S rRNA
agagtttgatcctggctcaggatgaacgctagcggcaggcttaacacatgcaagtcgaggggtagaggctttcgggccttgagaccggcgcacgggtgcgtaacgcgtatgcaatctgccttgtactgggggatagcccagagaaatttggattaataccccatagtattttcggttggcatcaactgattattaaagtttttcggtacaagatgagcatgcgtcccattagctagttggtatggtaacggcataccaaggctacgatgggtaggggtcctgagagggagatcccccacactggtactgagacacggaccagactcctacgggaggcagcagtgaggaatattggtcaatggtcgcaagactgaaccagccatgccgcgtgcaggatgaagcatctatggtgtgtaaactgcttttgtacgggaagaaacactgctacgtgtagcagcttgacggtaccgtaagaataaggatcggctaa

SEQ ID NO: 3443 - DNA, 490 bp, Unknown
  Ascusbbf_1281250, encodes 16S rRNA
agagtttgatcctggctcaggacgaacgctggcggcgtgcctaacacatgcaagtcgagcgaagtgattttaaggaaattttcggatggaattaaaattatcttagcggcggacgggtgagtaacgcgtgagaaacctgcctttcacaaagggatagcctcgggaaactgggattaataccatatgatacttttacttcgcatgaagcaaaagttaaagcgtaaagcggtgaaagatggtctcgcgtcccattagttagttggtgaggtaacggctcaccaagaccgcgatgggtagccggcctgagagggtgaacggccacactggaactgagacacggtccagactcctacgggaggcagcagtggggaatattgcacaatggaggaaactctgatgcagcgacgccgcgtgaacgatgaaggccttcgggtcgtaaagttctgtccttggggacgataatgacggtacccaaggaggaagccccggc

SEQ ID NO: 3444 - DNA, 490 bp, Unknown
  Ascusbbf_254751, encodes 16S rRNA
agagtttgatcctggctcaggatgaacgctggcggcgtgcttcatacatgcaagtcgaacgtgaagctgacttcggtcagtggaaagtggcggacgggtgagtaatacataggaaatctgcccttaggaaggggataacagtcggaaacgattgctaataccctatacgagcttggttgaaataccaatcttgaaaactccggtgcctaaggatgagcctgtgcctgattagctagttggtggtgtaatggaccaccaaggcgacgatcagtagctggtttgagaggatgatcagccacaatggaactgagacacggtccatactcctacgggaggcagcagtagggaattttgggcaatgggcgaaagcctgacccagcaacgccgcgtgtgtgatgaagcccctaggggtgtaaaacactgtcagtagggaagaaacttgactgtacctacagaggaagcaccggctaactccgtgccagcagccgcg

SEQ ID NO: 3445 - DNA, 490 bp, Unknown
  Ascusbbf_487683, encodes 16S rRNA
agagtttgatcatggctcaggacgaacgctggcggcgtgcttcatacatgcaagtcgaacgagaagttaccttcgggtaatggatagtggcggacgggtgagtaatgtgtagagaatctgccttcaagagggggatagcagttggaaacgactattaataccccatatgcgcgtagttggaatactattcgtgaaagattaatcgcttgaagatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgattgagaagaccttcgggttgtaaagatctgtcagtagggacgaacaatgactgtacctacagaggaagcaccggctaactccgtgccagcagccgcgg

SEQ ID NO: 3446 - DNA, 490 bp, Unknown
  Ascusbbf_1682531, encodes 16S rRNA
agagtttgatcctggctcaggacgaacgctggcggcgtgcttaacacatgcaagtcgaacggaggatttatttcggtaaatccttagtggcgaacgggtgagtaacgcgtgggcaatctgcccttcagatggggacaacatcccgaaaggggtgctaataccgaatacgatcgtattcccgcatgggattgcgatgaaagatggcctctatttataagctatcgctgaaggatgagcctgcgtctgattagctagttggtggggtaacggcctaccaaggcgatgatcagtagccggtctgagaggatgaacggtcacattgggactgagacacggcccaaactcctacgggaggcagcagtggggaatattccgcaatggacgaaagtctgacggagcaacgccgcgtgagtgatgaaggttttcggactgtaaagctctgttgtttaggacgaaagtgcctgttgcgaacagttacaggtattgacgg

SEQ ID NO: 3447 - DNA, 490 bp, Unknown
  Ascusbbf_719944, encodes 16S rRNA
agagtttgatcatggctcaggatgaacgctggcggcgtgcctaatacatgcaagtcgaacggagatcttcggatcttagtggcgaacgggtgagtaatacatgaggaacctgccctttagacggggatagctcttggaaacgggaggtaataccggataacagataggaaggcatctacttatcttaaaagggagcttctggcttcgcttaaggatggcctcatggtgcattagctagacggcggggtaacggcccaccgtggcgatgatgcatagccgatctgagaggatgaccggccacattgggactgagacacggcccagactcctacgggaggcagcagtagggaattttcggcaatgggcgaaagcctgaccgagcaacgccgcgtgagtgttaaggccttcgggttgtaaagctctgttgtaagggacgaataacacgattaggaaatgaattgtgaatgacggtaccttaccagaaagccac

SEQ ID NO: 3448 - DNA, 490 bp, Unknown
  Ascusbbf_916039, encodes 16S rRNA
agagtttgatcctggctcaggatgaacgctggcggcgtgcttaacacatgcaagtcgaacgatgaagcaccagcttgctggtgtggattagcggcgaacgggtgagtaacacgtgagcaacctgccccggacttcgggataacagctggaaacagttgctaataccggatatgcacgagaaccgcatggttacttgtgggaaagatttatcggtccgggaggggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgggggatgacggccttcgggttgtaaacctcttttagtagggaagaagccttcgggtgacggtacctgcagaaaaagcaccggctaactacgt

SEQ ID NO: 3449 - DNA, 490 bp, Unknown
  Ascusbbf_1665414, encodes 16S rRNA
agagtttgatcatggctcaggacgaacgctggcggcgtgcttaacacatgcaagttgaacggtactccatggaagcttgctgaagtggattatagtagcggacgggtgagtaatgcatgagaagctgccattgggagggggacaacagctggaaacggctgctaataccccgtatgccggaaggtgaaagggattaatcccgcccgatgaggtgctcatgtcctatcagctggttggtgaggtaacggctcaccaaggcgacgacgggtagccggcctgagagggtgaacggccacactggaactgggacacggtccagactcctacgggaggcagcagtggggaatattgggcaatgggggaaaccctgacccagcgacgccgcgtgagggaagacggccttcgggttgtaaacctcttttgtatgggaagaaggaagtgacggtaccatacgaataagtcccggctaactacgtgccagcagccgcgg

SEQ ID NO: 3450 - DNA, 490 bp, Unknown
  Ascusbbf_1467165, encodes 16S rRNA
agagtttgatcatggctcaggacgaacgctggcggcgtgcttaacacatgcaagtcgaacggaagtatataagaagcttgcttttaatatactttagtggcgaacgggtgagtaacgcgtgaggacttgtccactccagggggacaacagttggaaacggctgctaataccccataagccttcgggtaaaaggagcaatccgggagaggagagactcgcgtcctatcagctagtaggtgaggtaacggcttacctaggctaagacgggtaaccggactgagaggtcgaacggtcacactggaactgagacacggtccagactcctacgggaggcagcagtggggaatcttgggcaatggggggaaccctgatccagcgacgccgcgtgggtgaagacatccttcgggatttaaagccctgttgtacgggaagatagtgacggtaccgtaccagaaagccccggcaaactacgtgccagcagccgcggtaa

SEQ ID NO: 3451 - DNA, 490 bp, Unknown
  Ascusbbf_125392, encodes 16S rRNA
agagtttgatcctggctcaggatgaacgctagctacaggcttaacacatgcaagtcgaggggcagcatgaagtttgcttgcaaactttgatggcgaccggcgcacgggtgagtaacgcgtatccaacctgcccattacccggggatagcccgccgaaaggcgaattaatacccgatgtggtcccatgacggcatcagagtgggaccaaagtcttgtcggtaacggatggggatgcgtccgattaggttgttggcggggtaacggcccaccaagcctgcgatcggtaggggttctgagaggaaggtcccccacactggaactgagacacggtccagactcctacgggaggcagcagtgaggaatattggtcaatggtcggaagactgaaccagccaagtagcgtgcaggatgacggccctatgggttgtaaactgcttttatgcgggaataaagtgagggacgtgttcctttttgcatgtaccgcatgaat

SEQ ID NO: 3452 - DNA, 490 bp, Unknown
  Ascusbbf_175343, encodes 16S rRNA
agagtttgatcatggctcaggatgaacgctggcggcgtgcctaacacatgcaagtcgaacgaagcttgataaatgatttcttcggaatgaattttgatatgacttagtggcggacgggtgagtaacacgtgagcaacctgcctttcagagggggataacggtcggaaacgaccgctaataccgcatgatgtatcgagatggcatcattttgataccaaaggagcaatccgctgaaagatgggctcgcgtctgattagatagttggcggggtaacggcccaccaagtcgacgatcagtagccggactgagaggttgaacggccacattgggactgagatacggcccagactcctacgggaggcagcagtggggaatattgcacaatgggggaaaccctgatgcagcaacgccgcgtggaggacgacggttttcggattgtaaactccttttctttgtgaagaattctgacggtagcaaaggaataagcatc

SEQ ID NO: 3453 - DNA, 488 bp, Unknown
  Ascusbbf_300542, encodes 16S rRNA
agagtttgatcatggctcagaacgaacgctggcggcaggcttaacacatgcaagttgaacgggatttgtttgtagcttgctataagcaatgagagtagcgcactggtgagtaacacgtgggaacataccttttggtgggggacaacagttggaaacgactgctaataccgcataagccctaagggggaaagatttattgccgaaagattggcccgcggaagattaggtagttggtggggtaaaggcctaccaagccgacgatctatagctggtctgagaggacgaacagccacattggaactgagacacggtccagactcctacgggaggcagcagtgaggaatattgggcaatggaggaaactctgacccagccatgccgcgtgagtgaagaaggttttcgaattgtaaagctctttcgggtgagacgatgatgacggtatcacctaaagaagccccggcaaacttcgtgccagcagccgcggtaat

SEQ ID NO: 3454 - DNA, 490 bp, Unknown
  Ascusbbf_911948, encodes 16S rRNA
agagtttgatcatggctcaggatgaacgctggcggcgtgcctaacacatgcaagtcgaacggagctgcgacgctgatgatggaagtgcttgcacggaaagaatcttgttgtagcttagtggcggacgggtgagtaacgtgtggataacctggttcatccaggaggatagcagctggaaacggctggtaataccgcataagcgcacagtggggcatcctacggtgtgaaaagatttatcgggatggaatggatccgcatctgattagccagttggcggggtaacggcccaccaaagcgacgatcagtagccggcctgagagggcggacggccacattgggactgagacacggcccagactcctacgggaggcagcagtgggggatattgcacaatggagggaactctgatgcagcgacgccgcgtgggtgaagaagtatttcggtatgtaaagccctatcagcagggaagataatgacggtacctgagtaa

SEQ ID NO: 3455 - DNA, 490 bp, Unknown
  Ascusbbf_298474, encodes 16S rRNA
agagtttgatcatggctcaggacgaacgctggcggcgtgcctaacacatgcaagtcgaacggagatatttcagattgagatttcggttgattgaagaaatatcttagtggcggacgggtgagtaacgcgtgagtaacctgcccatgagagggggataacgttctgaaaagaacgctaataccgcataacatatttgaatcgcatgatttggatatcaaaggagcaatccgcttatggatggactcgcgtccgattagctggttggcgggataacagcccaccaaggcgacgatcggtagccggactgagaggttgaacggccacattgggactgagacacggcccagactcctacgggaggcagcagtgggggatattgcgcaatgggggaaaccctgacgcagcaacgccgcgtgaatgatgaaggtcttcggattgtaaaattcttttgttgaggacgaaagaaatgacggtactcaacgaataagct

SEQ ID NO: 3456 - DNA, 490 bp, Unknown
  Ascusbbf_128260, encodes 16S rRNA
agagtttgatcatggctcaggatgaacgctagcggcaggcctaacacatgcaagtcgaacggtaacatgagagcttgctctcgatgacgagtggcgcacgggtgagtaacacgtgtacaacttacctctaactggggcatagcccgaagaaattcggattaataccccataataattgaaattcgcatgtttttcaatttaaaactccggtggttagagatgggtacgcgtcctattagttagttggtgaggtaacggctcaccaagacttcgataggtaggggttctgagaggaagatcccccacactggtactgagacacggaccagactcctacgggaggcagcagtgaggaatattggacaatggacgaaagtctgatccagccatgccgcgtgtaggaagaatgccctctgggttgtaaactacttttatatgggaataaacccctcgacgtgtcgagggctgaatgtaccatacgaataagcac

SEQ ID NO: 3457 - DNA, 490 bp, Unknown
  Ascusbbf_574891, encodes 16S rRNA
agagtttgatcatggctcaggatgaacgctggcggcgtgcctaacacatgcaagtcgaacggaaagaattcttcggaattctttcagtggcggacgggtgagtaacgcgtgggtaacctgccccatacaggggaacaacagctggaaacggctgctaataccgcataagcgcacagtactgcatggtacagtgtgaaaagatttatcactgtaagatggacccgcgtctgattagccagttggcagggtaacggcctaccaaagcgacgatcagtagccgacctgagagggtgatcggccacattgggactgagacacggcccaaactcctacgggaggcagcagtgggggatattgcacaatggaggaaactctgatgcagccatgccgcgtgtgtgaagaaggccttcgggttgtaaagcactttcggaggggaggaacaaatgacgttaccctcagaagaagcaccggctaactccgtgccagcagc

SEQ ID NO: 3458 - DNA, 490 bp, Unknown
  Ascusbbf_229726, encodes 16S rRNA
agagtttgatcctggctcaggacgaacgctggcggcgtgcctaacacatgcaagtcgaacggagtttactttttagatttcttcggaatgacgagttgtaaacttagtggcggacgggtgagtaacgcgtgagcaacctgcctttcagagggggacaacagttggaaacgactgctaataccgcataatattaggtttagacatctttacctaatcaaaggagcaatccgctgaaagatgggctcgcgtccgattagatagttggcggggtaacggcccaccaagtcgacgatcggtagccggactgagaggttgatcggccacattgggactgagacacggcccagactcctacgggaggcagcagtgggggatattgcacaatgggcgaaagcctgatgcagcaacgccgcgtgagggaagaaggtcttcggattgtaaacctttgtcctaagtgaagaaacaaatgacggtaacttaggaggaagcc

SEQ ID NO: 3459 - DNA, 490 bp, Unknown
  Ascusbbf_503241, encodes 16S rRNA
agagtttgatcctggctcaggatgaatgctggcggcgtgcctaacacatgcaagtcgaacgtgaaagcatagcaatatgctggaaagtggcgaacgggtgagtaacacgtgggtaacctgccgcgcagagggggataacgactggaaacggtcgctaataccgcatggtaccacactcatgggaatgagagtggttaaaactttggtgctgcgcgaggggcctgcgaccgattagttagttggtggggtaacggcctaccaagacagtgatcggtagctagtctgagaggatgattagccacacgggaactgagacacggtcccgactcctacggggggcagcagtgaggaatattgcacaatggacgcaagtttgatgcagcaacgccgcgtggaggatgacggtctttggattgtaaactccttttctcagggaagagaatggacggtacctgaggaataagtcacggctaactacgtgccagcagcc

SEQ ID NO: 3460 - DNA, 490 bp, Unknown
  Ascusbbf_559899, encodes 16S rRNA
agagtttgatcatggctcaggacgaacgctggcggcgtgcctaacacatgcaagtcgaacgaggtccatccttcgggagaagacctagtggcgaacgggtgagtaacacgtgagaaacctgccccggagaccgggataaccgcctgaaaaggtggctaataccggatgtccccattccgccgcatggtggtttgaggaaatggattccgctccgggagggtctcgcggcctatcagctagttggtgaggtaacggctcaccaaggcgtcgacgggtagctggtctgagaggatgatcagccacactgggactgagacacggcccagactcctacgggaggcagcagtggggaatcttgcgcaatgggcgaaagcctggcgcagcaacgccgcgtgggggatgaaggctctcgggttgtaaacccctttcagcagggacgaattttgacggtacctgcagaagaagccccggctaactacgtgccagcagc

SEQ ID NO: 3461 - DNA, 486 bp, Unknown
  Ascusbbf_384010, encodes 16S rRNA
agagtttgatcatggctcagaatgaacgttggcggcatggattaggcatgcaagtcgtgcgcgaagctcccttcggggagtggaaagcggcgaaagggagagtaacacgtgggtatctgcctccaggtctggaatagcggcgggaaactgccggtaatgccagatgacatctccggatcaaagctccggcgcctggagaggggcccgcgtcctattagcttgttggcggggtaatggcccaccaaggctatgatgggtactgggtgtgagagcatgacccagctcactgggactgagatactgcccagacacctacgggtggctgcagtcgagaatcttcggcaatgggcgcaagcctgaccgagcgatgccgcgtgcgggatgaaggccttcgggttgtaaaccgctgtcgtaggggaggaaatagcaatttgaccgatcctaggaggaagtccgggctaagttcgtgccagcagccgcggtaat

SEQ ID NO: 3462 - DNA, 490 bp, Unknown
  Ascusbbf_1565875, encodes 16S rRNA
agagtttgatcctggctcagattgaacgctggcggcatgcttaacacatgcaagtcgaacggcagcacggtctagcttgctagactggtggcgagtggcgaacgggtgagtaacgcgtaggaatatgccttaaagtgggggacaacttggggaaactcaagctaataccgcataatatcttcggattaaagctagggaccttcgggcctggcgctttaagattagcctgcgtacgattagctagttggtggggtaagggcctaccaaggcgacgatcgttagctggtctgagaggatgaccagccacactggaactgagacacggtccagactcctacgggaggcagcagtggggaatattggacaatgggggcaaccctgatccagcaatgccgcgtgtgtgaagaaggcctgagggttgtaaagcactttcagtggggaggagggtttataggttaagagctagtaaactggacgttacccacagaag

SEQ ID NO: 3463 - DNA, 490 bp, Unknown
  Ascusbbf_1586953, encodes 16S rRNA
agagtttgatcatggctcaggacgaacgctggcggcgtgcctaacacatgcaagtcgaacggggtagagagcttcggttttctacttagtggcgaacgggtgagtaacgcgtgaagaacctgccttccagtgggggacaacagttggaaacgactgctaataccgcatgacacttctgaggggcatcccttagaagtcaaagctttatgtgctggaagatggcttcgcgtctgattagctagatggcggggtaacggcccaccatggcgacgatcagtagccggtctgagaggatgaacggccacattgggactgagatacggcccagactcctacgggaggcagcagtggggaatattgggcaatgggggaaaccctgacccagcaacgccgcgtgaaggaagaaggccttcgggttgtaaacttcttttaccagggacgaaggacgtgacggtacctggagaaaaagcaacggctaactacgtgccag

SEQ ID NO: 3464 - DNA, 490 bp, Unknown
  Ascusbbf_1512103, encodes 16S rRNA
agagtttgatcatggctcaggatgaacgctggcggcgtgcctaatacatgcaagtcgaacgatgaagttccttcgggaacggattagtggcgaacgggtgagtaacacgtgaacaatctacctctttgactgggataccaatctgaaaagattgctaataccggataggtaccgggagggcatcctccttgtattaaagatgcgtttgcatcacattgagatgagttcacgtcgcattagttagttggtgaggtaacggcccaccaagacgatgatgcgtagccgatctgagaggatgaccggccacattgggactgagacacggcccagactcctacgggaggcagcagtagggaattttcggcaatgggcgcaagcctgaccgagcaacgccgcgtgaacgatgaaggtctttggattgtaaagttctgttacgagggaagaacagttggtataggaaatgatatcaacctgacggtacctcgccaga

SEQ ID NO: 3465 - DNA, 490 bp, Unknown
  Ascusbbf_1138143, encodes 16S rRNA
agagtttgatcctggctcaggatgaacgctggcggcgtgcctaacacatgcaagtcgaacggagtgtagacgctgtgcgaagaagtgcttgcacggattcaaacttgtctatacttagtggcggacgggtgagtaacgcgtggaaaacctgcctcatacagggggataacaggaagaaattcctgctaataccgcatgagcgcacgaagggacatccctatgtgtgaaaagattttatcggtatgagatggttccgcgtctgattagccagttggcggggtaacggcccaccaaagcgacgatcagtagccggcctgagagggcggacggccacattgggactgagacacggcccagactcctacgggaggcagcagtgggggatattgcacaatggaggcaactctgatgcagcgacgccgcgtgggtgaagaagttattcgtaatgtaaagccctatcagcagggaagataatgacggtacctgacta

SEQ ID NO: 3466 - DNA, 490 bp, Unknown
  Ascusbbf_1262580, encodes 16S rRNA
agagtttgatcatggctcaggatgaacgctagcggcaggcctaacacatgcaagtcgaggggtagaagttacttgcaactttgagaccggcgcacgggtgcgtaacgcgtatgcaatctaccttgtactatgggatagcccggagaaatccggattaataccgtatagaatagttaaatggcatcataagactattaaagatttatcggtacaagatgagcatgcgtcccattagttagttggtgtggtaacggcataccaagacgatgatgggtaggggtcctgagagggagatcccccacactggtactgagacacggaccagactcctacgggaggcagcagtgaggaatattggtcaatggaggcaactctgaaccagccatgccgcgtgcaggaagaatgtcctatggattgtaaactgcttttgtacgggaagaaaaagtgttacgtgtaacatattgacggtaccgtaagaataaggatcggc

SEQ ID NO: 3467 - DNA, 490 bp, Unknown
  Ascusbbf_136919, encodes 16S rRNA
agagtttgatcatggctcaggacaaacgctggcggcgtgcctaacacatgcaagtcgaacgaagcacattggaaagaggcttcggccaatggaaaatgtgacttagtggcggacgggtgagtaatgcatgagcaacctgccctggagagggggacaacagctggaaacggctgctaataccgcatgaagttgtcgggaggcatctcctgacaaccaaagatttatcgctctgggatgggctcatgtctgattagttagttggcggggtaacggcccaccaagactacgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttatcagggacgaagaaagtgacggtacctgatgaataagccacg

SEQ ID NO: 3468 - DNA, 486 bp, Unknown
  Ascusbbf_14409, encodes 16S rRNA
agagtttgatcctggctcagaacgaacgctggcggcatgcttaacacatgcaagtcgaacggtgttttctagtacttgtattaggaaacatagtggcaaacgggtgagtaacgcgtgggaatgtaccctttggtattgaataacgtctggaaacggacgctaatacaatataagctcgagagaggaaagagaaatcgctgaaggagtagcccgcgttagattaggtagttggtggggtaatggcctaccaagccaatgatctatagctggtctgagaggatgaacagccacattgggactgagacacggcccagactcctacgggaggcagcagtggggaatattggacaatgggggaaaccctgatccagcgatgccgcgtgagtgatgaaggtcttcggattgtaaagctcttttataggtgaagataatgacggtagcctatgaataagctccggctaactccgtgccagcagccgcggtaat

SEQ ID NO: 3469 - DNA, 490 bp, Unknown
  Ascusbbf_16976, encodes 16S rRNA
agagtttgatcctggctcagaacgaacgctggcggcaggcttaacacatgcaagttgaacgggatccttaagatagcttgctattttgaggtgagagtagcgcacgggtgagtaacacgtgggaacataccatttagtgtgggataacaattggaaacgattgataataccgcataagccctgagggggaaaggagagattcgctgaatgattggcccgcggaagattaggcagttggtggggtaaaggcctaccaaacctacgatctatagctggtctgagaggacgatcagccacattgggactgagacacggcccaaactcctacgggaggcagcagtgaggaatattgggcaatgggggcaaccctgacccagccatgccgcgtgagtgaagaaggttttcggattgtaaagctctttcggatgtgaagatgatgacggtagcatctaaagaagccccggcaaacttcgtgccagcagccgcggta

SEQ ID NO: 3470 - DNA, 470 bp, Unknown
  Ascusbbf_1514014, encodes 16S rRNA
agagtttgatcatggctcagagcgaacgctggcggcaggcttaacacatgcaagtcgaacgcatccttcggggtgagtggcagacgggtgagtaacacgtgggaacgtacctctttgtacggaatagcttttggaaacgaaaggtaataccgtatacgcccttttggggaaagatttatcgcagagagatcggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaat

SEQ ID NO: 3471 - DNA, 490 bp, Unknown
  Ascusbbf_1754037, encodes 16S rRNA
agagtttgatcatggctcaggacgaacgctggcggcgtgcctaatacatgcaagtggaacgcatgattgatactgtagcttgctacaccattaatcatgagtcgcgaacgggtgagtaacgcgtaggtaacctgcctactagcgggggataactattggaaacgatagctaataccgcataagagtttttaacacatgttagaaatttaaaaggagcaaatgcttcactagtagatggacctgcgttgtattagctagttggtaaggtaacggcttaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgttgagtagagtggaaagttactcaagtga

SEQ ID NO: 3472 - DNA, 490 bp, Unknown
  Ascusbbf_375412, encodes 16S rRNA
agagtttgatcatggctcaggatgaacgctggcggcgtgcctaacacatgcaagtcgaacggggacgtcccgccgttgaagcttcggcagagacatgggacatcctagtggcggacgggtgagtaacgcgtgggcaacctgccctgtactgggggatagcagctggaaacggctggtaataccgcataagcgcacagtgtcgcatgacacagtgtgaaaagctccgacggtacaggatgggcccgcgtccgattagccagttggcggggtaacggcccaccaaagcgacgatcggtagccggcctgagagggcggacggccacattgggactgagacacggcccagactcctacgggaggcagcagtgggggatattgcacaatggggggaaccctgatgcagcgacgccgcgtgggtgaagaagtatttcggtatgtaaagccctatcggcagggacgacgatgacggtacctgactaagaagccccgg

SEQ ID NO: 3473 - DNA, 490 bp, Unknown
  Ascusbbf_718119, encodes 16S rRNA
agagtttgatcctggctcaggatgaacgctagcggcaggcctaatacatgcaagtcgagcggtaagttgcggagtaatccaagacctagagcggcgtacgggtgcgtaacgcgtatgcaacctacctcatacagggggatagcccggagaaatctggattaataccccatagcacagcacaagggcatctgcgagctgttaaagattcatcggtatgagatgggcatgcgtctgattagctagttggcggtgtaacggaccaccaaggcgacgatcagtaggggttctgagaggaaggtcccccacactggcactgagatacgggccagactcctacgggaggcagcagtagggaatattgggcaatggacgagagtctgacccagccatgccgcgtgcaggaagacggcgttctgcgttgtaaactgcttttatctgggaagaaaaagtccatgcgtggaaaattgccggtaccagatgaataagcacc

SEQ ID NO: 3474 - DNA, 361 bp, Unknown
  Ascusbbf_520815, encodes 16S rRNA
agagtttgatcatggctcaggacgaacgctggcggcgtgcctaacacatgcaagtcgaacggagtgaaagtagcttgctactggaacttagtggcggacgggtgagtaacacgtgagtaacctgcctttcagaggggaataatgtctggaaacggacactaataccgcataacatattttgatcgcatgattgagatatcaaaggagcaatccgctgaaagatggactcgcgtctgattagccagttggcggggtaacggcccaccaaagcgacgatcagtagccggactgagaggttgaacggccacattgggactgagacacggcccagactcctacgggagccagcagccgcggtaat

SEQ ID NO: 3475 - DNA, 490 bp, Unknown
  Ascusbbf_99105, encodes 16S rRNA
agagtttgatcatggctcagattgaacgctggcggcaggcctaacacatgcaagtcgagcggtaacagagagaagcttgcttctctgctgacgagcggcggacgggtgagtaatgcctgggaaattgccctgatgtgggggataaccattggaaacgatggctaataccgcatgatgctttcgagccaaagagggggaccttcgggcctctcgcgtcaggatatgcccaggtgggattagctagttggtggggtaaaggctcaccaaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccttcgggttgtaaagtactttcagtggtgaggaagggagtgtggttaatagccatattctttgacgttagccacagaag

SEQ ID NO: 3476 - DNA, 490 bp, Unknown
  Ascusbbf_316195, encodes 16S rRNA
agagtttgatcctggctcaggacgaacgctggcggcgtgcctaatacatgcaagtcgagcgaactctggtaactgaacgatggtgcttgcaccggagtgatgatacatttgagtgagcggcggatgggtgagtaacacgtgggtaacctgccctaaagtgggggataacatctggaaacaggtgctaataccgcataacaacatttaccacatggtttatgtttgaaagatggttctgctatcgctttaggatggacccgcggcgtattagctagttggtgaggtaacggctcaccaaggcagtgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcgtgagagta

SEQ ID NO: 3477 - DNA, 490 bp, Unknown
  Ascusbbf_461051, encodes 16S rRNA
agagtttgatcatggctcaggacgaacgctggcggcgtgcctaacacatgcaagtcgagcggagccaatcgacggagcccttcggggcaaagatgaggaagcttagcggcggacgggtgagtaacgcgtgagtaacctgcccataagagggggataacacagagaaatttgtgctaataccgcatacagagtgaataccgcatggtgaacacttgaaagatttatcgcttatggatggactcgcgtctgattagatagttggtgaggtaacggctcaccaagtcgacgatcagtagccgaactgagaggttgatcggccacattgggactgagacacggcccagactcctacgggaggcagcagtgggggatattgcgcaatggggggaaccctgacgcagcaacgccgcgtgaaggaagaaggccttcgggttgtaaacttttgttgcaagggaagaaagaaatgacggtaccttgtgaggaagccacg

SEQ ID NO: 3478 - DNA, 470 bp, Unknown
  Ascusbbf_229391, encodes 16S rRNA
agagtttgatcatggctcagagcgaacgctggcggcaggcttaacacatgcaagtcgaacgggcacttcggtgtcagtggcagacgggtgagtaacacgtgggaacgtacctcttggttcggaacaacacagggaaacttgtgctaataccggataagcccttacggggaaagatttatcgccgagagatcggcccgcgtctgattagctagttggtagggtaacggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaat

SEQ ID NO: 3479 - DNA, 490 bp, Unknown
  Ascusbbf_1461923, encodes 16S rRNA
agagtttgatcctggctcaggatgaacgctagctacaggcttaacacatgcaagtcgaggggcagcgcagtgtagcaatacatgggcggcgaccggcgcacgggtgcgtaacgcgtatccaaccttcccgatactcttggatagccttccgaaagggagattaatacaagatggtgtttcactttcgcatgttattgaaactaaagatttatcggtatcggatggggatgcgtgacattagatagtaggcggggtaacggcccacctagtctacgatgtctaggggttctgagaggaaggtcccccacactggaactgagacacggtccagactcctacgggaggcagcagtgaggaatattggtcaatggtcggaagactgaaccagccaagtagcgtgaaggatgaaggttctatggattgtaaacttcttttatacgggaataaaacctcccacgtgtgggagcttgtatgtaccgtatgaataagc

SEQ ID NO: 3480 - DNA, 490 bp, Unknown
  Ascusbbf_402534, encodes 16S rRNA
agagtttgatcctggctcaggatgaacgctagctacaggcttaacacatgcaagtcgaacggagtagcaatactcagtggcaaacgggtgagtaacacgtatccaacctaacctctactcgggtatagcctttcgaaaggaagagtaatccctgatgttatatgtgattcacatgcattgcatatcaaagatttatcggtagagggtggggatgcgttccattagatagtcggcggggtaacggcccaccgagtcgatgatggataggggttctgagaggaaggtcccccacattggaactgcgacacggtccaaactcctacgggaggcagcagtgaggaatattggtcaatggccggaaggctgaaccagccaagtagcgtgaaggatgacggccctatgggttgtaaacttcttttttatgggaataacgatagtcacgtgtgactatgtgcatgtaccatacgaataaggatcggctaactccgtg

SEQ ID NO: 3481 - DNA, 490 bp, Unknown
  Ascusbbf_455155, encodes 16S rRNA
agagtttgatcctggctcagagtgaacgctggcggcgtggttaagacatgcaagtcgagcgagaacaaaagcgtagcaatacgtggatgagaaagcggcgaacgggtgcgtaacacgtaagcaacctgccctaaagacggggatagctcggggaaactcgaattaataccggatgtggttctttaacgcatgttaaagatactaaagcttgagatggcgctttaggaggggcttgcggcctatcagcttgttggtgaggtaaaggctcaccaaggcaaagacgggtagcgggtctgagaggacgatccgccacactggaactgagacacggtccagacacctacgggtggcagcagtttcgaatcattcacaatgggggaaaccctgatggtgcaacgccgcgtgagggatgacggccttcgggttgtaaacctctgtcacacaggactaaacgcgaggttcatagcctcgcttgaattaactgtgagag

SEQ ID NO: 3482 - DNA, 490 bp, Unknown
  Ascusbbf_1104790, encodes 16S rRNA
agagtttgatcctggctcaggatgaacgctagcgacaggcctaacacatgcaagtcgaggggcagcacaaagagtagcaatacttttggtggcgaccggcgcacgggtgagtaacacgtatgcaacctgcctgtaagcggggaataacccggagaaatccggactaataccgcataacactatgttttcgcatgggaatatagttaaacatttatggcttacagatgggcatgcgtatgattagctagttggtgaggtaacggctcaccaaggcaacgatcattaggggttctgagaggaaggtcccccacactggtactgagacacggaccagactcctacgggaggcagcagtgaggaatattggtcaatgggcgagagcctgaaccagccaagtcgcgtgaaggaagaatgtcctatggattgtaaacctcttttgcaggagaataaagtgcaccacgtgtggtgttttgtatgtaccctgcgaata

SEQ ID NO: 3483 - DNA, 490 bp, Unknown
  Ascusbbf_1027042, encodes 16S rRNA
agagtttgatcctggctcagattgaacgctggcggcatgctttacacatgcaagtcgaggggcagcgcgagggtagcaatactcttggcggcgaccggcggaagggtgcgtaacgcgtgagcaacatgcccgtatccgggagataaccgatggaaacgtcgactaatatcccataacaacaggtaagacatcttatttgtttgaaagtttcgatggatacggattggctcgcgtgacattagctagacggcggagtaacggcccaccgtggcgacgatgtctaggggttctgagaggaaggtcccccacactggaactgagacacggtccagactcctacgggaggcagcagtgaggaatattggacaatgggcggaagcctgatccagccatgccgcgtgcaggaataaggtcctatggattgtaaactgcttttgttgtggagcaataaggtctacgtgtagactgatgagagtacacagcgaataag

SEQ ID NO: 3484 - DNA, 490 bp, Unknown
  Ascusbbf_859807, encodes 16S rRNA
agagtttgatcctggctcagattgaacgctagcgggatgctttacacatgcaagtcgaacggcagcacagaggaacttgttccttgggtggcgagtggcggacgggtgagtaatgtatcggaacgtgcccagtagtgggggataactacgcgaaagcgtggctaataccgcatattctctacggaggaaagagggggatcatttgacctctcgctattggagcggccgatattagattagctagttggtggggtaacggcctaccaaggcagtgatctatagctggtttgagaggacgaccagccacactgggactgagacacggcccagactcctacgggaggcagcagtggggaattttcgacaatggggggaaccctgatcgagccatcccgcgtgtgggacgaaggccttcgggttgtaaaccacttttctcaacgaagaaaagtcttaggctaataccttaagatgctgacggtagttgaggaat

SEQ ID NO: 3485 - DNA, 490 bp, Unknown
  Ascusbbf_1169515, encodes 16S rRNA
agagtttgatcatggctcaggacgaacgctggcggcgcgcttaacacatgcaagtcgaacgaggtccatccagtcgcaagaccggtgaagacctagtggcgaacgggtgagtaacacgtgagaaacctaccccgaagaccgggataaccagccgaaaggctggctaataccggatgccttcataacgtcgaatggcgatttgaagaaatggattccgctttgggagggtctcgcggcctatcagcttgttggtgaggtaacggctcaccaaggcaacgacgggtagctgttctgagaggaagatcagccacactgggactgagacacggcccagactcctacgggaggcagcagtggggaatcttgcgcaatgggcgaaagcctgacgcagcgacgccgcgtgcgggaagacggccttcgggttgtaaaccgctttcagcagggacgaaattgacggtacctgcagaagaagctccggccaactacgtgc

SEQ ID NO: 3486 - DNA, 490 bp, Unknown
  Ascusbbf_1478940, encodes 16S rRNA
agagtttgatcctggctcaggacgaacgctggcggcgtgcttaacacatgcaagtcgaacgaagcacttacgacggaactcttcggagggaagatgtatttgactgagtggcggacgggtgagtaacgcgtgggtaacctgccccatagagggggacaacagttggaaacgactgctaataccgcatagtaaggaggaaccgcatgatttcttcttgaaagcattagtgctatgggatggacccgcgtctgattagctagttggtgaggtaacggcccaccaaggcgacgatcagtagccggcttgagagagtgaacggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagaagaatgacggtacctgactaagaagccccg

SEQ ID NO: 3487 - DNA, 490 bp, Unknown
  Ascusbbf_1154165, encodes 16S rRNA
agagtttgatcatggctcaggatgaacgctagcgacaggcttaacacatgcaagtcgaggggcagcgcgatggtagcaatactattggcggcgaccggcgcactggtgagtaacacgtatgcgacctgccccggacagggggataaacccgggaaactgggcctaataccccatatgccctaaggatgcatgtcctttgggtgaaagatccgtcggtccgggatgggcatgcggcgcattagcttgttggcggggtaacggcccaccaaggcgacgatgcgtaggggttctgagaggaaggtcccccacattggaactgagacacggtccaaactcctacgggaggcagcagtgaggaatattggtcaatggtcggaagactgaaccagccaagtagcgtgaaggatgactgccctacgggttgtaaacttcttttatgcgggaataaagtgccccacgcgtggggtattgcatgtaccgcgtgaataag

SEQ ID NO: 3488 - DNA, 490 bp, Unknown
  Ascusbbf_182001, encodes 16S rRNA
agagtttgatcatggctcagattgaacgctggcggcaggcttaacacatgcaagtcgagcggtaacagggggagcttgctccctgctgacgagcggcggacgggtgagtaatgcataggaatctgcccagtagtgggggatagcccggggaaacccggattaataccgcatacgccctttgggggaaagcaggggatcttcggaccttgcgctattggatgagcctatgtcggattagctagttggtggggtaaaggcctaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagtgaggaggaaaacctttgggttaatacccctgaggcttgacgttactcacagaagaa

SEQ ID NO: 3489 - DNA, 490 bp, Unknown
  Ascusbbf_1596826, encodes 16S rRNA
agagtttgatcatggctcagattgaacgctggcggcatgcctaacacatgcaagtcgaacggcagcgcggacttcggtctggcggcgagtggcggacgggtgaggaatacatgggaatctgcccagtcgtgggggataacgtagggaaacttacgctaataccgcatacgacggcgacgtgaaagtgggggaccgcaaggcctcacgcgattggatgagcccatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagcaatgccgcgtgggtgaagaaggccttcgggttgtaaagccctttttgtacgggaagaaagcttctgggttaataccccgggaggatgacggtaccgtaagaataagca

SEQ ID NO: 3490 - DNA, 490 bp, Unknown
  Ascusbbf_88122, encodes 16S rRNA
agagtttgatcctggctcaggattaacgctggcggcatgcctaatacatgcaaatcgaacgaagccttttggcttagtggtgaacgggtgagtaacacgtatccaatctacccttaagtttgggataactagtcgaaagattagctaataccggataataacattcacttgcatgagtgaatgtggaaagttgcgtttgcaacgcttttggatgagggtgcgacgtatcagatagttggtgaggtaacggctcaccaagtcattgacgcgtagctgtactgagaggtagaacagccacaatgggactgagacacggcccatactcctacgggaggcagcagtagggaatttttcacaatgggcgaaagccttatgaagcaatgccgcgtgaacgatgaaggtctataagattgtaaagttcttttatttgggaagaaccactaaaataggaaatgattttagtttgactgtaccatttgaataagtatcg

SEQ ID NO: 3491 - DNA, 490 bp, Unknown
  Ascusbbf_641783, encodes 16S rRNA
agagtttgatcctggctcaggatgaacgctagcgacaggcttaacacatgcaagtcgagggagaaggcgaagggaggcgactcccgaagccggacaccggcgcacgggtgagtaacacgtatgcaacctgcccccggcaggggaataaccggaagaaattccgactaatgccgcgtatactccggaggggcatccctccggggggaaagctgaggcggccggggatgggcatgcgggccattagctagtcggcggggtaacggcccaccgaggcaacgatggctaggggttctgagaggaaggtcccccacactggtactgagacacggaccagactcctacgggaggcagcagtgaggaatattggtcaatgggcggaagcctgaaccagccaagtcgcgtgagggaagaaggtcctaaggattgcagacctcttttgccggggagcaacgggcgttctgaggggcgccgtgagagtacccggagaaaa

SEQ ID NO: 3492 - DNA, 481 bp, Unknown
  Ascusbbf_240904, encodes 16S rRNA
agagtttgatcctggctcagaacgaacgctggcggcaggcctaacacatgcaagtcgaacgaggtgctttcttcggaaagttacctagtggcggacgggtgcgtaacacgtgggaatctaccttatagtggggaataacttctggaaacgggagctaataccccatacgcccttcgggggaaagatttatcgctataagatgagcccgcggtggattaggtagttggtgaggtaaaggctcaccaagccgatgatccatagctggtttgagagaatgaccagccacactgggactgagacacggcccagactcctacgggaggcagcagtggggaatcttagacaatgggggcaaccctgatctagccatgccgcgtgagtgaagaaggccttagggttgtaaagctctttcacctgtgaggataatgacagtagcaggataagaaggaccggctaactccgtgccagcagccgcggtaat

SEQ ID NO: 3493 - DNA, 490 bp, Unknown
  Ascusbbf_1340910, encodes 16S rRNA
agagtttgatcctggctcaggatgaacgctggcggcatgcctaagacatgcaagtcgaacgaagtggcccattgaatatggagtacttgtacaaaatatgatttggaatttccacttagtggcagacgggtgagtaacacgtaagtaacctaccttaaagactgggataacgtttggaaacgaaagctaataccagataattcatttttagaaaactagaaatgctaaaagaagcgtttgcttcactttaagatgggcttgcggcgtattaactagttggtggggtaatgtcctaccaagggggcggatgggtcgccgggcggagaggcacatcggccgcattgagactgagacacggcccaaactcctacgggaggcagcagttaggaatattcgtcaatgggggaaaccctgaacgagcaatgccgcgtgagtgatgacggtcttatagattgtaaaactctgttgtaaaggaagaaccctcactata

SEQ ID NO: 3494 - DNA, 490 bp, Unknown
  Ascusbbf_1323707, encodes 16S rRNA
agagtttgatcctagctcaggacgaacgctggcggcatgcttagcacatgcaagtcgaacggactgattccttcgggatgaaagttagtggcgaacgggtgagtaatgtatgagcaacctgcctctatcaacgggataacagttggaaacgactgctaatacggtataagaccacggcaccgcatgatgctgcggtaaacgatttttcggataaatatgggctcatatcccattagctagttggtgagataacagcccaccaaggcgtggatgggtagcagagctgagaggctgatcggccccattgggactgaaaaccggcccagactcctacgggaggcagcagtggggaatattgggcaatggaggcaactctgaaccagcaatgccgcgtgagtgatgaaggtaattttattgtaaagctcttttcccaggaacgaataaagatgacggtacctgaggaataagccccggctaactacgtgccagc

SEQ ID NO: 3495 - DNA, 490 bp, Unknown
  Ascusbbf_594162, encodes 16S rRNA
agagtttgatcctggctcaggacgaacgctggcggcgtgcctaatacatgcaagtcgaacggtttagttccaagaggcttgccttttggaactagacagtggcggacgggtgagtaacacgtaggcaacctacctgtcaaaccgggataacctcgggaaaccgaagctaaacccggataagctcctttttcgcatgaagggggagtgaaaaggtgcgacctgatgacagatgggcctgcggcgcattagctagtaggtagggtaacggcctacctaggcgatgatgcgtagccgacctgagagggcgtacggccacactgggactgagatacggcccagactcctacgggaggcagcagtagggaatcttcggcaatgggcgaaagcctgaccgagcaacgccgcgtgagtgaggaaggccttcgggttgtaaaactctgttgtttgggaagaagggaaagggtaggacccttaggtgacggtaccaaac

SEQ ID NO: 3496 - DNA, 474 bp, Unknown
  Ascusbbf_502443, encodes 16S rRNA
agagtttgatcctggctcagagtgaacgctggcggcatgcttaacacatgcaagtcgcacggtcggcttcggtcggcagtggcggacgggtgaggaacgcgtagggatgtgtccaggggtgggggataacgttgggaaactgacgctaataccgcatgtgatctgaggatcaaagccttcgggcgccattggagcaacctgcgtccgattaggtagttggtggggtaatggcctaccaagcctccgatcggtagctggtctgagaggacgaccagccacactgggactgagacacggcccagactcctacgggaggcagcagtggggaatattggacaatgggcgcaagcctgatccagcaatgccgcgtggatgaagaaggtcttcggattgtaaagtcctttcgacggggacgatgatgacggtacccgtagaagaagccccggctaacttcgtgcgagcagccgcggtaat

SEQ ID NO: 3497 - DNA, 490 bp, Unknown
  Ascusbbf_1764731, encodes 16S rRNA
agagtttgatcctggctcaggatgaacgctggcggcgtacgtaacacatgcaagttgagcgacgacgtttctgaagtggcaacatggaagggacgagcggagcggcggacgggtgagtaagacatgagaagctgtcctgtggcgggggacaacgtctggaaacggacgctaataccccgtaagccgaaaggtgaaagcagcaatgcgccatgggaggtgctcgtggcctatcagctagttggtgaggtaatggctcaccaaggctacgacgggtagccggcctgagagggtgaccggccacactgggactgagatacggcccagactcctacgggaggcagcagtggggaatattgggcaatgggagagatcctgacccagcgacgccgcgtgaatgacgaaggccttcgggtcgtaaagttcttttatgtgggaagaagaaagtgacggtaccacatgaataagccccggctaactacgtgccagcagc

SEQ ID NO: 3498 - DNA, 490 bp, Unknown
  Ascusbbf_617399, encodes 16S rRNA
agagtttgatcctggctcaggatgaacgctggcggcgtgcctaatacatgcaagtcgaacgagagcgtccttcgggacaatctagtggcgaacgggtgagtaacacgtaggtaacctgccttaaagttgggaataacagttggaaacgactgctaataccgaataggtaattggaaggcatcttctaattattaaaggtccttcgggactgctttaggagggacctgcgctgcattagttagttggtgaggtaacggctcaccaagaccgtgatgcatagccggactgagaggttgaacggccacactgggactgagacacggcccagactcctacgggaggcagcagtagggaatcttcggcaatggggggaaccctgaccgagcaacgccgcgtgaatgaagaagcacttcggtacgtaaaattcttttattagggaagaatgtatgctagaggaaatgctagtatagtgacggtacctaatgaataa

SEQ ID NO: 3499 - DNA, 490 bp, Unknown
  Ascusbbf_617500, encodes 16S rRNA
agagtttgatcctggctcaggatgaacgctggcggcgtgcttaacacatgcaagtcgaacggagtattccgcccgaggattgaagaagcttgctttggattgactcaactgggatacttagtggcggacgggtgagtaacgcgtgggtaacctaccttacacagggggataacagttagaaatgactgctaataccgcataagcgcacaggatcgcatgattcagtgtgaaaaactccggtggtgtaagatggacccgcgtctgattagctggttggtgaggtaacggcccaccaaggcgacgatcagtagccggcctgagagggtgaacggccacattggaactgagacacggtccaaactcctacgggaggcagcagtggggaatattgcacaatgggggaaaccctgatgcagcgacgccgcgtgagtgaagaagtatttcggtatgtaaagctctatcagcagggaagatcatgacggtacctgac

SEQ ID NO: 3500 - DNA, 490 bp, Unknown
  Ascusbbf_555877, encodes 16S rRNA
agagtttgatcctggctcagattgaacgctggcggcaggcttaatacatgcaagtcgaacggtaacagtaagagagtttactcttttagctgacgagtggcggacggatgagtaatacctggggagctgcctggatgagggggataccttctggaaacggaagctaataccgcataaaccctgaggggaaaagggagcaatcccgcattcagatgcgcccagatgggattaggcagttggggaggtaacggctcaccaaaccgatgatctctagctggtttgagaggacaatcagccacattggaattgagaaacggaccaaactcctacgggaggcagcagtggggaatattgcacaatgggggaaaccctgatgcagccatgccgcgtgtgtgaagaaggccttcgggttgtaaagcacttttgcattcgaggaagacagcgcgtaaataaacgcgttatttgacgttagagtgtgaataagcaccgg

SEQ ID NO: 3501 - DNA, 490 bp, Unknown
  Ascusbbf_1878032, encodes 16S rRNA
agagtttgatcctggctcaggatgaacgctggcggcgtgcctaacacatgcaagtcgagcgagaaatcttagaacgaaacttcggtctagtgaagagatggaaagcggcggacgggtgagtaacgcgtaggcaacctgccccatacagagggatagcctcgggaaaccgggattaaaacctcataacaccaaaagtccacatggacctttggccaaagatttatcggtatgggatgggcctgcgtctgattagctagttggtggggtaacggctcaccaaggcaacgatcagtagccgacctgagagggtaatcggccacattggaactgagacacggtccaaactcctacgggaggcagcagtggggaatattgcacaatgggcgaaagcctgatgcagcaacgccgcgtgagcgaagaaggcctttgggtcgtaaagctctgtcctaggggaagaaaaaaatgacggtacccttggaggaagccccgg

SEQ ID NO: 3502 - DNA, 470 bp, Unknown
  Ascusbbf_336309, encodes 16S rRNA
agagtttgatcatggctcagaacgaacgctggcggcatgcttaacacatgcaagtcgaacgttatcttcggatggcgtggcggacgggtgagtaacacgtgggaacctgcccagaggtacgggataacccagggaaacttgggacaataccgtatgtgacctgagggtgaaagatttatcgcctttggatgggcccgcgtcggattaggtagttggtggggtaaaggcctaccaagccgacgatccgtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcacccacgacgatgatgacggtagtgggagaagaagccccggctaacttcgtgccagcagccgcggtaat

SEQ ID NO: 3503 - DNA, 490 bp, Unknown
  Ascusbbf_1587887, encodes 16S rRNA
agagtttgatcctggctcaggacgaacgctggcggcgtgcctaatacatgcaagtcgagcggagaatttggagcttgctccagattcttagcggcggacgggtgagtaacacgtgggcaacctgccctgcagatcgggataactccgggaaaccggtgctaataccgaatagtttgtttcacctcctggtgaaacacggaaagacggtttcggctgtcactgcaggatgggcccgcggcgcattagctagttggtggggtaacggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggtttttggatcgtaaaactctgttgtgagggaagaacaagtaccaactaactactggtaccttgacggtacctca

SEQ ID NO: 3504 - DNA, 490 bp, Unknown
  Ascusbbf_1500211, encodes 16S rRNA
agagtttgatcatggctcagaacgaacgctggcggcatggattaggcatgcaagtcgaacgctcatcttcggatgggagtggcggaagggtgaggaacacgtgaataatctgcccccaagtttggaataactttccgaaaggaaagctaataccgaatgtggttgatttaccgcatggtgaatcaactaaagatttattgcttggggatgagttcgcgtcccattagctagttggtgaggtaacggctcaccaaggccgagatgggtagctggtctgggaggatgatcagccacactgggactgagacactgcccagactcctacgggaggctgcagtcgagaatcttttgcaatgcgcgaaagcgtgacaaagcaatgccgcgtgccggatgaaggtcttcggattgtaaacggctgtcacccgtgacgaaaaatgacggtaacgggagaggaagccacggctaactccgtgccagcagccgcggtaat

SEQ ID NO: 3505 - DNA, 490 bp, Unknown
  Ascusbbf_1883198, encodes 16S rRNA
agagtttgatcctggctcagagttaacgctggcagcgtgcataacacatgcaagtcgaacggggattaccggtgtagcaatacattggttaattctagtggcagacgggtgagtaatacatagggaatccacctagaagtggggaataactagttgaaagattagctaataccccataatataagaactcggcatcgggttcttcttaaaggtttttcgcttctagacgatcctatggtctatcagcttgttggtagggtaacggcctaccaaggctacgacggatagccggcctgaaagggcgaccggccacaggggcactgagacacgggccccactcctacgggaggcagcagtggggaattttggacaatggacgaaagtctgatccagcaacgctgcgtgaaggacgaaggttttcggattgtaaacttcttttgcaggggaagaaaaaaatgacggtaccctgtgaataagccacggctaacta

SEQ ID NO: 3506 - DNA, 490 bp, Unknown
  Ascusbbf_1496571, encodes 16S rRNA
agagtttgatcatggctcaggacgaacgctggcggcgtgcctaatacatgcaagtcgagcggagttatgaaggagcttgctccagattaacttagcggcggacgggtgagtaacacgtaggcaacctgcccctatgactgggataactaccggaaacggtagctaataccggataatctcttccttctcctgagggaagaatgaaaggcggagcaatctgccgcttggggatgggcctgcggcgcattagctagttggcggggtaacggcccaccaaggcgacgatgcgtagccgacctgagagggtgaacggccacactgggactgagacacggcccagactcctacgggaggcagcagtagggaatcttccgcaatgggcgacagcctgacggagcaacgccgcgtgagtgatgaaggttttcggatcgtaaagctctgttgccagggaagaacgtccggtagagtaactgctgccggagtgacggta

SEQ ID NO: 3507 - DNA, 488 bp, Unknown
  Ascusbbf_602868, encodes 16S rRNA
agagtttgatcatggctcagaacgaacgctggcggcaggcttaacacatgcaagtcgaacgccccgcaaggggagtggcagacgggtgagtaacgcgtgggaatctacctagttctacggaacaacagttggaaacgactgctaataccgtatacgccctacgggggaaagatttatcggaattagatgagcccgcgtgagattagctagttggtggggtaatggcctaccaaggcgacgatctctagctggtctgagaggatgatcagccacactgggactgagacacggcccagactcctacgggaggcagcagtgaggaatattggtcaatggacgagagtctgaaccagccaagtagcgtgcaggatgacggccctatgggttgtaaactgcttttatacagggataaagtgcactacgtgtagtgttttgtaggtactgtatgaataaggaccggctaattccgtgccagcagccgcggtaat

SEQ ID NO: 3508 - DNA, 490 bp, Unknown
  Ascusbbf_1097911, encodes 16S rRNA
agagtttgatcatggctcaggacgaacgctggcggcgtgcttaacacatgcaagtcgaacgggatccattggtgcttgcactgatggtgagagtggcgaacgggtgagtaatacgtgacgaacctgcctcatactttggaatagctcctggaaacgggtggtaatgccgaatgatccgattctccgcatggggggttgggaaagtgttagcggtatgagatggtgtcgcgtcctatcagcttgttggtggggtagtggcctaccaaggcgttgacgggtagccggcctgagagggtgaccggccacattgggactgagatacggcccagactcctacgggaggcagcagtggggaatattgcgcaatggacgaaagtctgacgcagcgacgccgcgtgcgggatgacggccttcgggttgtaaaccgcttttaatagcgagcaagcgtaagtgagtttaactattgaataaggaccggctaactacgtgc

SEQ ID NO: 3509 - DNA, 490 bp, Unknown
  Ascusbbf_321315, encodes 16S rRNA
agagtttgatcctggctcaggatgaacgctagctacaggcttaacacatgcaagtcgaggggcagcatggagtcagcttgctgactttgatggcgaccggcgcacgggtgcgtaacacgtatccaatctacccatggctcagggatagcctttcgaaagaaagattaatacctgatggtcttacggagagacatctctctgtaagtaaagatttatcggcgatggatgaggatgcgtccgattaggtagtaggcggggtaacggcccaccaaggcgacgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttgttagggacgaaaaatgacggtacctaacgaataagctccggctaactacgt

SEQ ID NO: 3510 - DNA, 468 bp, Unknown
  Ascusbbf_1543740, encodes 16S rRNA
agagtttgatcctggctcagaatgaacgctggcggcaggcctaacacatgcaagtcgagcgacccgcaaggggagcggcaaacgggtgagtaacacgtgggaatctaccttacagtttggaatagccccgggaaactgggagtaataccaaatacggtctacggacgaaagatttatcgctgtaagatgagcccgcgttagattagctagttggtgaggtaatggctcaccaaggctacgatctatagctggtttgagaggatgatcagccacattgggactgagatacggcccaaactcctacgggaggcagcagtgaggaatattggacaatgggcgaaagcctgatccagccatgccgcgtgtgtgatgaaggccctagggttgtaaagcacttttagcagggaagataatgacggtacctgcagaaaaagccccggctaactccgtgccagcagccgcggtaat

SEQ ID NO: 3511 - DNA, 490 bp, Unknown
  Ascusbbf_892407, encodes 16S rRNA
agagtttgatcctggctcaggacgaacgctggcggcgtgcctaacacatgcaagtcgagcggggtatatttttcggaatatacttagcggcggacgggtgagtaacgcgtgaggaatctgccctatacagaggaatagcctcgggaaaccgggattaaaaccacataacactttagtatcgcatggtacataagtcaaattgaattagaggtataggatgagctcgcgtctgattagctagttggtgaggtaatggctcaccaaggcgacgatcagtagccggcctgagagggtgaacggccacactggaactgagacacggtccagactcctacgggaggcagcagtggggaatattgtacaatggaggaaactctgatgcagcgacgccgcgtgagtgaagaaggtcttcggatcgtaaaactctgtccttggtgaagataatgacggtagccaaggaggaagccccggctaactacgtgccagcagc

SEQ ID NO: 3512 - DNA, 488 bp, Unknown
  Ascusbbf_564442, encodes 16S rRNA
agagtttgatcctggctcagggtgaacgctagcggtgcgcctaacacatgcaagtcgagcgggagtatttattagcttgctaatagatatgagagcggcgaacgggtgagtaacacgttggtacatgcccccaagtcagggatagcctagtgaaaactagattaataccggatagtctctttggagtaaaaatttattgcttggggagtggcctgcgttctatcagctagttggtgaggtaatagctcaccaaggctatgacggataactggtctgagaggatgatcagtcacaatggaactgagacacggtccatactcttacgggaggcagcagtgaggaatcttccacaatggacgaaagtctgatggagcgacaccgcgtgaaggatgaaggtctaacgattgtaaacttcttttctgaaggagcataatgagagtactttaggaataagggacggctaaatatgtgccagcagccgcggtaat

SEQ ID NO: 3513 - DNA, 490 bp, Unknown
  Ascusbbf_515722, encodes 16S rRNA
agagtttgatcctggctcaggatgaacgctagctacaggcttaacacatgcaagtcgaggggcatcatggcggttgcttgcaaccgctgatggcgaccggcgcacgggtgagtaacgcgtatccaacctgcccctgtcctcgggatagcccgccgaaaggcggattaataccggatgctgtcacaagacgacatcagattgtgacgaaaggtttttttccggacagggatggggatgcgtccgattaggcaggcggcggggcaacggcccaccgcgccgacgatcggtaggggttctgagaggaaggtcccccacattggaactgagacacggtccaaactcctacgggaggcagcagtgaggaatattggtcaatgggcgatggcctgaaccagccaagtagcgtgagggacgacggccctacgggttgtaaacctctttttcgcggggataaaatgcgggacgtgtcccgccttgcaggtaccgcgtg

SEQ ID NO: 3514 - DNA, 490 bp, Unknown
  Ascusbbf_289457, encodes 16S rRNA
agagtttgatcatggctcaggatgaacgctggcggcgtgcttaacacatgcaagtcgaacgaagcagcgggaacgaagttttcggactgagatcctgctgacttagtggcggacgggtgagtaacgcgtggataacctgccgtatgcagggggacaacagctggaaacggctgctaataccgcataagcgcacagatgcgcatgcatcagtgtgaaaagtcttggcggcatacgatggatccgcgttggattaggtagttggcggggtaagggcccaccaagccgacgatccatagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggct

SEQ ID NO: 3515 - DNA, 344 bp, Unknown
  Ascusbbf_627979, encodes 16S rRNA
agagtttgatcatggctcagaacgaacgctggtggcgtgtcttatacatgcaagtcgagcgaggcagcaatgcctagcggcgaacgggtgagtaacgcgtaagcaatctgccccatatcaggaaatacccgtgccaacgcgcggttgatgtccaggagcgtggcttcccgcatgggatgttgacaagagatttatcggtatgggatgagcttgcgtccgattagctagttggcggggcaacggcccaccaaggcgacgatcggtagccggcctgagagggtgatcggccacattgggactgagatacggcccagactcctacgggagccagcagccgcggtaat

SEQ ID NO: 3516 - DNA, 490 bp, Unknown
  Ascusbbf_650321, encodes 16S rRNA
agagtttgatcatggctcaggataaacgctggcggcgcacataagacatgcaagtcgaacggaagtcgtaggaaaatggattgaagatttatcagattgaagtttttttacaatggctttagtggcggactggtgagtaacgcgtgagcaacctgcctattagaggggaataacagtgagaaatcattgctaataccgcatatgctcacagtatcacatgatacagtgaggaaaggagtaatccgctaatagatgggctcgcgtctgattagctagttggtggggtaacggcttaccaaggcgacgatcagtagccggactgagaggttgaacggccacattgggactgagatacggcccagactcctacgggaggcagcagtcgggaatattgcgcaatggaggaaactctgacgcagtgacgccgcgtatgggaagaaggttttcggattgtaaaccattgtcgttagggaagaagaagtgacagtac

SEQ ID NO: 3517 - DNA, 490 bp, Unknown
  Ascusbbf_335012, encodes 16S rRNA
agagtttgatcatggctcaggatgaacgctggcggcgtgcttaacacatgcaggtcgaacgaagctcctgaagctgaatcttcggaagaagcggaaggatgactgagtggcggacgggtgagtaacgcgtggggaacctgcccgaaagagggggacaacagttggaaacgactgctaataccgcataagccgacgaggtcgcatgagtttgtcggaaaaggagcaatccgctttcggatggccccgcgtctgattagccggttggcggggtaacggcccaccaaagcgatgatcagtagccggactgagaggttgaacggccacattgggactgagacacggcccaaactcctacgggaggcagcagtggggaatattgcacaatggagggaactctgatgcagcgacgccgcgtgagtgaagaagtgtttcggcatgtaaagctctatcatcggggaagaagatgacggtacccgaataagaagccccg

SEQ ID NO: 3518 - DNA, 490 bp, Unknown
  Ascusbbf_627541, encodes 16S rRNA
agagtttgatcctggctcagaacgaacgctggcagcgtggattaggcatgcaagtcgaacgggatccgggtgatagcaatattatctggtgagagtggcggattggggaggagcacgtgagcaacctgccctggagatgtggaaaacctctggaaacggaggctaatacagaatgtggcgtccgatggcatcatcggcgcgccgaagggggccgcaaggctcccgctccgggatgggctcgcgcaccatcagctagttggcggggtaacggcccaccaaggcctacggttagctggtctgggaggatgaccagccccactgggactgagatactgcccagactcctacgggaggctgcagtcgaggatcattcgcaatgggcgaaagcctgacgatgcgacgctgcgtggaggatgaaggccttcgggtcgtaaactcctgtcatgggggaagaggcgaggggacccaacacgtcccttagttgactgta

SEQ ID NO: 3519 - DNA, 490 bp, Unknown
  Ascusbbf_498239, encodes 16S rRNA
agagtttgatcatggctcagattgaacgctggcggcaggcctaacacatgcaagtcgagcggcagcggaaagtagcttgctactttgccggcgagcggcggacgggtgagtaatgtctgggaaactgcccgatggagggggataaccactggaaacggtggctaataccgcataacgtcttcggaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggtagtgtcttaatacggcattacattgacgttactcgcagaag

SEQ ID NO: 3520 - DNA, 490 bp, Unknown
  Ascusbbf_1484817, encodes 16S rRNA
agagtttgatcctggctcaggatgaacgctggcggcgtgcttaacacatgcaagtcgaacgaagctcctgaagcagagatttcggtcaaagcggagggaagacttagtggcggacgggtgagtaacgcgtgggtaacctgccatatacagggggataacagttagaaatgactgctaataccccataagcgcacagcgaggcatctcgcagtgtgaaaagccgagacggtatatgatggacccgcgtctgattagctagttgggagggtaacggcctaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagcatttcggtgcgtaaagctctatcagcagggaagaaaatgacggtacctgactaagaagccccggc

SEQ ID NO: 3521 - DNA, 490 bp, Unknown
  Ascusbbf_392533, encodes 16S rRNA
agagtttgatcctggctcagaacgaacgctggcggcgtgcttaatacatgcaagtcgaacgtgattcccgagcaatcgggatgaaagtggcgaacgggtgagtaacacgtaagtaatctgcctctaagattgggataaccctgccaacgcggggctaataccggatgtggtcccgccaacgcatgttggcgggattaaaggagcaatccgcttagagatgaacttgcggcccattagtttgttggtgaggtaacggcccaccaagactgagatgggtagccggcctgagagggtggacggccacattgggactgagatacggcccagactcctacgggaggcagcagtagggaattttgcgcaatggacgaaagtctgacgcagcaacgccgcgtgaaggatgaaggccttcgggttgtaaacttctgttggatgggaaaaaaatcccgcaagggactgatggtaccattcgagtaagcaccggctaact

SEQ ID NO: 3522 - DNA, 490 bp, Unknown
  Ascusbbf_532232, encodes 16S rRNA
agagtttgatcctggctcaggatgaacgctagctacaggcttaacacatgcaagtcgaggggtagcaggatctagcaatagattgctgacgaccggcgcacgggtgagtaacacgtatccaaccttccgtttactcggggatagcctttcgaaagaaagattaatacccgatagtatgtttcttccgcatgggagaaccattaaagtttttcggtaatcgatggggatgcgttccattaggcagttggtgaggtaacggctcaccaaaccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaaggagcctacgtgtaggtttttgtatgtaccatacgaataagga

SEQ ID NO: 3523 - DNA, 490 bp, Unknown
  Ascusbbf_493246, encodes 16S rRNA
agagtttgatcatggctcagattgaacgctagcgggatgctttacacatgcaagtcgaacggtagcacgaagaaagcttgctttctttggtgacgagtggcgaacgggtgagtaatgtatcggaacgtacccagtagcgggggataactacgcgaaagcgtggctaataccgcatacgccctacgggggaaagggggggatcgcaagacctctcactattggagcggccgatatcggattagctagttggtggggtaaaggcctaccaaggcaacgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcagagaagaaacggcctgggctaataccctgggctaatgacggtatctgcaga

SEQ ID NO: 3524 - DNA, 490 bp, Unknown
  Ascusbbf_232911, encodes 16S rRNA
agagtttgatcatggctcagattgaacgctggcggcatgctttacacatgcaagtcgaacggcagcacgggagcttgctcctggtggcgagtggcggacgggtgagtaatacatcggaacatgccctgtagagggggataactgaacgaaagttcagctaataccgcatgagacctgagggtgaaagctggggactgagaggcctagcgctacaggattggccgatggctaattagctagttggtggggtaatagcttaccaaggcgacgattagtagctggtctgagaggatgatcagccacactgggactgagacacggcccagactcctacgggaggcagcagtggggaattttggacaatgggcggaagcctgatccagctatgccgcgtgagtgaagaaggccttcgggttgtaaagctctttcggttgggaagaagtttgcgtgtttaagagatatgtgaattgacggtaccgacagaagaagc

SEQ ID NO: 3525 - DNA, 490 bp, Unknown
  Ascusbbf_271110, encodes 16S rRNA
agagtttgatcctggctcaggatgaacgctggcggcgtgcctaacacatgcaagtcgaacggagcttatggtgaaagatacttcggtagatggaagcgtaagcttagtggcggacgggtgagtaacgcgtggagaacctgccctgtaccgggggataacagagggaagcttctgctaataccgcataagcgcacggcaccgcatggtgcagtgtgaaaaactccggtggtacaggatggctccgcgttggattagcttgttggcggggcaacggcccaccaaggcgacgatccatagccggcctgagagggtgaacggccacattgggactgagacacggcccagactcctacgggaggcagcagtggggaatattgcacaatggggggaaccctgatgcagcgacgccgcgtgaaggaagaagtatctcggtatgtaaacttctatcagcagggaagacaatgacggtacctgcataagaagccccggc

SEQ ID NO: 3526 - DNA, 363 bp, Unknown
  Ascusbbf_1608761, encodes 16S rRNA
agagtttgatcctggctcagaacgtacgctggcggcgcgtcttaagcatgcaagtcgagcgggaataagggagcttgcttccttatgagagcggcggactggtgagtaacacgtgggtaacgcaccctcctgacggggacagcctgtggaaacacagggtaataccggatgagatggacttctggaagggagttcatgaaaggagctacggctccgcagggggaacggcccgcggcccatcagctggttggcggggaaaaggcccaccaaggcgatgacgggtatccggcctgagagggtgaacggacacattgggactgagatacggcccagactcctacgggagccagcagccgcggtaat

SEQ ID NO: 3527 - DNA, 490 bp, Unknown
  Ascusbbf_1858857, encodes 16S rRNA
agagtttgatcatggctcaggacgaacgctggcggcatgcctaatacatgcaagtcgagcgaacagatgaagtgcttgcacttctgacgttagcggcgaacgggtgagtaacacgtaaggaatctacctataagcgggggataacattcggaaacgggtgctaataccgcataatatcttcttccgcatggaagaagattgaaagacggctctgctgtcacttatagatgaccttgcggtgcattagttagttggtggggtaacggcctaccaagacgatgatgcatagccgacctgagagggtgatcggccacattgggactgagacacggcccaaactcctacgggaggcagcagtagggaatcttccgcaatgggcgaaagcctgacggagcaatgccgcgtgagtgaagaaggccttcgggtcgtaaaactctgttataagagaagaacaaattgtagagtaactgctacagtcttgacggtatct

SEQ ID NO: 3528 - DNA, 490 bp, Unknown
  Ascusbbf_703905, encodes 16S rRNA
agagtttgatcctggctcaagacgaacgctggcggcgtgcctaacgcatgcaagtcgagcggagatgctggggtctgagaggggaaactcttgaaggctttagcatcttagcggcggacgggtgagtaacacgtgagcaacctaccctcagcacggggataacagctcgaaagggctgctaatacccgatgggaccacggcatcgcatggtgctgtggtgaaagggtagccggagaggctataccggctggggatgggctcgcggcccatcagctagttggtggggtaacggcctaccaaggcgacgacgggtagccggcctgagagggtgtacggccacagtgggactgagacacggcccacactcctacgggaggcagcagcggggaatcttgcgcaatgggcgaaagcctgacgcagcgacgccgcgtgagggaagaagcccttcggggtgtaaacctctttggacggggagaagaggaagatagta

SEQ ID NO: 3529 - DNA, 490 bp, Unknown
  Ascusbbf_1333661, encodes 16S rRNA
agagtttgatcatggctcaggacgaacgctggcggcgtgcctaaaacatgcaagtcgaacgaggcccacccagtggcaacactggtgacgacctagtggcgaacgggtgagtaacacgtgaggaacctgccccgaagaccgggataaccctccgaaaggagagctaataccggatgtccccaccagatcgcatggtccggtgaggaaatgcttttgtgcttcgggagggcctcgcggcctatcagctagttggtgaggtcacggctcaccaaggcaacgacgggtagctggtctgagaggacgatcagccacactgggactgagacacggcccagactcctacgggaggcagcagttaggaatcttgcgcaatgggcgaaagcctgacgcagcaacgccgcgtgggggatgaaggccctcgggttgtaaacccctttcagtggggacgaacacagacggtacccacagaagaagcaccggccaactacgt

SEQ ID NO: 3530 - DNA, 468 bp, Unknown
  Ascusbbf_1209759, encodes 16S rRNA
agagtttgatcatggctcagaacgaacgctggcggcaagcttaacacatgcaagtcgaacgccccgcaaggggagtggcggacgggtgcgtaacacgtgggaatctgcctttaggtaaggaataacttgaggaaacttaagctaataccttataatgtctttggaccaaagatttatcgcctaaagatgagcccgcggtagattagctagttggtggggtaatggcctaccaaggcaacgatctatagctggtcttagaggatgatcagccacactgggactgagacacggcccagactcctacgggaggcagcagtggggaatattgggcaatgggcgaaagcctgacccagctatgccgcgtgaatgatgaaggccttagggttgtaaagttcttttaccagggaagatgatgactgtacctggagaaaaagctccggctaacttcgtgccagcagccgcggtaat

SEQ ID NO: 3531 - DNA, 490 bp, Unknown
  Ascusbbf_1473116, encodes 16S rRNA
agagtttgatcatggctcaggacgaacgctggcggcgtgcctaacacgtgcaagtcgagcggagccaattaacagatcccttcggggtgacgttgaggaagcttagcggcggacgggtgagtaacgcgtgagtaacctgcctgtaagagggggataacacagagaaatttgtgctaataccgcatattgagtattaatcgcatggttgatacttgaaagatttatcgcttacagatggactcgcgtctgattagctggttggtgaggtaacggctcaccaaggcgacgatcagtagccgaactgagaggttgatcggcaacattgggactgagacacggcccagactcctacgggaggcagcagtgggggatattgcgcaatgggggaaaccctgacgcagcaacgccgcgtgatggaagaaggcctacgggttgtaaacatctgttgcaagggaagaaacaaatgacggtaccttgtgaggaagccacg

SEQ ID NO: 3532 - DNA, 490 bp, Unknown
  Ascusbbf_196220, encodes 16S rRNA
agagtttgatcatggctcagattgaacgctggcggcatgctttacacatgcaagtcggacggcagcacagagaagcttgcttcttgggtggcgagtggcgaacgggtgagtaacgcatcggaacataccgagtagtgggggataactgtccgaaaggatggctaataccgcatacgctttgagaaggaaagcgggggctcttcggacctcgcgctattcgagcggccgatgtctgattagctggttggtggggtaaaggcctaccaaggcgacgatcagtagcgggtctgagaggatgatccgccacactgggactgagacacggcccagactcctacgggaggcagcagtggggaattttggacaatgggggcaaccctgatccagccatgccgcgtgtctgaagaaggccttcgggttgtaaaggacttttgtcagggaagaaaagctgcgggttaataccccggggtgatgacggtacctgaagaat

SEQ ID NO: 3533 - DNA, 488 bp, Unknown
  Ascusbbf_68359, encodes 16S rRNA
agagtttgatcatggctcagaacgaacgctggcggcaggcttaacacatgcaagttgaacgggatttcagagtagcttgctattttggatgagagtggcgcacgggtgagtaatacgtgggaacatacctattggtgggggataacgctgggaaactggtgctaataccgcataagccctacgggggaaagattaattgccgatagaatggcccgcggcagattaggcagttggtggggtaaaggcctaccaaaccgacgatctgtagctggtctgagaggacgatcagccacattgggactgagacacggcccagactcctacgggaggcagcagtgaggaatattgggcaatgggggcaaccctgacccagccatgccgcgtgagtgaagaaggttttcggattgtaaagctctttcgggagagaagatgatgacggtatctccagaagaagccccggcaaacttcgtgccagcagccgcggtaat

SEQ ID NO: 3534 - DNA, 490 bp, Unknown
  Ascusbbf_421239, encodes 16S rRNA
agagtttgatcatggctcaggatgaacgctggcggcgtgcctaacacatgcaagtcgaacgaagcactttcccggaaccttcgggtgaaggggctgtgactgagtggcggacgggtgagtaacgcgtgggtaacctgccctgtacagggggataacagtcagaaatgactgctaataccgcataagcgcactgaggtagcattaccttgtgtgaaaaactccggtggtacaggatgggcccgcgtctgattagcttgttggcggggtaaaggcccaccaaggcgacgatcagtagccggtctgagaggatgaacggccacattggaactgagacacggtccaaactcctacgggaggcagcagtggggaatattgcacaatggggggaaccctgatgcagcaacgccgcgtgggtgaagaagtatttcggtatgtaaagccctatcagcagggaagataatgacggtacctgactaagaagctccggcta

SEQ ID NO: 3535 - DNA, 490 bp, Unknown
  Ascusbbf_295492, encodes 16S rRNA
agagtttgatcatggctcaggacgaacgctggcggcgtgcctaacacatgcaagtcgaacgagaatctaacgacggagttttcggacaactgagttagaggaaagtggcggactggtgagtaacgcgtgagcaacctgcctttcagagggggacaacagttggaaacgactgctaataccgcataacatatgcttaaggcatctttagcatatcaaaggagcaatccgctgaaagatgggctcgcgtctgattagatagttggcggggcaacggcccaccaagtcgacgatcagtagccggactgagaggttgaacggccacattgggactgagatacggcccagactcctacgggaggcagcagtggggaatattgggcaatggacgcaagtctgacccagcaacgccgcgtgaaggaagaaggctttcgggttgtaaacttcttttaagagggacgaaggacgtgacggtacctcttgaataagccac

SEQ ID NO: 3536 - DNA, 490 bp, Unknown
  Ascusbbf_634490, encodes 16S rRNA
agagtttgatcatggctcaggatgaacgctggcggcgtgcttaacacatgcaagtcgaacggagctgattgaacggagattcgtcaaagtttaagaaagcttagtggcggacgggtgagtaacgcgtgggtaacctgcctcatagagggggataacagttggaaacgattgctaataccgcataagcccacagtaccgcatggtacagagggaaaagaatttatcgctatgagatggacccgcgtttgattagttagttggcggtgtaacggaccaccaagacgacgatcaatagccggactgagaggttgaacggccacattgggactgagacacggcccaaactcctacgggaggcagcagtggggaatattgcacaatgggggaaaccctgatgcagcgacgccgcgtgagtgaagaagtttttcggaatgtaaagctctatcagcagggaagaagaaagacggtacctgactaagaagccccggct

SEQ ID NO: 3537 - DNA, 490 bp, Unknown
  Ascusbbf_369078, encodes 16S rRNA
agagtttgatcatggctcaggacgaacgctggcggcgcgcctaacacatgcaagtcgaacggactttatggaaactgaggcttcggcggacgaagaagtaaagttagtggcgaacgggtgagtaacacgtgaggaaccaacctttcagagggggataacacttagaaataggtgctaataccgcataagaccacactgaggcatctcagaggggtcaaaggagcaatccgctgaaagacggcctcgcgtccgattaggtagttggtgaggtaacggcccaccaagcctacgatcggtagccggactgagaggttgatcggccacattgggactgagacacggcccagactcctacgggaggcagcagtggggaatattgggcaatgggggaaaccctgacccagcgacgccgcgtgagggaagaaggttttcggattgtaaacctctgtcttcggggaagataatgacggtacccgaggaggaagccacg

SEQ ID NO: 3538 - DNA, 470 bp, Unknown
  Ascusbbf_199170, encodes 16S rRNA
agagtttgatcatggctcagaacgaacgctggcggcaggcctaacacatgcaagtcgagcgcggtacttgtaccgagcggcagacgggtgagtaacacgtgggaatctacctatcggtggggaataacttcgggaaactgaagctaataccgcatacgccctgagggggaaagatttatcgccgatagatgagcccgcgtctgattagctagttggtaaggtaaaggcttaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaat

SEQ ID NO: 3539 - DNA, 490 bp, Unknown
  Ascusbbf_362567, encodes 16S rRNA
agagtttgatcctggctcagattgaacgctagcgggatgctttacacatgcaagtcgaacggcagcgcgaagaaagcttgctttctttggcggcgagtggcggacgggtgagtaatgcatcggaatgtgcccagtagcgggggataactactcgaaagagtggctaataccgcatattctctacggaggaaagagggggatcttcggacctctcactactggagcagccgatgtcagattagctagttggtggggtaaaggcctaccaaggcaatgatctgtagctggtttgagaggacgaccagccacactgggactgagacacggcccagactcctacgggaggcagcagtggggaattttggacaatggggggaaccctgatccagccatcccgcgtgtatgatgaaggccttcgggttgtaaagtacttttgacagggaagaaacgacaccacctaatacgtggtgttaatgacggtacctgtaga

SEQ ID NO: 3540 - DNA, 490 bp, Unknown
  Ascusbbf_1510234, encodes 16S rRNA
agagtttgatcatggctcagaatgaacgttggcggcgtggattaggcatgcaagtcgtgcgagaagctccttcgggagtggacagcggcgaaagggagagtaacgcgtggttacatgccctcgggaccgggatagtagcgggaaactgctagtaataccggataatatctttggatcaaaggtgtgattccgcctgaggattggactgcgttctattagcttgttggtgtggtaatggctcaccaaggctgcgatggataccgggtgtgagagcatggcccggctcactgggactgagacactgcccagacacctacgggtggctgcagtcgagaatcttcggcaatgggggaaaccctgaccgagcgacgccgcgtgcgggatgaaggccttcgggttgtaaaccgctgtcagttgggaggaaatgccagggggctatccccttggcttgaccgatcttcagaggaaggacgggctaagttcgtgccag

SEQ ID NO: 3541 - DNA, 488 bp, Unknown
  Ascusbbf_324043, encodes 16S rRNA
agagtttgatcatggctcagaacgaacgctggcggcaggcttaacacatgcaagtcgagcgccccgcaaggggagcggcagacgggtgagtaacgcgtgggaatctacccatctctacggaataactcagggaaacttgtgctaataccgtatacgcccttcgggggaaagatttatcggagatggatgagcccgcgttggattagctagttggtgaggtaaaggctcaccaaggcgacgatccatagctggtctgagaggaaggtcccccacattggaactgagacacggtccaaactcctacgggaggcagcagtgaggaatattggtcaatggacgaaggtctgaaccagccaagtagcgtgcaggatgacggccctatgggttgtaaactgcttttatacagggataaagtcgggaacgtgttcccgtttgcaggtactgtatgaataaggaccggctaattccgtgccagcagccgcggtaat

SEQ ID NO: 3542 - DNA, 490 bp, Unknown
  Ascusbbf_1484556, encodes 16S rRNA
agagtttgatcctggctcaggacgaacgctggcggcgtgcctaatacatgcaagtcgaacgagtttacttttaatgaaggcggtgcttgcaccaactgatttaaaaataaacgagtggcggacgggtgagtaacacgtgggtaacctaccctaaagtgggggataacatttggaaacagatgctaataccgcataatattaaaaaccacatggtttttaattgaaagacggcgtaagctgtcacttttggatggacccgcggcgtattagctagttggtgaggtaacggctcaccaaggcgatgatacgtagccgacctgagagggtgatcggccacattgggactgagacacggcccaaactcctacgggaggcagcagtagggaatcttccacaatggacgaaagtctgatggagcaacgccgcgtgagtgaagaaggttttcggatcgtaaaactctgttattggagaagaacgtatttggtagtaa

SEQ ID NO: 3543 - DNA, 490 bp, Unknown
  Ascusbbf_593604, encodes 16S rRNA
agagtttgatcctggctcagattgaacgctggcagcaggcctaatacatgcaagtcgaacggtaacataagaaaagcttgcttttcttgatgacgagtggcggacgggtgagtaacatttgggaaactacctgatagagggggacaacagttggaaacgactgctaataccgcatacagcctaagggtgaaagaagcaattcgctatcagatgtgcccaaacgggattagctagtaggtgaggtaaaggctcaccaaggcgacgatcagtaggggttctgagaggaaggtcccccacattggtactgagacacggaccaaactcctacgggaggcagcagtgaggaatattggtcaatgggcgcaagcctgaaccagccaagtagcgtgcaggatgactgccctatgggttgtaaactgcttttatacggggataaagtcagagtcgtgactctgtttgtaggtaccgtatgaataaggaccggctaatt

SEQ ID NO: 3544 - DNA, 490 bp, Unknown
  Ascusbbf_1762086, encodes 16S rRNA
attgatcatggctcagaacgaacgctggcggcgtgcttaatacatgcaagtcgaacgtgattttcgtagcaatacgggatgaaagtggcgaacgggtgagtaacacgtaagtaatctgccttcaagtttgggataaccctgccaacgcggggctaataccggatgtggtccattagactcatgtttattggattaaaggtcgcaagaccgcttggagatgagcttgcggcccattagcttgttggtgaggtaacggctcaccaaggctttgatgggtagccggcctgagagggtgtacggccacattgggactgagatacggcccagactcctacgggaggcagcagtagggaattttgcgcaatggacggaagtctgacgcagcaacgccgcgtgaaggatgactgccttcgggttgtaaacttctgttggatgggaaaaaaagcccgggtgaccgggaattgatggtaccattcgagtaagcaccggc

SEQ ID NO: 3545 - DNA, 490 bp, Unknown
  Ascusbbf_1341604, encodes 16S rRNA
agagtttgatcatggctcaggacgaacgctggcggtgtgcttaacacatgcaagtggtgcgacgaaccaggcttcggcctgaggcaaagccgcgaacgggtgagtaacacgtgggtaatctgccccgatgactgggacaacccgaggaaactcgggctaataccggatgtggtgcctggacataagtctggtcactaaaggtagcttcggcttccgcattgggaggggcccgcggcccattagcttgttggtggggtcaaggcctaccaaggcaacgatgggtagctggtctgagaggacgaccagcaacactgtgacggcgacacggaccagactcctacgggaggcagcagtggggaatcttgcgcaatgcgcgaaagcgtgacgcagcaacaccgcgtgagggaagacggccttagggttgtaaacctctttcagatgggacgaaggttggccggtgaatagccgagataattgacggtaccgtcag

SEQ ID NO: 3546 - DNA, 480 bp, Unknown
  Ascusbbf_353173, encodes 16S rRNA
agagtttgatcctggctcagaacgaacgctggcggcaggcctaatacatgcaagtcgaacgatagatatccttcgggatattgacagtggcgcacgggtgagtaacgcgtgggaatatgccttttggtacggaataacccagggaaacttggactaataccgtatggtcccttcggggtaaagatttatcgccaaaagattagcccgcgttagattagctagttggtggggtaaaagcctaccaaggcgacgatctatagctggtctgagaggatgatcagccacactgggactgagacacggcccagactcctacgggaggcagcagtagggaatattggacaatgggcgaaagcctgatccagccatgccgcgtgagtgatgaaggccttcgggttgtaaagctctttcgctagtgaagataatgactgtaactagataagaagctccggctaacttcgtgccagcagccgcggtaat

SEQ ID NO: 3547 - DNA, 479 bp, Unknown
  Ascusbbf_401837, encodes 16S rRNA
agagtttgatcctggctcaggatgaacgctggcggcgtgcctaatacatgcaagtcgagcggtaaggcctcttcggaggtacacgagcggcggacggctgagtaacacgtaggaacgtaccccaaactgagggataactgctcgaaagagtagctaataccgcatgtgctctaaggagtaaagcttcggcggtttgggaacggcctgcgcatgattagcttgttggtgaggtaaaagctcaccaaggcgacgatcattagctggtctgagaggatgatcagccagactgggactgagacacggcccagactcctacgggaggcagcagtagggaattttccacaatgggtgtaagcctgatggagcaacgccgcgtgcaggatgaatgccttcgggttgtaaactgcttttatatgtgacgattatgacggtagcatatgaataaggatcggctaactccgtgccagcagccgggtaat

SEQ ID NO: 3548 - DNA, 490 bp, Unknown
  Ascusbbf_188713, encodes 16S rRNA
agagtttgatcatggctcaggatgaacgctggcggcgtgcgtaacacatgcaagttgagcgacgacgggactgaagtggagacatggaagtcttgagcggagcagcggacgggtgagtaagacatgagaagctgccctttggtgggggacaacgtttggaaacggacgctaataccccataggccgagaggttaaagccgagaggtgccaagggaggtgctcgtggcctatcagctagttggtgaggtaatggctcaccaaggcttcgacgggtagccggcctgagagggtgaccggccacactgggactgagatacggcccagactcctacgggaggcagcagtggggaatattgggcaatgggagagatcctgacccagcgacgccgcgtggacgaagaaggccttcgggtcgtaaagtccttttatgggggaagaaggaagtgacggtaccccatgaataagccccggctaactacgtgccagcagc

SEQ ID NO: 3549 - DNA, 490 bp, Unknown
  Ascusbbf_370188, encodes 16S rRNA
agagtttgatcatggctcagattgaacgctagcgggatgctttacacatgcaagtcgaacggcagcgcaagaaaagcttgcttttcttggcggcgagtggcgaacgggtgagtaatgtatcggaacgtgcctagtagcgggggataactacgcgaaagcgtggctaataccgcatacgccctacgggggaaagggggggatcgcaagacctctcactattagagcggccgatatcggattagctagttggtggggtaagagcctaccaaggcatcgatccgtagctggtttgagaggacgaccagccacactgggactgagacacggcccagactcctacgggaggcagcagtggggaattttggacaatgggggaaaccctgatccagccatcccgcgtgtgtgatgaaggccttcgggttgtaaagcacttttggcagggaagaaacagcgtcggataatacctggcgtgaatgacggtacctgcaga

SEQ ID NO: 3550 - DNA, 490 bp, Unknown
  Ascusbbf_328372, encodes 16S rRNA
agagtttgatcctggctcaggatgaacgctggcggcgtgcttaacacatgcaagtcgaacggagatgcagttaggaagttttcggatggaatgattgcatcttagtggcggacgggtgagtaacacgtaaacaatctgcctccaagagcgggataacagatagaaatatttgctaataccgcataagaccacggccccgcatggggcaggggtaaaaggggagcaatctcgcttggagatgagtttgcggactattagctagttggtgaggtaacggcccaccaaggcagagatggttagccgacctgagagggtgatcggccacactggaactgagacacggtccagactcctacgggaggcagcagtgaggaatattgggcaatggaggaaactctgacccagcaacgccgcgtgaaggaagaaggttttcggattgtaaacttctgttatggaggaaaaaggaagtgatggtactccatgagcaagc

SEQ ID NO: 3551 - DNA, 490 bp, Unknown
  Ascusbbf_520366, encodes 16S rRNA
agagtttgatcctggctcaggacgaacgctggcggcgtgcctaacacatgcaagtcgagcggagatcagggagtgcttgcacgagctgattttagcggcggacgggtgagtaacgcgtgagcaatctgtcctgcacagggggataacacttggaaacaggtgctaataccgcatgagaccacggtgccacatgacacaggggtcaaaggagaaatccggtgcagggtgagctcgcgtcccattagatagttggcggggtaacggcccaccaagtcgacgatgggtagccgacctgagagggtgatcggccacactgggactgagacacggcccagactcctacgggaggcagcagtggggaatattgggcaatgggcgcaagccttacccagcaacgccgcgtgagggaagaaggttttcggattgtaaacctctgtcctgggggacgaaggaagtgacggtaccccgggaggaagccccggctaactac

SEQ ID NO: 3552 - DNA, 487 bp, Unknown
  Ascusbbf_451185, encodes 16S rRNA
agagtttgatcatggctcagaacgaacgctggcggcaggcttaacacatgcaagttgaacgggaatctgaggtagcttgctaccgaggaggagagtagcgcactggtgagtaacacgtgggaacgtacattgtagtggggaacaacagagggaaacttctgctaataccgcatacgccctgagggggaaagatttatcgctatgatatcggcccgcggaagattaggtagttggtggggtaaaggcctaccaagcctacgatctatagctggtctgagaggacgatcagccacattggaactgagacacggtccagactcctacgggaggcagcagtgaggaatattgggcaatggaggaaactctgacccagccatgccgcgtgagtgagaaggttttaggattgtaaagctctttcgggcgagaagatgatgacggtatcgccagaagaagccccggcaaacttcgtgccagcagccgcggtaat

SEQ ID NO: 3553 - DNA, 490 bp, Unknown
  Ascusbbf_305498, encodes 16S rRNA
agagtttgatcctggctcagattgaacgctggcggcaggcttaacacatgcaagtcgaacgaggttagggagcttgctcctgatacctagtggcgaacgggtgagtaatgcttaggaatctgcctagtagtgggggataactatccgaaaggatagctaataccgcatacgacctacgggtgaaagggggcgcaagctctcgctattagatgagcctaagtcggattagctagttggtggggtaaaggcctaccaaggcgacgatctgtagctggtctgagaggatgatcagccacactgggactgagacacggcccagactcctacgggaggcagcagtggggaatattggacaatgggcgaaagcctgatccagccatgccgcgtgtgtgaagaaggccttttggttgtaaagcactttaagtagggaggaaaagctaatggttaatacccattagccctgacgttacctacagaataagcaccggct

SEQ ID NO: 3554 - DNA, 490 bp, Unknown
  Ascusbbf_396039, encodes 16S rRNA
agagtttgatcctggctcaggactaacgctggcggcgtgctttaaacatgcaagtcgaacggaggttaggtgttgcactaagcatttctatacggagtgtttagtgcaatgcttacccttagtggcggacgggtgagtaacgcgtgagtaatctacctttatctgggggacaacagttggaaacgactgctaataccgcataagaccacaggcacacaagtgctaggggtaaaagatttttcgaataaagatgagctcgcgtagcattagttagttggtgaggtaacggcccaccaagaccgtgatgcttagccgatctgagaggatgatcggccacactggaactgagatacggtccagactcctacgggaggcagcagttaggaatattgggcaatggaggcaactctgacccagcaacgccgcgtgaaggatgaaggtcctcggattgtaaacttctgtattagaggaagaagatagtgacggtact

SEQ ID NO: 3555 - DNA, 470 bp, Unknown
  Ascusbbf_1894312, encodes 16S rRNA
agagtttgatcatggctcagaacaaacgctggcggcaggcctaacacatgcaagtcgagcggtcccttcgggggcagcggcggacgggtgagtaacgcgtgggaacgtgccccttggtgtggaacaaccgctggaaacggcggctaatgccacatgatgtctacggaccaaagatttatcgccaagggatcggcccgcgttggattaggtagttggtggggtaatggctcaccaagccgacgatccatagctggtttgagaggatgatcagccacactgggactgagacacggcccagactcctacgggaggcagcagtggggaatcttggacaatgggggaaaccctgatccagccatgccgcgtgagcgatgaaggccttagggttgtaaagctctttcacccgtgaagataatgacggtagcgggagaagaagccccggctaactccgtgccagcagccgcggtaat

SEQ ID NO: 3556 - DNA, 490 bp, Unknown
  Ascusbbf_1683994, encodes 16S rRNA
agagtttgatcatgctcaggacgaacgctggcggcgtgccttagacatgcaagtcgaacgaagcacttatctccgatcatttcggtgtgaagagatctgtgacttagtggcgaacgggtgagtaacacgtgagtgacctgccccgaagtgcggcataacagggggaaacccttgctaattccgcatgtgctcccacctcttgtggtgtgagtaaagatttatcgcttcgggatgggctcgcggtccatcagctagttggtagggtaatggcctaccaaggcgacgacggatagccggcctgagagggtgtacggccacaggggcactgagatacgggccccactcctacgggaggcagcagttaggaatcttccacaatgggcgaaagcctgatggagcgacgccgcgtgagggacgaaggtctttggatcgtaaacctctaaaagtgggacgataatgacggcaccacttgaaaagcaccggctaactc

SEQ ID NO: 3557 - DNA, 490 bp, Unknown
  Ascusbbf_1257171, encodes 16S rRNA
agagtttgatcatggctcaggatgaacgctagcgacaggcttaacacatgcaagtcgaggggcagcggtgcgcagcaatgcgcagccggcgaccggcgcactggtgagtaacacgtatgcaacctgcccgtgcctgggggataaactggagaaatccggcctaataccccgtaagccgcgcgtccgcatggccgtgcggtgagaggagcgatccgtgcacggatgggcatgcggcgcattagctggttggcggggtgacggcccaccaaggcgacgatgcgtaggggttctgagaggaaggtcccccacactggtactgagacacggaccagactcctacgggaggcagcagtgaggaatattggtcaatggacggaggtctgaaccagccaagtcgcgtgtgggaagacggtcctatggattgtaaaccactttagccggggggcagcacgcgggacgcgtcccgcgccgagagtacccggagaataag

SEQ ID NO: 3558 - DNA, 490 bp, Unknown
  Ascusbbf_606159, encodes 16S rRNA
agagtttgatcctggctcagagtgaacgctggcggcgtggctaagacatgcaagtcgagcggttatatgctttcgggcatatgatagcggcaaacgggtgagtaacacgtaagcaacctacccttaagactgggatagcctgatgaaagttggggtaataccggatgaggagcattggtgcatgccaatggatctaaaggcatggaaaggcgcttaaggaggggcttgcggcctatcagctagttggtggtgtaacggaccaccgaggcgaagacgggtagccggtctgagaggacgaacggccacattggaactgagacacggtccaaacatctacggatggcagcagtttcgaattattcacaatgggcggaagcctgatggtgcgacgtcgcgtggaggaagaaggtctttggattgtaaactcctgtcattagggagcaaagtgcaagtgaagagcttgttttgagttaacctaaagaggaagcag

SEQ ID NO: 3559 - DNA, 490 bp, Unknown
  Ascusbbf_503636, encodes 16S rRNA
agagtttgatcctggctcaggatgaacgctggcggcgcgcctaacacatgcaagtcgaacggccggacccaccccggtgggcgaggcagtggcgaacggctgagtaacacgtgggcaacctgcccccctccccgggacagcctcgggaaaccgtgggtaataccggatactccgccccctccgcatgggaggggcgggaaagctccggcggggggggatgggcccgcggcctgttagctagttggcggggcagaggcccaccaaggcgacgatgcgtaggggttctgagaggaaggtcccccacattggtactgagacacggaccaaactcctacgggaggcagcagtgaggaatattggtcaatgggcgggagcctgaaccagccaagtcgcgtgagggaggaaggtcctacggattgtaaacctctttagccggggagcaacgtgcgccacgcgtggcgcagtgagagtacccggagaataagcatcg

SEQ ID NO: 3560 - DNA, 490 bp, Unknown
  Ascusbbf_698927, encodes 16S rRNA
agagtttgatcctggctcaggatgaacgctagcgataggcttaacacatgcaagtcgaggggcagcatggtcttagcttgctaagactgatggcgaccggcgcacgggtgcgtaacgcgtatgcaacttgccttacagagggggataacccgttgaaagacggactaacaccgcatatgctcaggggtctgcatgggcctttgaggaaatatttatagctgtaagataggcatgcgtcccattagcttgttggtgaggtaacggctcaccaaggcaacgatgggtaggggaactgagaggtttatcccccacactggtactgagacacggaccagactcctacgggaggcagcagtgaggaatattggtcaatgggcgagagcctgaaccagccaagtcgcgtgaaggatgaaggccctatgggtcgtaaacttcttttatacgggaataacgagccttacgggtagggcgctgaatgtaccgtaggaat

SEQ ID NO: 3561 - DNA, 490 bp, Unknown
  Ascusbbf_1643956, encodes 16S rRNA
agagtttgatcctggctcagattgaacgctggcggcatgcctaacacatgcaagtcgaacggcagcacggtctagcttgctagatgggtggcgagtggcgaacgggtgagtaacgcgtaggaatatgccttgaagagtgggacaacttggggaaactcaagctaataccgcataatgtctgaggacgaaagctggggaccttagggcctggcgcttcaagattagcctgcgtccgattagctagttggtggggtaaaggcctaccaaggcgacgatcggtagctggtctgagaggatgaccagccacactggaactgagacacggtccagactcctacgggaggcagcagtggggaatattggacaatggggggaaccctgatccagcaatgccgcgtgtgtgaagaaggcctgagggttgtaaagcactttcagtggggaggaggatatttaggttaagagctagaatattggacgttacccacagaag

SEQ ID NO: 3562 - DNA, 490 bp, Unknown
  Ascusbbf_1394049, encodes 16S rRNA
agagtttgatcctggctcaggatgaacgctggcggcaggcttaatacatgcaagttgaacggtaacatgattgtagcaatacgattgatgacgagtggcgtacgggtgcgtaacacgtgtgcaacctaccttatacaggaacaaaacgtcgagaaattggcgctaatattccataatgttattttgtggcatcacaagataattaaagctacggcggtataagatgggcacgcgtcccattagctagttggtaaggtaacggcttaccaaggcgacgatgggtaggggttctgagaggatacacccccacactggaactgagacacggtccagactcctacgggaggcagcagtaaggaatattggtcaatggaggcaactctgaaccagccatgccgcgtgcaggaagacggccttatgggttgtaaactgcttttattagaggataaatataggtacgtgtacttatttgcaggtatctaatgaataa

SEQ ID NO: 3563 - DNA, 490 bp, Unknown
  Ascusbbf_1732749, encodes 16S rRNA
agagtttgatcatggctcaggatgaacgctggcggagtgcctaatacatgcaagtcgagcggcaacatgcttctcaccaaggttcgaagcgggaataggaaatctaatccctttacttcgagctttcgtgagaagtgatggcgagcggcggacggctgagtaacgcgtgggaacgtgccccaaagtgaggaataactgcccgaaagggtagctaatgccgcatatggtcttcggattaaaggatttatccgctttgggagcggcccgcgtcagattaggttgttggtgaggtaatggctcaccaagccgacgatctgtagctggtctgagaggatgatcagccagactgggactgagacacggcccagactcctacgggaggcagcagtaaggaatcttccacaatggacgaaagtctgatggagcaactccgcgcgcaggatgaaggccttcgggttgtaaactgcttttatttgtgaagaatatgacg

SEQ ID NO: 3564 - DNA, 490 bp, Unknown
  Ascusbbf_1287997, encodes 16S rRNA
agagtttgatcctggctcaggatgaacgctggcggcgtgcttaacacatgcaagtcgaacgaagaggtgcgaaaggataggcttcggtcttgaattttgcacatatcttagtggcggacgggtgagtaacgcgtgggcaacctgccctttacaggggaataatcattggaaacgatgactaataccgcatgtcaccgtgaaacggcatcgttttacggaaaaaggattttatccggtaaaggatgggcccgcgtctgattagctggttggtggggtaacggcctaccaaggcgacgatcagtagccgacctgagagggtgatcggccacattgggactgagacacggcccaaactcctacgggaggcagcagtggggaatattgcacaatggggggaaccctgatgcagcaacgccgcgtgaaggaagaaggttttcggatcgtaaacttctatcaatagggacgaagaaaatgacggtacctaaataag

SEQ ID NO: 3565 - DNA, 490 bp, Unknown
  Ascusbbf_237917, encodes 16S rRNA
agagtttgatcatggctcaggacgaacgctggcggcgtgcctaacacatgcaagtcgaacggagctgtttcacgaaggtcttcggattggacgaggcagcttagtggcggacgggtgagtaacgcgtgagcaacctgcctttcagagggggacaacggttggaaacgaccgctaataccgcatgaagcaatcggaccgcatgatctgattgccaaagattttatcgctgaaagatgggctcgcgtctgattagatagttggtggggtaacggcctaccaagtcgacgatcagtagccggactgagaggttgaacggccacattgggactgagatacggcccagactcctacgggaggcagcagtggggaatattgggcaatgggggcaaccctgacccagcaacgccgcgtgaaggaagaaggctttcgggttgtaaacttcttttaccagggacgaagaacgtgacggtacctggagaaaaagccacgg

SEQ ID NO: 3566 - DNA, 480 bp, Unknown
  Ascusbbf_44270, encodes 16S rRNA
agagtttgatcatggctcagaacgaacgctgtcgacatgcttaacacatgcaagtcggacgggtataacttgttataccagtggcaaacgggtgagtaatacgtagaaatgtacccagtagtttcgaataacaactggaaacggttggtaatacgggataagatagagatatgaaaggtctgaaaggatcgctattggagcagtctacgatggattagatagttggtgaggtaaaggctcaccaagtcgaagatccatagctggtctgagaggatgaacagccacattgggactgagatacggcccagacttctacgggaggcagcagtggggaatattggacaatgggggaaaccctgatccagcgatgtcgagtgaatgaagaaggccttagggttgtaaaattcttttataagcgattaagaagaaagtaacttatgaataagctccggcaaacttcgtgccagcagccgcggtaat

SEQ ID NO: 3567 - DNA, 490 bp, Unknown
  Ascusbbf_203709, encodes 16S rRNA
agagtttgatcatggctcaggacgaacgctggcggcgtgcctaatacatgcaagtagaacgctgattactagagcttgctctggtatgatgagttgcgaacgggtgagtaacgcgtaggtaacctacctcttagcgggggataactattggaaacgatagctaataccgcataacagttttagtcgcatgactgagatttgaaaggcgcaactgcgtcactaagagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgttgtgtagagtggaaaattacacaagtgacggtatct

SEQ ID NO: 3568 - DNA, 490 bp, Unknown
  Ascusbbf_825562, encodes 16S rRNA
agagtttgatcatggctcaggacgaacgctggcggtgtgcctcatacatgcaagtcgaacgataaggcttcttcggaagtacataagtggcggacgggtgagtacaacataggaaatctgccttagggtgggggacaacagagggaaactcctgctaataccccatatgagctaacttgaaatagttatcttgaaaactccggtgccctaagatgagcctgtgcctgattagctggttggtggtgtaatggactaccaaggcgacgatcagtagctggtttgagaggatgatcagccacaatgggactgagacacggcccatactcctacgggaggcagcagtagggaattttgcgcaatgggggaaaccctgacgcagcaacaccgcgtgaatgttaagcccttcggggtgtaaagttctgtcagtagggaagaacaaatgcctttccctacaaaggaagcaccggctaactccgtgccagcagccgcg

SEQ ID NO: 3569 - DNA, 490 bp, Unknown
  Ascusbbf_148091, encodes 16S rRNA
agagtttgatcatggctcaggattaacgctggcggtacgtctaatacatgcaagtcgaacggacacttcggtgtcagtggcgaacgggtgagtaacacgtaggtaacctgcccttaagacggggataacttttggaaacgaaagctaataccggattgaaagtagaataggcatctattttatttaaaaggtcctttcggggactgcttaaggaggggcctgcggcgcattagttagttggtgaggtaatggctcaccaagacgatgatgcgtagctggactgagaggttgaacagccacactgggactgagaacggcccagactcctacgggaggcagcagtagagaatcttcggcaatggggggaaccctgaccgagcgataccgcgtgaatgaagaaatacttcggtatgtaaagttcttttatataggatgaatggtatgggtaggaaatgaccaataaatgacagtactatttgaataagccccg

SEQ ID NO: 3570 - DNA, 490 bp, Unknown
  Ascusbbf_647979, encodes 16S rRNA
agagtttgatcctggctcaggacgaacgctggcggcgggtttaatacatgcaagtcgagggacgaagtttggtgcttgcaccgaacggaaaccggcgaacgggtgagtaacacgtgagaaacctacccttcactttgggataacccaaggaaacttgggctaatactggatatcccggttggatcgcatgatccttccgggaaagctccggcggtgatggacggtctcgcggcctatcagcttgttggtgaggtaacggctcaccaaggcgacgacgggtagctggagtgagagctcgagcagccacactgggactgagacacggcccagactcctacgggaggcagcagtagaggatcttgcacaatgggcgaaagcctgatgcagccacgccgcgtgagggacgaatgtcttcggattgtaaacctctttcagtcgtgaagaagcgcaagtgacggtagcgacagaagaagccccggctaactacgtg

SEQ ID NO: 3571 - DNA, 490 bp, Unknown
  Ascusbbf_136593, encodes 16S rRNA
agagtttgatcctggctcaggatgaacgctggcggtatgcctaatacatgcaagtcgagcgggggacttcggtccctagcggcgaacgggtgagtaacacgttggtaatctacctttcagttggggatacccaggcgaaagcttggctaataccgtaatacgtattaagttgagatacttaatataaaaggcccttcggggtcgctgatagatgagcctgcgtctgattagctagttggtgagataatagcccaccaaggcgaggatcagtagccgacctgagagggtgatcggccacaatggaactgagacacggtccatactcctacgggaggcagcagtagggagtcttcgacaatgggggaaaccctgatcgagcaataccgcgtgagtgatgaaggtcttcggattgtaaagctcttttaattgggagaaataactagggtaggtaatgaccttagtttgatagtaccttttgaataagcaacga

SEQ ID NO: 3572 - DNA, 490 bp, Unknown
  Ascusbbf_175961, encodes 16S rRNA
agagtttgatcctggctcaggacgaacgctggcggcgtgcctaacacatgcaagtcgagcgagaagctcataaacgagccttcgggcaagtgagtgagtggaaagcggcggacgggtgagtaacgcgtgagtaatctgccttaaggagggggataacgcagagaaatctgcgctaataccgcataacacataactgttgcatgacagatatgtcaaaattccggtgccttaagatgagctcgcgtccgattagttagttggcggggtaaaggcccaccaagacgacgatcggtagccggactgagaggttgaacggccacattgggactgagacacggcccagactcctacgggaggcagcagtgggggatattgcgcaatggggggaaccctgacgcagcaacgccgcgtgaaggaagaaggtcttcggattgtaaacttttgtcttttgggacgaagaagtgacggtaccaaaggaggaagccacggc

SEQ ID NO: 3573 - DNA, 490 bp, Unknown
  Ascusbbf_580406, encodes 16S rRNA
agagtttgatcatggctcaggatgaacgctagctacagacttaacacatgcaagtcgaggggcagcatgatcttagcttgctaagattgatggcgaccggcgcacgggtgcgtaacgcgtatccaacctgccgtgtacacggggacagccctctgaaaggaggattaatacccgatgtggtccttggggggcatctcccggggactaaagatttatcggtacaccgatggggatgcgtacgattagcttgccggcggggtaacggcccaccggggcaacgatcgttaggggttctgagaggaaggtcccccacataggaactgagacacggtcctaactcctacgggaggcagcagtgaggaatattggtcaatgggcgcgagcctgaaccagccaagtagcgtgaaggatgactgccctacgggttgtaaacttcttttacgggagaataaagtgaggcacgcgtgccttattgcaggtatcccgtgaa

SEQ ID NO: 3574 - DNA, 490 bp, Unknown
  Ascusbbf_1726684, encodes 16S rRNA
agagtttgatcatggctcaggacgaacgctggcggcgtgcctaatacatgcaagtcgagcgagctgaattcaaagattccttcgggatgatttgttggacgctagcggcggatgggtgagtaacacgtgggcaatctgccctaaagactgggataccacttggaaacaggtgctaataccggataacaacatgaatcgcatgattcaagtttgaaaggcggcgtaagctgtcactttaggatgagcccgcggcgcattagctagttggtggggtaaaggcctaccaaggcaatgatgcgtagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatagaggcagtaactggtcttta

SEQ ID NO: 3575 - DNA, 490 bp, Unknown
  Ascusbbf_1500451, encodes 16S rRNA
agagtttgatcctggctcagattgaacgctggcggcaggcctaacacatgcaagtcgaacggcagcggggggtagcttgctaccctgccggcgagtggcggacgggtgagtaatgcctggggagctgcccaatcgagggggataccagttggaaacgactgctaataccgcatacgccctgagggggaaaggtggggatcttcggacctaccgcgattggatgcacccaggtgggattagctagttggtgaggtaacggctcaccaaggcgacgatctctagctggtctgagaggatgaccagccacactggaactgagacacggtccagactcctacgggaggcagcagtggggaatattgcacaatgggggaaaccctgatgcagccatgccgcgtgtgtgaagaaggccttagggttgtaaagcactttcagcgaggaggaaaggtggctagctaatacctggttgctgtgacgttactcgcagaag

SEQ ID NO: 3576 - DNA, 490 bp, Unknown
  Ascusbbf_656872, encodes 16S rRNA
agagtttgatcctggctcaggacgaacgctggcggcgtgcttcaaacatgcaagtcgaacgaggtaagaaggagcttgctcctgacgacctagtggcggacgggtgagtaacgcgtgagcaatctggctattacagggggataacacttagaaatgagtgctaataccgcgtatgaccacaacctggcatcaggaaggggtgaaaggagaaatccggtaatagatgagcttgcgtttcattagctagttggtgacggtaacggcgcaccaaggcgacgatgaatagccgatctgagaggatgaccggccacactggaattgagaaacggtccagactcctacgggaggcagcagttaggaatattgggcaatggagggaactctgacccagcaacgccgcgtgaaggaagaaggttttcggattgtaaacttctgatctatgggaagaagaaagtgacggtaccataggagaaagccacggctaactacg

SEQ ID NO: 3577 - DNA, 490 bp, Unknown
  Ascusbbf_1058542, encodes 16S rRNA
agagtttgatcatggctcaggatgaacgctggcggcgtgcctaacacatgcaagtcgaacgaagaccccgaggcagagatttcggtcgaagccaagggaggactgagtggcggacgggtgagtaacgcgtggataacctgccccatacagggggatagcagttggaaacgactgataataccgcataagcgcacggggagacatctctttgtgtgaaaagatttatcggtatgggatgggtccgcgtccgattagcaagatggcggggtaaaggcccaccaaagcgacgatcggtagccggcctgagagggcggacggccacattgggactgagacacggcccagactcctacgggaggcagcagtgggggatattgcacaatggggggaaccctgatgcagcgacgccgcgtgggtgaagaagtatttcggtatgtaaagccctatcagcagggaagaaagtgacggtacctgagtaagaagccccggc

SEQ ID NO: 3578 - DNA, 490 bp, Unknown
  Ascusbbf_163863, encodes 16S rRNA
agagtttgatcatggctcagaatgaacgttggcggcgtggattaggcatgcaagtcgcgcgatttccttcggggaagagcggcggaagggagagtaacgcgtagatacctaccctcgggaccggaatagcgacgggaaactgtcggtaatgccggataacgtccctggaccaaaggtgtgaatccgcctgaggaggggtctgcgtcctattagctagtcggcggggtaacggcccaccgaggcgaagatgggtaccgggcgtgagagcgtgacccggctcactgggactgagacactgcccagacacctacgggtggctgcagtcgagaatcttcggcaatgagcgcaagcttgaccgagcgacgccgcgtgcgggatgaaggctttcgggttgtaaaccgctgtcagtggggaggaaattcttgggggtactcccccttgattgaccgatccgcagaggaaggacgggctaagttcgtgccagcagccg

SEQ ID NO: 3579 - DNA, 490 bp, Unknown
  Ascusbbf_1896303, encodes 16S rRNA
agagtttgatcctggctcaggatgaacgctggcggcatgcctaacacatgcaagtcgaacggagttaaaagagcttgcttttttaacttagtggcggacgggtgagtaacgcgtgagcaatctgcctttcagtggggaataatgttctgaaaagagcactaataccgcataatgtataatcgccgcatgacggatataccaaagatttatcgctgagagatgagctcgcgtccgattagccggttggtggtgtaacggcctaccaaagctacgatcggtagccggactgagaggttgaacggccacattgggactgagacacgtcccagactcctacgggaggcagcagtgggggatattgcgcaatgggggaaaccctgacgcagcaatgccgcgtgaaggatgaaggtcttcggattgtaaacttcttttgtcagggacgaaaatgacggtacctgacgaataagctccggctaactacgtgccagca

SEQ ID NO: 3580 - DNA, 490 bp, Unknown
  Ascusbbf_692367, encodes 16S rRNA
agagtttgatcctggctcagaatgaacgctggcggtgtgcctaacacatgcaagtcgagcgagaaagcttcttcggaagtgagtacagcggcggacgggtgagtaacacgtaagaacctgccttttagtgaagaataccttcgagaaatcgaagttaatgctgcatacgtccctttggggagaaaagtggcttttatgctactgctgaaagatgggcttgcggactatcagcttgttggtggggtaaaggcctaccaaggctatgacggttagccgacctgagagggtgatcggccacattgggactgagacacggcccagactcctacgggaggcagcagtggggaatattgcgcaatgggcgaaagcctgacgcagcaacaccgcgtggaggatgaaggttttaggattgtaaactcctgttagttgggaagaaaagctcttttttaatacagaagagtcatgacggtaccagcagagaaagcaccgg

SEQ ID NO: 3581 - DNA, 490 bp, Unknown
  Ascusbbf_693280, encodes 16S rRNA
agagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaacctcggcatcgaggaaagatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaacagttagaagg

SEQ ID NO: 3582 - DNA, 469 bp, Unknown
  Ascusbbf_236864, encodes 16S rRNA
agagtttgatcatggctcagaacgaacgctggcggcaggcctaacacatgcaagtcgaacgagatcttcggatctagtggcgcacgggtgagtaacgcgtaggaatctacctattagttcgggataacagttggaaacgactgctaataccggatacgccctttgggggaaagaatttcgctaatagatgagccttcgtgacattaggtagttggtggggtaatggctcaccaagcctacgatgtctagctggtctgagaggatgatcagccacactgggactgagacacggcccagactcctacgggaggcagcagtggggaatattgggcaatgggcgcaagcctgacccagccatgccgcgtgagtgatgacggccttagggttgtaaagctctttcagtagcgaagatgatgacagtagctacagaagaagccccggctaacttcgtgccagcagccgcggtaat

SEQ ID NO: 3583 - DNA, 490 bp, Unknown
  Ascusbbf_545476, encodes 16S rRNA
agagtttgatcctggctcaggatgaacgctggcggcatgcctaagacatgcaagtcgaacgaggtggcccaaagaagatggagtgcttgcacaaagttggatttggaattaccacctagtggcagacgggtgagtaacacgtgggtaacctgcctctttgttggggataacagttggaaacgactgctaataccgaataagatactcgtatcgaaaggagcccttaaagcttcgcgaagagatgggcctgcggcgtattaactagttggtgaggtaatggctcaccaaggtaacgatgcgtagccggactgagaggtcgaacggccacactgggactgagacacggcccagactcctacgggagacagcagttaggaatattcgtcaatggaggaaactctgaacgagcaatgccgcgtgagtgatgaaggtctttggattgtaaaactctgttgtatggaaagaacagctaagttaggaaatgaactta

SEQ ID NO: 3584 - DNA, 490 bp, Unknown
  Ascusbbf_962534, encodes 16S rRNA
agagtttgatcatggctcagattgaacgctggcggcaggcctaatacatgcaagtcgaacggtaacataagaaaagcttgcttttcttgatgacgagtggcggacgggtgagtaacatttgggaaactacctgatagagggggacaacagttggaaacgactgctaataccgcatacagcctaagggtgaaagaagcaattcgctatcagatgtgcccaaacgggattagctagtaggtgaggtaaaggctcacctaggcgatgatctctagctggtctgagaggaaggccccccacactgggactgagacacggcccagactcctacgggaggcagcagtgaggaatattggtcaatggcggcaacgctgaaccagccaagtagcgtgagggatgacggccctacgggtcttaaacctcttttgttggggagcaaactgcgccactggtggcgtattgcgagtacccttcgaataagcatcggctaact

SEQ ID NO: 3585 - DNA, 490 bp, Unknown
  Ascusbbf_450141, encodes 16S rRNA
agagtttgatcatggctcaggatgaacgctagcgggaggcctaacacatgcaagccgagcggtagattgtcttcggataattgagagcggcgtacgggtgcggaacacgtgtgtaacctgcccttatcaaggggatagcccagagaaatttggattaataccctataatacaagatgtggcatcataacttgttaaaaaccacggtggataaggatgggcacgcgcaagattagctagttggtgaggtaacggctcaccaaggcgacgatctttagggggcctgagagggtgatcccccacactgggactgagacacggcccagactcctacgggaggcagcagtgaggaatattggacaatgggtggaagcctgatccagccatcccgcgtgaaggaagacggttctatggattgtaaacttcttttctatggggataaacctactctcgtgagggtagctgaaggtaccataggaataagcaccggct

SEQ ID NO: 3586 - DNA, 490 bp, Unknown
  Ascusbbf_768576, encodes 16S rRNA
agagtttgatcctggctcaggatgaacgctagcgggaggcttaacacatgcaagccgagggagaagttgtcttcggacagcggacaccggcggacgggtgagtaacatgtatgcaacttgcccctatcagtgagataacccggggaaactcggactaatatcacataacaaacgaaatagcattattttgttttaaaagatttatcggatagggataggcatgcgtaggattagttagttggtgaggtaacggctcaccaagacgatgatccttagggggcctgagagggtgatcccccacactggtactgagacacggaccagactcctacgggaggcagcagtgaggaatattggacaatgggtgagagcctgatccagccatcccgcgtgcaggaagacggccctatgggttgtaaactgcttttatacaggaataaacctactcacgtgtgagtagttgaaggtactgtaggaataagcatcggct

SEQ ID NO: 3587 - DNA, 487 bp, Unknown
  Ascusbbf_1594792, encodes 16S rRNA
agagtttgatcctggctcaggatgaacgctggcggagtgcctaacacatgcaagtcgagcggcagcgcgagtagtttactacttggcggcgagcggcggacggctgagtaacgcgtgggaacatgccccaaagtgaggaataactgcccgaaagggtggctaatgccgcatatggtcttcggattaaaggatttatccgctttgggagtggcctgcgtacgattagatagttggtgaggtaaaggctcaccaagtctacgatcgttaactggtttgagaggatgatcagtcagactggaactgagacacggtccagactcctacgggaggcagcagtgaggaatcttcacaatggacgaaagtctgatggagcaactccgcgtgcaggatgaaggccttcgggtcgtaaactgcttttatttgtgaagaatatgacggtaacaaatgaataagggtcggctaaatacgtgccaacagccgcggtaat

SEQ ID NO: 3588 - DNA, 210 bp, Unknown
  Ascusbbf_562, encodes 16S rRNA
agagtttgatcctggctcagattgaacgctggcggcaggcttattgcacaatgggggaaaccctgatgcagccatgccgcgtgtgtgaagaaggccttcgggttgtaaagcacttttgcattcgaggaagacagcacgtaaataaacgtgttatttgacgttagagtgtgaataagcaccggcaaactccgtgccagcagccgcggtaat

SEQ ID NO: 3589 - DNA, 470 bp, Unknown
  Ascusbbf_106927, encodes 16S rRNA
agagtttgatcatggctcagaacgaacgctggcggcaggcttaacacatgcaagtcgaacgatctcttcggaggtagtggcagacgggtgagtaacacgtgggaacatacctttcagttcggaataactcatggaaacgtgagctaataccggatacgccccctgggggaaagatttatcgctgaaagattggcccgcgtctgattagcttgttggtgaggtaatggctcaccaaggcgacgatcagtagctggtctgagaggatgaccagccacactgggactgagacacggcccagactcctacgggaggcagcagtggggaatattggacaatgggcgcaagcctgatccagccatgccgcgtgagtgatgacggccttagggttgtaaagctctttcgacggggacgataatgacggtacccgtagaagaagccccggctaacttcgtgccagcagccgcggtaat

SEQ ID NO: 3590 - DNA, 490 bp, Unknown
  Ascusbbf_189273, encodes 16S rRNA
agagtttgatcctggctcagattgaacgctggcggcaggcctaacacatgcaagtcgagcggggttttcggacctagcggcggacgggtgagtaatgtatagggagctgcccgatagagggggataccagttggaaacggctgttaataccgcataatgtctacggaccaaagtgtgggaccttcgggccacatgctatcggatgcacctatatgggattagctggttggtggggtaatggctcaccaaggcgacgatccctagctggtttgagaggatgatcagccacactggaactgagacacggtccagactcctacgggaggcagcagtggggaatattggacaatgggcgcaagcctgatccagccatgccgcgtgtgtgaagaaggccttcgggttgtaaagcactttcagcggggaggaaggggttgttgttaatagcaacaatctttgacgttacccgcagaagaagcaccggctaactccg

SEQ ID NO: 3591 - DNA, 295 bp, Unknown
  Ascusbbf_75288, encodes 16S rRNA
agagtttgatcatggctcaggcagttggagaatggctattaaatgcgccaaaagctcatgtcactgcttgggtgatttcaatcgcggtgttgcttggggtatggagggcgactaaaaccggcaaatgggaaattgtcctcttgtggatagctgggggcgtgttgttcgtgctcggagcgtcaagtgacgaggaacttgactggtggcgtgaggcattgaccggtggtttttacaccgatcccaacagagttgcagctgtggcggcgatttcctctgtgccagcagccgcggtaat

SEQ ID NO: 3592 - DNA, 490 bp, Unknown
  Ascusbbf_483118, encodes 16S rRNA
agagtttgatcctggctcaggatgaacgctggcggcatgcctaagacatgcaagtcgaacgagatggtccatcgaaagctgcgtgcttgcacaaagctggacttgggttgccatctagtggcagacgggtgagtaacacgtgggtgacctgccttttcgttggggataacagttggaaacgattgctaataccgaataagatataagagtcaatcttatattgaaaggagcctttaaagctccgcgattagatgggcctgcggcgtattaactagttggtggggtaatggcctaccaaggtaacgatgcgtagccgaactgagaggttgatcggccacactgggactgagacacggcccagactcctacgggagacagcagttaggaatattcgtcaatgggggaaaccctgaacgagcaatgccgcgtgagtgatgaaggtcctttggattgtaaaactctgttgtatggaaaaaacgaccaggttagg

SEQ ID NO: 3593 - DNA, 490 bp, Unknown
  Ascusbbf_797307, encodes 16S rRNA
agagtttgatcatggctcagaatgaacgctggcggcatggattaggcatgcaagtcgaacgagaaagcggcttcggccgcgagtaaagtggcgaaagggtgagtaacacgtgaggaacctgccctccagtccggaacaaacctgtgaaaacgggcctgaaaccggatgccggccctccccgcatggggcggagccgaaacatttatggctggaggatggcctcgcggcccattagctagttggcggggtatcggcccaccaaggctacgacgggtaggtggtctgagaggatggtcacccacactgggactgagacactgcccagactcctacgggaggctgcagtcgagaatcttccgcaaggggcgcaagcctgacggagcgatgccgcgtgagggacggaggccttcgggtcgtaaacctctgtcgacggggacgaacgcaatgacggtacccgtcaaggaagccacggctaaccacgtgccagcag

SEQ ID NO: 3594 - DNA, 490 bp, Unknown
  Ascusbbf_222837, encodes 16S rRNA
agagtttgatcatggctcagattgaacgctggcggcaggcttaacacatgcaagtcgagcggggatagggtgcttgcacctgattcctagcggcggacgggtgagtaatacttaggaatctgcctattagtgggggataacggctcgaaagggtcgctaataccgcatacgtcctacgggagaaagcaggggatcgtaagaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctcccgtagctaatatctacggagagtggacgttactcgcagaataagc

SEQ ID NO: 3595 - DNA, 490 bp, Unknown
  Ascusbbf_355930, encodes 16S rRNA
agagtttgatcatggctcaggacgaacgctggcggcatgcctaacacatgcaagtcgaacggagtctttccggaagtttacttttgggaagacttagtggcggacgggtgagtaacacgtgggtaatctgcctgagagactgggacaacagggggaaaccgctgctaataccagataagctcacggggacgggagttcctgggagaaaaggagaaatccgctttcagatgagcccgcggctgattagccagttggtggggtaacggcctaccaaagcgacgatcagtagccggcctgagagggtgtacggccacactggaactgagacacggtccagactcctacgggaggcagcagtggggaattttccgcaatgggcgaaagcctgacggagcaatgccgcgtgagtgaggaaggccttcgggttgtaaagctctgtcttcggggacgaataaatgacggtacccgaggaggaagccacggctaacta

SEQ ID NO: 3596 - DNA, 490 bp, Unknown
  Ascusbbf_276800, encodes 16S rRNA
agagtttgatcatggctcaggatgaacgctggcggcgtgcctaatacatgcaagtcgaacggagagctcctatcggacgagtgcttgcactctgaagtgtggaatactcttagtggcgaacgggtgagtaatacatgaacaacctgcccctttgtctgggataacattctgaaaagattgctaataccggataggtactgttgaggcatctcaacttcattaaagatgggtttccatcgcattgggatgggttcatgtcgcattagctagttggtgaggtaacggcccaccaaggctgtgatgcgtagccggtctgagaggacgaacggccacattgggactgagacacggcccagactcctacgggaggcagcagtagggaattttcggcaatgggggcaaccctgaccgagcaacgccgcgtgaacgatgaaggtctttggattgtaaagttctgttacgagggaagaatacttggtataggaaatga

SEQ ID NO: 3597 - DNA, 490 bp, Unknown
  Ascusbbf_1140067, encodes 16S rRNA
agagtttgatcctggctcagattgaacgctggcggcaggcctaacacatgcaagtcgagcggcagcacgggtgcttgcacctggtggcgagcggcggacgggtgagtaatgcgtgggaacgtgcccattagtgggggataacctggggaaactcaggctaataccgcataagccctacgggggaaagcgggggatcttcggacctcgcgctattggatcggcccacgtcagattagcttgttggtgaggtaaaggctcaccaaggcgacgatctgtaactggtctgagaggatgatcagtcacaccggaactgagacacggtccggactcctacgggaggcagcagtggggaatcttggacaatgggcgcaagcctgatccagccatgccgcgtgtgtgaagaaggccctagggttgtaaagcactttcagcagggaggaaggcttcgggataataccctggagtacttgacgttacctgcagaagaagc

SEQ ID NO: 3598 - DNA, 490 bp, Unknown
  Ascusbbf_1808533, encodes 16S rRNA
agagtttgatcatggctcagattgaacgctggcggcgtgcctaacacatgcaagtcgagcggtagcaggtgtagcaatacatgctgacgagcggcggacgggtgagtaacgcttgggaatctgcctattagtgggggataactcggggaaactcgagctaataccgcatacgatctacggatgaaagctggggaccgcaaggcctggcgctaatagatgagcccaagtcggattagctagttggtaaggtaatggcttaccaaggcgacgatccgtaactggtctgagaggacgaccagtcacaccggaactgagacacggtccggactcctacgggaggcagcagtggggaatattggacaatgggcgaaagcctgatccagcgacgccgcgtgggtgaagaaggcctgcgggttgtaaagccctttcggtagggaagaaaagtttcgacctaacacgtcgggaccttgacgtaacctactaaagaagc

SEQ ID NO: 3599 - DNA, 472 bp, Unknown
  Ascusbbf_183158, encodes 16S rRNA
agagtttgatcatggctcagaacgaacgctggcggcaggctttagtcatgcaagttgaacggttatagcaatataacagtagcgcacgggtgagtaatgcatgggaacataccttttggtgggggatattcttcggaaacgaagagcaataccgcataagccctgagggggaaagatttattgccgaaagattggcccatgttagattagctagttggttaggtaaaagctgaccaaggctatgatctatagctggtttgagaggacgaccagccacattgggactgagacacggcccagactcctacgggaggcagcagtcaggaatattggacaatgggggaaaccctgatccagccatgccgcgtgagtgaagaaggcccttgggttgtaaagctcttttgtacgggaagatgatgacggtaccgtaagaataagcaccggctaacttcgtgccagcagccgcggtaat

SEQ ID NO: 3600 - DNA, 490 bp, Unknown
  Ascusbbf_1870272, encodes 16S rRNA
agagtttgatcatggctcagaatgaacgctggcggcatggattaggcatgcaagtcgaacgagaaaagcggcttcggccgcgagtaaagtggcgaaagggtgagtagcacgtggggaacctgccccggggaccggaacaagcctgtgaaaacgggtctgagaccggatgccgcccccctccgcatggggggagggcgaaagattcatcgccccgggatggccccgcgccccattagctagttggcggggtgacggcccaccaaggctgcgacgggtaggtggtctgagaggatggtcacccacactgggactgagacactgcccagactcctacgggaggctgcagtcgagaatcttccgcaatgggcgcaagcctgacggagcgatgccgcgtgagggaagaaggccctcgggtcgtaaacctctgtcggacgggacgaagccaacgacggtaccgtccaaggaagccacggctaaccacgtgccagca

SEQ ID NO: 3601 - DNA, 490 bp, Unknown
  Ascusbbf_1840140, encodes 16S rRNA
agagtttgatcctggctcaggacgaacgctggcggcgtgcttaaaacatgcaagtcgaacgggaagttgagaagcttgcttttcaacttctagtggcggacgggtgagtaacgcgtgagtaacctgcctactacagggggataacacagagaaatttgtgctaataccgcataagaccacaacgtggcatcacgaaggggtcaaaggagttaaatccggtagtagaggggcttgcgtctcattagctagttggtggggtaacggcctaccaaggcgacgatgagtagccgatctgagaggatgaacggccacactggaactgagaaacggtccagactcctacgggaggcagcagttaggaatattgggcaatggaggcaactctgacccagcaacgccgcgtgaaggaagaaggttttcggattgtaaacttctgatctgtgggaaaaagagaacgatggtaccacaggagaaagccacggctaactac

SEQ ID NO: 3602 - DNA, 490 bp, Unknown
  Ascusbbf_1882069, encodes 16S rRNA
agagtttgatcctggctcaggatgaacgctggcggcgtgcctaacacatgcaagtcgaacggttaagccggcttcggccgggaatacagtggcgaacgggtgagtaacacgtgaccaacctgccccccgcaccgggacagccccgcgaaagcgcggttaataccggatatgcccccgcgcccgcatgggagcggggggaaagcccaggcggcgggggatggggtcgcggcccatcaggtagtaggcggggcagcggcccgcctagccgacgacgggtagccgggttgagagaccgaccggccacattgggactgagatacggcccagactcctacgggaggcagcagtggggaatattgcgcaatgggggcagccctgacgcagcaacgccgcgtgcgggacgaaggcgtccgcgtcgtaaaccgctttcagcagggaagatgacgacggtacctgcagaagaagccccggctaactacgtgccagcagc

SEQ ID NO: 3603 - DNA, 490 bp, Unknown
  Ascusbbf_1808165, encodes 16S rRNA
agagtttgatcatggctcaggacgaacgctggcggcgtgcctaatacatgcaagtcgaacgcttttttcaatcatcgtagcttgctacaccgattgaaaattgagtggcgaacgggtgagtaacacgtgggtaacctgcccaaaagagggggataacacttggaaacaggtgctaataccgcataaccatgatgaccgcatggtcattatgtaaaagatggtttcggctatcacttttggatggacccgcggcgtattaacttgttggtggggtaacggcctaccaaggtaatgatacgtagccgaactgagaggttgatcggccacattgggactgagacacggcccaaactcctacgggaggcagcagtagggaatcttccacaatgggcgcaagcctgatggagcaacgccgcgtgagtgaagaaggtcttcggatcgtaaaactctgttgttagagaagaacatgcgagagagtaactgttcttgt

SEQ ID NO: 3604 - DNA, 490 bp, Unknown
  Ascusbbf_1586330, encodes 16S rRNA
agagtttgatcatggctcagattgaacgctggcggcatgcttaacacatgcaagtcgaacggcagcatagcctagcttgctaggttgatggcgagtggcgaacgggtgagtaacgcgtaggaatatgccctggagagggggataacttggggaaactcaagctaataccgcatgaactctgaggagcgaagctggggaccttagggcctggcgcttcaggaatagcctgcgtctgattagctagttggtggggtaagggcctaccaaggcgacgatcggtagctggtctgagaggatgatcagccacactgggactgagacacggcccagactcctacgggaggcagcagtggggaatattggacaatggggggaaccctgatccagcaatgccgcgtgtgtgaagaaggcctgagggttgtaaagcacttttgttggggaggagtcttggatggttaagagctgtttaagaggacgttacccaaagaat

SEQ ID NO: 3605 - DNA, 490 bp, Unknown
  Ascusbbf_186563, encodes 16S rRNA
agagtttgatcatggctcaggacgaacgctagcgacgtgtctaagaaatgcaagtcgagcgatgacggaggcttcggtctcccgattagcggcgaacggtcgcgtaacacgtaagcaatctgccccaaagtttgggatagcccggcgaaagtcggattaataccggatgtggacagggtttcgcatggagcccggtctaaagcagcaatgcgctttgggatgagcttgcggcctatcagcttgatggcggggtaacggcctgccatggcgacgacgggtagctggtctgagaggatggtcagccggactgggactgagatacggcccagactcctacggggggcagcaattaagaatcttgcgcaatgggggcaaccctgacgcagcgacgtcgcgtgaacgatgaattctttcgggatgtaaagttcttttgtcagggaagagtaatagactgtacctgacgaataagccccggctaactacgtgccag

SEQ ID NO: 3606 - DNA, 490 bp, Unknown
  Ascusbbf_212387, encodes 16S rRNA
agagtttgatcatggctcaggatgaacgctggcggcgtgcctaacacatgcaagtggagcgacgaacccggacttgtccgggggcaaagccgcgaacgggtgagtaacacgtggattatctgccccaatgaccgggacaactcgaggaaactcgagctaataccggatgtgctcttcggaggaaaggaagcttcggcctccgcattgggatgagtccgcggcgcattagctagttggtgaggtaaaggctcaccaaggcgacgatgcgtagctggtctgagaggacgatcagccacactggaactgagacacggtccagactcctacgggaggcagcagtggggaatcttgcgcaatgcacgaaagtgtgacgcagcaacgccgcgtgcgggaagaaggtcttcggatcgtaaaccgctttcagttgggacgagggttacacggtgaatagccggcgtaactgacggtaccttcagaagaagccccggct

SEQ ID NO: 3607 - DNA, 490 bp, Unknown
  Ascusbbf_685612, encodes 16S rRNA
agagtttgatcctggctcaggatgaacgctggcggcgtgcttaacacatgcaagtcgaacggagagcccatgacggagttttcggacaactgattgggtttcttagtggcggacgggtgagtaacgcgtgagtaacctgcctgggagcggggaataacacagtgaaaattgtgctaataccgcataatgcagttgtgccgcatggtactgactgccaaagatttatcgctcttagatggactcgcgtctgattagatagttggcggggtaacggcccaccaagtcgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttatcagggacgaattttgacggtacctgatgaataagccacgg

SEQ ID NO: 3608 - DNA, 490 bp, Unknown
  Ascusbbf_1045362, encodes 16S rRNA
agagtttgatcctggctcaggacgaacgctagcgacgtgtctaagaaatgcaagtcgagcgatgacggaggcttcggcctcccgattagcggcgaacggtcgcgtaacacgtaagcaatctgccccaaagttcgggatagcccggcgaaagtcggattaataccggatgtggatgtttttgcgcatgcatttgcatctaaagcagcgatgcgctttgggatgagcttgcggcctatcagcttgatggcggggtaacggtctgccatggcgacgacgggtagctggtctgagaggatggtcagccggactgggactgagatacggcccagactcctacggggggcagcaattaagaatcttgcgcaatgggggaaaccctgacgcagcgacgtcgcgtgaatgatgaagtctttcgggatgtaaagttcttttgtcggggaagagtaacagactgtacccgacgaataagccccggctaactacgtgccag

SEQ ID NO: 3609 - DNA, 490 bp, Unknown
  Ascusbbf_543579, encodes 16S rRNA
agagtttgatcctggctcaggacgaacgctggcggtatgcttaagacatgcaagtcgaacgagcgattgagtgtgcttgcacattcaaaagcgagtggcggacgggtgagtaacgcgtgagcaacctgcctctttcaacgggataccaattggaaacgattgttaataccgtatatgaccacagcatcgcatggtgcaggggtgaaagggtttactggaaagagatgggctcgcgtctgattagctagttggtggggcaacggcctaccaaggcgacgatcagtagccgacctgagagggtgatcggccacattgggactgagaacggcccagactcctacgggaggcagcagtcgggaatattgggcaatggaggaaactctgacccagcaataccgcgtgagggatgaaggttttcggattgtaaacctctgttataaaggaagaaacaaatgacggtactttataagtaagccccggcaaactatgt

SEQ ID NO: 3610 - DNA, 490 bp, Unknown
  Ascusbbf_1372204, encodes 16S rRNA
agagtttgattatggctcaggacgaacgctggcggcgtgcttaacacatgcaagtcgaacggtgaagggagcttgctcccggatcagtggcgaacgggtgagtaacacgtgagcaacctacccttgactctgggataacagttggaaacagctgctaataccggatacgaccctggcgggcatctgccggggtggaaagctccgacggtcaaggatgggctcgcggcctatcagcttgttggtggggtaacggcccaccaaggcgccgacgggtagccggcctgagagggcgaccggccaaactgggacagagatacggcccagactcctacgggaggcagcagtggggaatattgcacaatgggcgaaagcctgatgcagcaacgccgcgtgcgggatgacggccttcgggttgtaaaccgctttcagcagggacgaagggtttctgacggtacctgcagaagaagcaccggctaactacgtgccagca

SEQ ID NO: 3611 - DNA, 490 bp, Unknown
  Ascusbbf_1246149, encodes 16S rRNA
agagtttgatcctggctcaggacgaacgctggcggcgtgcctaacacatgcaagtcgaacgagaatttatcggcagaattcttcggaatgaagctggtaaaggaaagtggcggacgggcgagtaacgcgtgaataacctgcccataagagggggataatccatggaaacgtggactaataccgcatattgaatggagttcgcatgaacatcatttgaaagattatatcgcttatggatggattcgcgtcagattagatagttggagaggtaacggctcaccaagtcgacgatctgtagccgaactgagaggttgatcggccgcattgggactgagacacggcccagactcctacgggaggcagcagtggggaatattgcgcaatgggggcaaccctgacgcagcaacgccgcgtgcaggaagaaggtcttcggattgtaaactgttgtcgcaagggaagaataaaatgacggtaccttgtgagaaagtca

SEQ ID NO: 3612 - DNA, 490 bp, Unknown
  Ascusbbf_921101, encodes 16S rRNA
agagtttgatcctggctcaggacgaacgctggcggcgtgcttaacacatgcaagtcgaacgaggtgcagcgagttgaagcttcggcggaaacatgctgttaccgagtggcggacgggtgagtaacgcgtgagcaacctgccctgcaacgggggacaacagttggaaacgactgctaataccgcatgagaccacggtttcgcatggaactgaggtaaaaggatttattcgatgcaggatgggctcgcgtcccattagatagttggtgaggtaacggctcaccaagtcaacgatgggtagccgacctgagagggtgatcggccacactggaactgagacacggtccagactcctacgggaggcagcagtggggaatattgggcaatgggcgaaagcctgacccagcaacgccgcgtgagggaagaaggtcttcggattgtaaacctttgtcctatgggacgaaacaaatgacggtaccataggaggaagctc

SEQ ID NO: 3613 - DNA, 490 bp, Unknown
  Ascusbbf_1162518, encodes 16S rRNA
agagtttgatcatggctcaggacgaacgctggcggcgcgcctaacacatgcaagtcgaacgggactagtgactggagctaagaagttttcttggttgcattcactagttcagtggcggacgggtgagtaaagcatgagtaacttgcccattagtggggaatagcttttggaaacagaagataataccgcataattcggtttggacacatgttcggaccggaaaagaagcaattcgctaatggataggctcatgtctgattagcttgttggtgaggtaatggcttaccaaggccatgatcagtagccgtaccgagaggttcaacggccacattgggactgagacacggcccagactcctacgggaggcagcagtgaggaatattgcgcaatggaggaaactctgacgcagcgacgccgcgtgaaggaagaaggtcttcggattgtaaacttctgtcttcagggaagaaataaatgacggtacctggggagg

SEQ ID NO: 3614 - DNA, 490 bp, Unknown
  Ascusbbf_765018, encodes 16S rRNA
agagtttgatcatggctcaggatgaacgctagctacaggcttaacacatgcaagtcgaggggcatcatgggattggtttcggccgatcctgatggcgaccggcggacgggtgagtaacgcgtatccaacctgcccctgtcccgcggacagcccttagaaatgaggattaacccgcgatgttgcccgattgccgcatggtgattgggtgaaatgcctaaggacggggatggggatgcgttccattagcttgcaggcggggtgacggcccacctgggcgacgatggataggggttctgagaggaaggtcccccacactggaactgagacacggtccagactcctacgggaggcagcagtgaggaatattggtcaatgggcgcgagcctgaaccagccaagtagcgtgcgggaggaaggccctacgggttgtaaaccgcttttgtccggggataacgtgcgccacgtgtggtgtattgcaggtaccgggcgaa

SEQ ID NO: 3615 - DNA, 490 bp, Unknown
  Ascusbbf_1435746, encodes 16S rRNA
agagttgatcctggctcaggatgaacgctagcggcaggcttaacacatgcaagtcgaggggcagcgcggggtagcaatactctgtcggcgaccggcggaagggtgcgtaacgcgtgagcaacttgcccgtcactgggggataggcactggacacggtgtgtaatactccataacatatggattcacatggatttatattgaaagattcgttggtgacggatgggctcgcgtaacattagctagtcggcggggtaacggcccaccgaggctacgatgtttaggggttctgagaggaaggtcccacacacgggacctcggacccggtcaagacgcctacgggaggcagaagtgaggaatagtgggcaatgggcggaagcctgaaccagccatgccgcgtgcaggaataaggccctatgggtcgtaaactgcttttccttgagggcaagaagggtcacgagtggcccgatgagagtatcaggggaataagcat

SEQ ID NO: 3616 - DNA, 490 bp, Unknown
  Ascusbbf_1512822, encodes 16S rRNA
agagtttgatcctggctcaggatgaacgctagcggcaggcctaacacatgcaagtcgaggggtaaggttacttcggtagcctgagaccggcgcacgggtgcgtaacgcgtatgcaatctaccttttactatgggatagcccagagaaatttggattaataccatatagtatatccgaatggcatcgtttgaatattaaagatttatcggtaaaagatgagcatgcgtcccattagttagttggtgtggtaacggcacaccaagacgatgatgggtaggggtcctgagagggagatcccccacactggtactgagacacggaccagactcctacgggaggcagcagtgaggaatattggtcaatggaggcaactctgaaccagccatgccgcgtgcaggatgacggtcctatggattgtaaactgcttttgtacgggaagaaaacaaactacgcgtagttaattgacggtaccgtaagaataaggatcggc

SEQ ID NO: 3617 - DNA, 490 bp, Unknown
  Ascusbbf_1434706, encodes 16S rRNA
agagtttgatcctggctcaggatgaacgctagcggcaggcttaacacatgcaagtcgaggggcagcgcggggtagcaatactctggcggcgaccggcggaagggtgcgtaacgcgtgtgcaacttgcccgtcactgggggataggcactggaaacggtgtgtaatactccataacatatggattcacatggattcatattgaaagagtcgttgttgacggatgggcccgcgtcacatgagctagtcggcggtgaaacggcccaccgaggctacgatgtttaggggttctgagaggaaggtcccccacacgggaactgagacacggtccagactcctacgggaggcagcagtgaggaatagtggtcaatgggcggaagcctgaaccagccaagccgcgtgcaggaataaggccctatgggtcgtaaactgcttttcctcgagagcaataagggtcacgagtggcccgatgagagtatcaggggaataagca

SEQ ID NO: 3618 - DNA, 490 bp, Unknown
  Ascusbbf_1588633, encodes 16S rRNA
agagtttgatcatggctcaggacgaacgctggcggcgtgcctaacacatgcaagtcgagcggaggtaactagaggaagttttcggatggaatctggttactttagcggcggacgggtgagtaacgcgtgagcaacctgcctttcacagggggataacggatcgaaagattcactaataccgcatgagaccacgggggtgcatactccaggggtcaaaggagcaatccggtgaaagatgggctcgcgtccgattagatagttggtggggtaacggcctaccaagtcaacgatcggtagccgacctgagagggtgatcggccacactggaactgagagacggtccagactcctacgggaggcagcagtggggaatattgggcaatgggggaaaccctgacccagcaacgccgcgtgagggaagaaggttttcggattgtaaacctctgtccttggtgaagagaggaagacggtagccaaggaggaagccccg

SEQ ID NO: 3619 - DNA, 490 bp, Unknown
  Ascusbbf_1372667, encodes 16S rRNA
agagtttgatcatggctcaggacgaacgctggcggcgtgcctaacacatgcaagtcgagcggagccaatcggacaaacccttcggggtgcgtttgaggaagcttagcggcggacgggtgagtaacgcgtgagtaacctgcccataagagggggataacacagagaaatttgtgctaataccccatattgaattagaatcgcatggttttaatttgaaagatttatcgcttatggatggactcgcgtctgattagatagttggcggggtaacggcccaccaagtcgacgatcagtagccgaactgaggggtagagcggccacattgggactgagacacggcccagactcctacgggaggcagcagtgggggatattgcgcaatgggggaaaccctgacgcagcaacgccgcgtgaaggaagaaggctttcgggttgtaaacttctgttcttagggaagaagacagtgacggtacctaaggagcaagtcacg

SEQ ID NO: 3620 - DNA, 490 bp, Unknown
  Ascusbbf_1406985, encodes 16S rRNA
agagtttgatcctggctcaggatgaacgctagcggcaggcctaacacatgcaagtcgaggggtagagttgtgcttgcacaacttgagaccggcaaacgggtgcggaacacgtacgcaatctgcccttatcacgggaatagcccagagaaatttggattaatgcccgatagtattattgagaggcatcttttaataattaaagatttattggataaggatgagcgtgcgcaagattagctagttggtgaggtaacggctcaccaaggcgacgatctttagctgatgtgagagcatgatcagccacacgggcactgagacacgggcccgactcctacgggaggcagcagtgaggaatattggtcaatggacggaagtctgaaccagccatgccgcgtgaaggatgaaggcgttctgcgttgtaaacttcttttatcaggggagaaaccacagatttctatttgtgttgacggtacctgatgaataagcaccg

SEQ ID NO: 3621 - DNA, 490 bp, Unknown
  Ascusbbf_1360041, encodes 16S rRNA
agagtttgatcctggctcagattgaacgctggcggcatgcttaacacatgcaagtcgaacggcagcacggtctagcttgctagatgggtggcgagtgccgaacgggtgagtaacgcgtgggaatatgccttgaagagggggataacttggggaaactcaagctaataccgcatacgctctgaggagcaaagctagggaccttcgggcctggcgctttgagaatagcctgcgtccgattagctagttggtagggtaaaggcctaccaaggcgacgatcggtagctggtctgagaggacgaacagccacactgggactgagaaacggcccagactcctacgggaggcagcagtggggaatattggacaatgggggcaaccctgatccagcaatgccgcgtgtgtgaagaaggcctgagggttgtaaagcactatcagtggggaggaggattgattggttaagagctgattaattggacgttacccacagaag

SEQ ID NO: 3622 - DNA, 490 bp, Unknown
  Ascusbbf_868701, encodes 16S rRNA
agagtttgatcctggctcaggacgaacgctggcggcgcgcctaacacatgcaagtcgagcgagaaccagggcttcggccctggggacagcggcgaacgggtgagtaacacgtggataacctgccctcggcaccggaatagcccggggaaacccggattaatgccggatggccccacatccctgcggggaacgtgggaaaaggtagcttcggcctctggccgaggatgggtccgcggtggattagcttgttggtggggtaatggctcaccaaggcgacgatccatagctggtctgagaggacgatcagccacactgggactgggacacggcccagactcctacgggaggcagcagtggggaatcttgtgcaatgggcgaaagcctgacgcagcgacgccgcgtgcgggaagaaggccttcgggttgtaaaccgctttcaggagggacgaagccactcgggtgaatagcccagagggtgacggtacctccag

SEQ ID NO: 3623 - DNA, 490 bp, Unknown
  Ascusbbf_1043879, encodes 16S rRNA
agagtttgatcatggctcaggacgaacgctggcggcgtgcttaacacatgcaagtcgagcggaaaggctccttcgggggtactcgagcggcgaacgggtgagtaacacgtgagtaatctgccctccactctgggataacgttcagaaatgggtgctaataccggatgtacacaggctgacgcatgttggtgtgtggaaaggtttttctggtaggggatgtgctcgcggcctatcagcttgttggtggggtaatggcctaccaaggctttgacgggtagccggcctgagagggtgaccggccacactgggactgagacacggcccagactcctacgggaggcagcagtggggaatattggacaatgggcggaagcctgatccagcaacgccgcgtgagggatgacggccttcgggttgtaaacctctttcaccattgacgaagctgcatctttttgggtgtggtgacggtaggtggggaagaagcaccggc

SEQ ID NO: 3624 - DNA, 490 bp, Unknown
  Ascusbbf_253777, encodes 16S rRNA
agagtttgatcatggctcagagtgaacgctggcggcgtggttaagacatgcaagtcgagcgggatttatcatcatgagtcttcggatgaatgaggatgatgagagcggcaaacgggtgcgtaacacgtaaacaacttgccccctagtccgggatagctcaccgaaaggtggattaataccggatgcggttttctttcgcatggaagagatactaaagcttgtaatggcgctaagggagaggtttgcgtcctatcagcttgttggtgaggtaaaggcttaccaaggctaagacgggtagctggtctgagaggatgatcagccacagtggaactgagacacggtccacacacctacgggtggcagcagtttcgaatcattcacaatgggcaaaagcctgatggtgcaacgccgcgtgggggatgaaggttctcgaatcgtaaacccctgtcgccgaggaacaaaatccgggttcatagcccggcttgagtta

SEQ ID NO: 3625 - DNA, 490 bp, Unknown
  Ascusbbf_11559, encodes 16S rRNA
agagtttgatcatggctcagaacgaacgctggcggcatggattaggcatgcaagtcgaacggaagtagcaatacttcagtggcggaagggtgaggaacgcgtgagtaatctgccctcaagttgggaataacagctggaaacggctgctaataccgaatgtggctgtggaattgcatgattttacggctaaagctttatgtgcttgaggatgagctcgcgtcccattagcttgttggtgaggtaacggctcaccaaggcgatgatgggtagctggtctgagaggatggtcagccacactggaactgagacactgtccagactcctacgggaggctgcagtcgagaatcttgggcaatgcgcgaaagcgtgacccagcaatgccgcgtgtgtgacgaaggtcttcggattgtaaaacactgtctcccgtgacgaaagatgacggtagcggggaaggaagccacggctaactacgtgccagcagccgcggtaa

SEQ ID NO: 3626 - DNA, 490 bp, Unknown
  Ascusbbf_471207, encodes 16S rRNA
agagtttgatcatggctcaggatgaacgctagctacaggcttaacacatgcaagtcgaggggcagcgggagagtagcttgctactcttgccggcgaccggcgcacgggtgagtaacacgtatccaacctgccctgaaccccgggatagccctctgaaaggaggattaataccggatgtggccgctgggggacatcccctggcgtctaaagattcatcggttttggatggggatgcgtctgattagcttgtcggcggggtaacggcccaccgaggcaccgatcagtaggggttctgagaggaaggtcccccacataggaactgagacacggtcctaactcctacgggaggcagcagtgaggaatattggtcaatgggcgagagcctgaaccagccaagtagcgtgagggacgactgccctatgggttgtaaacctcttttatgcgggaataacgggagccacgcgtggctttgtgcatgtaccgcatgaat

SEQ ID NO: 3627 - DNA, 490 bp, Unknown
  Ascusbbf_107752, encodes 16S rRNA
agagtttgatcctggctcagagtgaacgctggcggcgtggttaagacatgcaagtcgaacgggattttctgttaagattcttcggatgattaatagagatgagagtggcaaacgggtgagtaacacgtaaataacttgccccttagtttgggatagctcgttgaaagacgaattaataccggatgtggttttcttctgatggaagagatactaaagcttgtgatggcgctaagggagaggtttacggcctatcagcttgttggcaaggtaatggcttaccaaggcaaagacgggtagctggtctgagaggatgatcagccacattggaactgagacacggtccagacacctacgggtggcagcagtttcgaattattcacaatggacgaaagtctgatggtgcaacgccgcgtgggggatgaaggttctcgaattgtaaacccctgtcgctgaggagtaaaggttaggttcatagcttaatttgaattaa

SEQ ID NO: 3628 - DNA, 490 bp, Unknown
  Ascusbbf_183949, encodes 16S rRNA
agagtttgatcatggctcagaacgaacgctggcggtgcgtcttaagcatgcaagtcgaacgggattcagcagcttgctgttgatgagagtggcggactggtgagtaacacgtgggtgacataccctcctgacggggatagcctttagaaataaggggtaataccggatacgcacgtacaggttagaggtgtacgtggaaagggagcttcggctccgcgggaggaatggcttgcggcccattagctggttggtgtggtaacggcgcaccaaggcgatgatgggtatccggcctgagagggtgaacggacacattgggactgagatacggcccagactcctacgggaggcagcagctaagaatattccgcaatggacggaagtctgacggagcgacaccgcgtgaatgaagaaggccggaaggttgtaaagtgcttttgaatgtgaagaataagcaggtcaggtaatgggcgtgcggtgacggtagcatttg

SEQ ID NO: 3629 - DNA, 363 bp, Unknown
  Ascusbbf_314243, encodes 16S rRNA
agagtttgatcatggctcagaacgaacgctggcggcgcgtcttaagcatgcaagtcgaacggcaagattggtgcttgcaccgatcctagagtggcggactggtgagtaacacgtgggtgacgtaccctctgaatggggatagccggtagaaataccggataataccgaataaccttgcacctttagagtggtgtaagaaaaggagcttcggcttcgtcggaggaacggcccgcgcactattagctagttggtgaggtaacggcccaccaaggcgacgatagttatccggcctaagagggtgaacggacacattgggactgagatacggcccagactcctacgggagccagcagccgcggtaat

SEQ ID NO: 3630 - DNA, 490 bp, Unknown
  Ascusbbf_175340, encodes 16S rRNA
agagtttgatcatggctcaggatgaacgctggcggcgtgcctaatacatgcaagtagaacgctgaagcttggtgcttgcaccgagcggatgagttgcgaacgggtgagtaacgcgtaggtaacctgcctggtagcgggggataactattggaaacgatagctaataccgcataacagtagatattgcatgatatctgcttgaaaggtgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgagtgtgagagtggaaagttcacactgtgacggtatct

SEQ ID NO: 3631 - DNA, 490 bp, Unknown
  Ascusbbf_200806, encodes 16S rRNA
agagtttgatcctggctcaggacaaacgctggcggcgtgcctaatacatgcaagtcgaacgagaatctctggcttgccagagaggaaagtggcggacgggtgagtaatatgtaggaaatctgccctcaagagggggacaacagttggaaacgactgctaataccccatatgagcttagttgaaatactaatcttgaaatgatttttcgcttgaggatgagcctgcatctgattagcttgttggtggtgtaatggactaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgagtgatgaagcccctcggggtgtaaaactctgtcagtagggacaaattctgatggtacctacagaggaagcatcggctaactacgtgccagcagcc

SEQ ID NO: 3632 - DNA, 470 bp, Unknown
  Ascusbbf_166141, encodes 16S rRNA
agagtttgatcatggctcagaacgaacgctggcggcaggcttaacacatgcaagtcgaacgcatccttcggggtgagtggcagacgggtgagtaacgcgtgggaacctacctttaggtctggaataactgagggaaacttcagctaataccggatagacccgtgagggtaaagatttatcgcctgaagatgggcccgcgcaggattagctagttggtggggtaaaggcctaccaaggcgacgatccttagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcgcacgtgacgataatgacggtagcgtgagaagaagccccggctaacttcgtgccagcagccgcggtaat

SEQ ID NO: 3633 - DNA, 490 bp, Unknown
  Ascusbbf_286346, encodes 16S rRNA
agagtttgatcctggctcaggacgaacgctggcggcgtgcttaacacatgcaagtcgaacgaggatgattccttcggggatcattcgagtggcggacgggtgagtaacgcgtgaacaatctgtccttcaaagggggataccaactggaaacagttgctaataccgcataagaccacggtatcgcatggtactgaggtaaaagatgaaagtcgatggagggtgagttcgcgtctgattaggcagttggcggggtaaaggcccaccaaaccgacgatcagtagccgacctgagagggtgaccggccacattgggactgagacacggcccagactcctacgggaggcagcagtgggaatattgggcaatgggcgaaagcctgacccagcaacgccgcgtgagggaagaaggttttcggattgtaaacctctgtcctaaaggacgaaggaagtgacggtactttaggaggaagccccggctaactacgtgccag

SEQ ID NO: 3634 - DNA, 470 bp, Unknown
  Ascusbbf_254126, encodes 16S rRNA
agagtttgatcatggctcagaacgaacgctggcggcaggcctaacacatgcaagtcgaacgccgtagcaatacggagtggcagacgggtgagtaacgcgtgggaaccttcccaatggtacggaataactcagggaaacttgtggtaataccgtatacgcccgaaaggggaaagatttatcgccattggatgggcccgcgtcggattagctagttggtgaggtaatggctcaccaaggctacgatccgtagctggtttgagagaatgaccagccacactgggactgagacacggcccagactcctacgggaggcagcagtggggaatattggacaatgggcgcaagcctgatccagccatgccgcgtgagtgacgaaggccttagggttgtaaagctcttttggcggggacgataatgacggtacccgcagaataagccccggctaacttcgtgccagcagccgcggtaat

SEQ ID NO: 3635 - DNA, 490 bp, Unknown
  Ascusbbf_1583309, encodes 16S rRNA
agagtttgatcatggctcaggatgaacgctagcgacaggcttaacacatgcaagtcgaggggcagcgggattgaagcttgcttcaattgccggcgaccggcgcacgggtgagtaacacgtatgcaacctgcccgccacaggggaataaccggaagaaattccgactaattccgcgtaacacctcagggaggcatcttcccgaggtcaaaggagcaatccggtggcggatgggcatgcggcgcattagctagtcggcggggtaacggcccaccgaggcgacgatgcgtaggggttctgagaggaaggtcccccacactggtactgagacacggaccagactcctacgggaggcagcagtgaggaatattggtcaatgggcgggagcctgaaccagccaagtcgcgtgagggaagacggccctacgggttgtaaacctcttttgtcagggagcaagaacaggcacgtgtgcctgactgagagtacctgaaga

SEQ ID NO: 3636 - DNA, 490 bp, Unknown
  Ascusbbf_692999, encodes 16S rRNA
agagtttgatcctggctcagattgaacgctggcggcaggcctaacacatgcaagtcgagcggcagcgggaggaagcttgcttcctcgccggcgagcggcggacgggtgagtaatgtctggggatctgcccgatggagggggataaccactggaaacggtggctaataccgcataacgtcgcaagaccaaagtgggggaccttcgggcctcacaccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgagcttaatacgctcatcaattgacgttactcgcagaag

SEQ ID NO: 3637 - DNA, 490 bp, Unknown
  Ascusbbf_543334, encodes 16S rRNA
agagtttgatcatggctcaggacgaacgctggcggcgtgcttcatacatgcaagtcgaacgagaagccgacttcggttggtggaaagtggcggacgggtgagtaatatgtagagaatctgccctggagagtgggacaacagttggaaacggctgctaataccgcatatgagcgtacctgtaatggtattcttgaaatgatttatcgctccgggatgagtctgcatctgattagctagttggcggtgtaatggaccaccaaggcgacgatcagtagctggtttgagaggatgatcagccacaatgggactgagacacggcccatactcctacgggaggcagcagtagggaattttgcgcaatgggggaaaccctgacgcagcaacgccgcgtgaacgaataagcccttcggggtgtaaagttctgtcagtagggacgaaacttgacggtacctacagaggaagcatcggctaactccgtgccagcagccgc

SEQ ID NO: 3638 - DNA, 490 bp, Unknown
  Ascusbbf_489291, encodes 16S rRNA
agagtttgatcatggctcaggacgaacgctggcggcgtgcttaacacatgcaagtcgaacggtaaggcgccttttggtgtacacgagtggcgaacgggtgagtaacacgtgaggaacgtgcccttgactttggtatagcacttggaaacaggtggtaatcccgaatattcagtttcccgggcatccggggggttggaaagcttttgcggtcagggatcgtctcgcggcctatcagcttgttggtggggtagtggcctaccaaggctttgacgggtagccggcctgagagggcgaccggccacattgggactgagatacggcccagactcctacgggaggcagcagtgggaatattgcacaatgggcggaagcctgatgcagcaacgccgcgtgcgggatgacggccttcgggttgtaaaccgctttcacccatgacgaagcttttgtgacggtagtgggggaagaagcaccggccaactacgtgccagca

SEQ ID NO: 3639 - DNA, 490 bp, Unknown
  Ascusbbf_1232497, encodes 16S rRNA
agagtttgatcatggctcaggatgaacgctggcggcgtgcttaacacatgcaagtcgagcgagaaatgacagatggattcttcggatgacagaagtcatggacagcggcggacgggtgagtaacgcgtgggcaacctgcccctgactgagggatagccgagggaaacttcgagtaatacctcataacgcataactgtcgcatggcagatatgccaaagatttatcggtcagggatgggcccgcgttcgattagctagttggtgaggcagcggctcaccaaggcgacgatcggtagccggcctgagagggtgaacggccacatgagaactgagacacggtccagactcctacgggaggcagcagtggggaatattgcacaatgggcgaaagcctgatgcagcaacgccgcgtgaaggaagaaggtcttcggatcgtaaacttctgtcctaggggaagaaacaaatgacggcacccttggaggaagccccgg

SEQ ID NO: 3640 - DNA, 490 bp, Unknown
  Ascusbbf_1143401, encodes 16S rRNA
agagtttgatcatggctcaggacgaacgctggcggcgtgcctaacacatgcaagtcgaacgaagctccgaaagcaacggtttcggccggagtggacggatgacttagtggcggacgggtgagtaacgcgtgagcaacctgcccttcagagggggacaacagttggaaacgactgctaataccgcataacgtaaggaaatggcatcatattcttaccaaagatttatcgctgaaggatgggctcgcgtctgattagcttgatggtggggtaaaggcctaccatggcgatgatcagtagccggactgagaggttgaacggccacattgggactgagatacggcccagactcctacgggaggcagcagtggggaatattgggcaatgggggaaaccctgacccagcaacgccgcgtgaaggaagaaggctttcgggttgtaaacttcttttgtcggggacgaagtaagtgacggtacctgacgaataagccac

SEQ ID NO: 3641 - DNA, 490 bp, Unknown
  Ascusbbf_395345, encodes 16S rRNA
agagtttgatcatggctcagaatgaacgctggcggcatggattaggcatgcaagtcgaacgagcgcgccctcgggcgcgaaagtggcgaaagggtgagtaacacgtgagcaacccgcccccggatccggaacaagccttggaaacgaggtctgaaaccggatgttgcctcgggaccgcatggtcccggggcgaaaaattccattgtccggggaagggctcgcggcccattagcttgttggcggggtgacggcccaccaaggcgacgacgggtaggtggtctgagaggatggtcacccacactgggactgagacactgcccagactcctacgggaggctgcagtcgagaatcttccgcaatgggcgcaagcctgacggagcgatgccgcgtgagggaagaaggccctcgggtcgtaaacctctgtcatccgggacgaagcaatgacggtaccggaggaggaagccacggctaaccacgtgccagcagccgc

SEQ ID NO: 3642 - DNA, 490 bp, Unknown
  Ascusbbf_698504, encodes 16S rRNA
agagtttgatcctggctcaggacgaacgctggcggtatgcttaagacatgcaagtcgaacgaggttgatattagtagcaatactgagatcaaccgagtggcggacgggtgagtaacgcgtgagcaacctgcctctttcactgggataccaattggaaacgattgttaataccggatatgaccacagcatcgcatggtgcaggggtgaaagggtttactggaaagagatgggctcgcgtctgattagctagttggtagtgtaacggactaccaaggcgatgatcagtagccgacctgagagggtgatcggccacattgggactgagaacggcccagactcctacgggaggcagcagtcgggaatattgggcaatggagggaactctgacccagcaataccgcgtgaaggaagaaggttttcggattgtaaacttctgttataaaggaagaaacaaatgacggtactttataagtaagccccggcaaactat

SEQ ID NO: 3643 - DNA, 361 bp, Unknown
  Ascusbbf_1112763, encodes 16S rRNA
agagtttgatcatggctcaggatgaacgctagcggcaggcttaacacatgcaagtcgaggggtagcgagaggtagcaatactttgtcggcgaccggcgcaagggtgcgtaacacgtgagtaacatgcccgatacaggaggataatccatggaaacgtggtctaatactccatattataatatgtacgcatgtacctattatgaaattttcgaaggtatcggattggctcgcgcaacattagccagttggtagggtaacggcctaccaaagcgacgatgtttaggggtcctgagagggaggtcccccacactggaactgagacacggtcccgactcctacgggagccagcagccgcggtaat

SEQ ID NO: 3644 - DNA, 490 bp, Unknown
  Ascusbbf_1590764, encodes 16S rRNA
agagtttgatcatggctcaggatgaacgctagctacaggcttaacacatgcaagtcgaggggcagcatggtcttcgggccgatggcgaccggcaaacgggtgcggaacgcgtacacaaccaaccgtatactgggggatagccctgagaaattaggaataataccccataagacagtaatccggcatcgggtagctgttaaagattcattggtatatgacgggtgtgcgtaagattagatagttggcggggtaaaggcccaccaagtctacgatctttagctgatgtgagagcatgatcagccacatgggcactgagacacgggcccaactcctacgggaggcagcagtgaggaatattggtcaatggacggaagtctgaaccagccatgccgcgtgaaggatgaatgcgttctgcgttgtaaacttcttttatctgaggcgaaaacaggtttttttaaacctcttgacggtatcagatgaataagcaccg

SEQ ID NO: 3645 - DNA, 490 bp, Unknown
  Ascusbbf_1370422, encodes 16S rRNA
agagtttgatcctggctcaggacgaacgctggcggcgtgcttaacacatgcaagtcgaacggactgcttcaagcttgcttggggtggtgagtggcgaacgggtgagtaacacgtgagtaacctgccctcttctttgggataacggccggaaacggctgctaataccgggtattcactggtcctcgcatgggggttggtggaaaggggcctcgtttggggtttctggtgggggatgggctcgcggcttatcagcttgttggtggggtgatggcctaccaaggctttgacgggtagccggcctgagagggtgaccggtcacattgggactgagatacggcccagactcctacgggaggcagcagtggggaattttgcacaatgggcgcaagcctgatgcagcgacgccgcgtgagggatggaggccttcgggttgtgaacctctttcgctcatggtcaagccgcggatgtgtccgtggtgagggtagtgggt

SEQ ID NO: 3646 - DNA, 490 bp, Unknown
  Ascusbbf_1602692, encodes 16S rRNA
agagtttgatcctggctcagaacgaacgctggcggcgcgtcttaagcatgcaagtcgaacggcaaggaagtgcttgcacttccctagagtggcggactggtgagtaacacgtgggtgacataccttttagttggggatagctattagaaatagtagataataccgaatgtgaccattacagttagagtgtaatgaggaaaggagctaaggctccgctaaaagattggcccgcggcccattagctagttggtgaggtaacggcccaccaaggcgatgatgggtatccggcctgagagggtgatcggacacattgggactgagatacggcccagactcctacgggaggcagcagctaagaatattccacaatggacgaaagtctgatggagcgacgccgcgtggatgacgaaggccgaaaggttgtaaaatccttttaaactggaacaataatcatggtagggaatgaccgtgaggtgaccgtacagtttga

SEQ ID NO: 3647 - DNA, 470 bp, Unknown
  Ascusbbf_1509114, encodes 16S rRNA
agagtttgatcctggctcagaacgaacgctggcggcaggcctaatacatgcaagtcgaacgaaaccttcgggtttagtggcgcacgggtgagtaatgcatgggaacgtgcccttcagtacggaataacatcgggaaactggtgctaataccgtataatatctccggatcaaagatttatcgctgaaggatcggcccatgttagattagcttgttggtgaggtaatggctcaccaaggcgacgatctatagctggtttgagaggatgaccagccacactgggactgagacacggcccagactcctacgggaggcagcagtaaggaatattggacaatgggggaaaccctgatccagccatgccgcgtgaatgaagaaggccttagggttgtaaagttcttttagggatgacgataatgacggtagtcccagaaaaagctccggctaactccgtgccagcagccgcggtaat

SEQ ID NO: 3648 - DNA, 490 bp, Unknown
  Ascusbbf_615578, encodes 16S rRNA
agagtttgatcatggctcaggatgaacgctagcggcaggcctaacacatgcaagtcgaggggtagagttagcttgctaacttgagaccggcgcacgggtgcgtaacgcgtatgcaatctaccttgtacagggggatagcccagagaaatttggattaataccccatagtgttatagactggcatcggtttataactaaagttccaacggtacaagatgagcatgcgtcccattagttagttggtgtggtaacggcacaccaagacgatgatgggtaggggtcctgagagggagatcccccacactggtactgagacacggaccagactcctacgggaggcagcagtgaggaatattggtcaatggacgcaagtctgaaccagccatgccgcgtgcaggaagaaggttctatggattgtaaactgcttttatataggaagaaacactctctcgtgagggagcttgactgtactataggaataaggatcggc

SEQ ID NO: 3649 - DNA, 490 bp, Unknown
  Ascusbbf_1732391, encodes 16S rRNA
agagtttgatcctggctcaggacgaacgctggcggcgtgcttaacacatgcaagtcgaacgagaagcaccggaaggagttttcggacaacggaaggtgtggaaagtggcggacgggtgagtaacgcgtgaggaacctgccttggagagggggacaacagctggaaacggctgctaataccgcatgatgcacggaggggacatcccttttgtgccaaagatttatcgctctgagatggcctcgcgtctgattagctggttggtggggtaacggctcaccaaggcgacgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaactgcttttgtacggggataaagtcagggacgtgtccctgtttgcatgtaccg

SEQ ID NO: 3650 - DNA, 490 bp, Unknown
  Ascusbbf_1591720, encodes 16S rRNA
agagtttgatcctggctcaggacgaacgctggcggcgtgcctaacacatgcaagtcgagcgaagcttttttagatgaaattttcggatggaatctaaaattgtcttagcggcgaacgggtgagtaacgcgtgagaaacctgcctttcacaacgggatagcctctggaaacggggattaataccgtatgacattattttttcgcatgaagagataattaaagcgtaaagcggtgaaagatggtctcgcgtcctattagttagttggtgaggtaacggctcaccaagacagcgataggtagccggcctgagagggtgaacggccacactggaactgagacacggtccagactcctacgggaggcagcagtggggaatattgcacaatggaggaaactctgatgcagcgacgccgcgtgaatgatgaaggccttcgggtcgtaaaattctgtccttggggaagataatgacggtacccaaggaggaagccccg

SEQ ID NO: 3651 - DNA, 490 bp, Unknown
  Ascusbbf_1815575, encodes 16S rRNA
agagtttgatcctggctcaggacgaacgctggcggcgtgcttaacacatgcaagtcgaacgagggaattagaagcttgcttttatgacccgagtggcaaacgggtgagtaacgcgtagacaacctgcctctcagatggggacaacatcccgaaaggggtgctaataccgaatgttgtgcaacctctgcatggaggatgcattaaaggtggtttcggccaccgctgagagatgggtctgcgtctgattagctagttggtggggtaacggcctaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagaaggtcttcggatcgtaaagctctgttgaaggggacgaagggcaggatcaggaaatgggttctgtttgacggtac

SEQ ID NO: 3652 - DNA, 468 bp, Unknown
  Ascusbbf_1519016, encodes 16S rRNA
agagtttgatcctggctcagaacgaacgctggcggcaggcctaatacatgcaagtcaaacggctcttcggagcagtggcgcacgggtgagtaacacgtgggaatctacaccaaggtacggaataacttcgggaaaccggcgctaataccgtataatatctccggatcaaagatttatcgccttgggatgagcccgcgcttgattagatagttggtggggtaatggcctaccaagtcgacgatcaatagctggtctgagaggatgatcagccacactggtactgagacacggaccagactcctacgggaggcagcagtaagggatattggacaatggaggaaactctgatccagccatgccgcgtgagtgaagaaggccttcgggttgtaaaactctttcagtagtgaagatgatgacggtaactacagaagaagctccggctaacttcgtgccagcagccgcggtaat

SEQ ID NO: 3653 - DNA, 479 bp, Unknown
  Ascusbbf_1731859, encodes 16S rRNA
agagtttgatcctggctcagaacgaacgctggcggcaggcctaacacatgcaagtcgaaggagaagcccctttcggggggtggacactggcgcacgggtgagtaacgcgtgggaatctaccccggggtggggaataaccgctggaaacggcggctaataccgcgtacgccgtattgggaaagctttagcgccctgggatgagcccgcgttagattagctagttggtggggtaacggcctaccaaggcgacgatctatagctggtctgagaggatgatcagccacactgggactgagacacggcccagactcctacgggaggcagcagtggggaatattggacaatgggcgcaagcctgatccagccatgccgcgtgcgtgaagaaggccttagggttgtaaagcgctttcactggtgaagatgatgacggtagccagagaagaagccccggctaaccacgtgccagcagccgcggtaat

SEQ ID NO: 3654 - DNA, 490 bp, Unknown
  Ascusbbf_1008590, encodes 16S rRNA
agagtttgatcatggctcaggatgaacgctggcggcgtgcctaacacatgcaagtcgagcggagtttattaaggaagtcgtaggacggaaagaataaacttagcggcggacgggtgagtaacacgtgagcaacctgcctttagctggggaataacactgggaaaccagtgctaataccgcataacatccaagtgtggcatcacatttggatcaaaggagaaatccggcaaaagatgggctcgcgtccgattagatagttggtagggtaaaggcctaccaagtcaacgatcggtagccggactgagaggttgaccggccacattgggactgagacacggcccagactcctacgggaggcagcagtggggaatattgggcaatgggggaaaccctgacccagcaacgccgcgtgaaggaagaaggtcttcggattgtaaacttctttgatcagggacgaagaaatgactgtacctgaagaacaagtcacggt

SEQ ID NO: 3655 - DNA, 490 bp, Unknown
  Ascusbbf_1398695, encodes 16S rRNA
agagtttgatcatggctcaggacgaacgctggcggcgtgcctaacacatgcaagtcgaacgggaacagtttggtttcgattgaactgttctagtggcgaacgggtgagtaacgcgtgagcaacctgcctttcagagggggacaacagctggaaacggctgctaataccgcataatctatctaatgggcatccattggatatcaaagatttatcgctgaaagatgggctcgcgtctgattagctagttggtggggtaaaagcctaccaaggcgacgatcagtagccggactgagaggttgaacggccacattgggactgagatacggcccagactcctacgggaggcagcagtggggaatattgggcaatgggggaaaccctgacccagcaacgccgcgtgaaggaagaaggctttcgggttgtaaacttctttgaccagggacgataatgacggtacctggaaaacaagccacggctaactacgtgccag

SEQ ID NO: 3656 - DNA, 490 bp, Unknown
  Ascusbbf_1581119, encodes 16S rRNA
agagtttgatcatggctcaggatgaacgctggcggcgtgcttaacacatgcaagtcgaacggggaattttatctcggtagaattcctagtggcgaacgggtgagtaacgcgtaggcaacctgcccttcagacggggacaacatcccgaaaggggtactaataccggatacgaagctcctgccgcatgacgggagcttgaaaggcgcaaacaagcgccgctgagggatgggcctgcgtccgattagcttgttggtggggtaacggcccaccaaggcgacgatcggtagccggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtg

SEQ ID NO: 3657 - DNA, 490 bp, Unknown
  Ascusbbf_1486258, encodes 16S rRNA
agagtttgatcatggctcaggatgaacgctagcgggaggcctaacacatgcaagccgagcggtagattactttcgggtaattgagagcggcgtacgggtgcggaacacgtgtgcaacctgcctttatcagggggatagcctttcgaaaggaagattaataccccataatataatgagtggcatcacttattattgaaaactgaggtggataaagatgggcacgcgcaagattagatagttggtagggtaacggcctaccaagtcgatgatctttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtatagggataaacctttccacgtgtggaaagctgaaggtactatacgaataagcaccggct

SEQ ID NO: 3658 - DNA, 490 bp, Unknown
  Ascusbbf_841799, encodes 16S rRNA
agagtttgatcatggctcaggacgaacgctggcggcgtgcttaacacatgcaagtcgaacgatgaagcctagcttgctgggtggattagtggcgaacgggtgagtaacacgtgagtaacctgcccccttcttcgggataagccttggaaacgaggtctaataccggatattcactgcctgtcgcatgatgggtggtggaaagattttttggtgggggatgggctcgcggcctatcagctagttggtggggtgatggcctaccaaggcgtcgacgggtagccggcctgagagggcgaccggccacactgggactgagacacggcgcagactcctacgggaggcagcagtggggaatattgcacaatgggcgaaagcctgatgcagcgacgccgcgtgagggatgaaggccttcgggttgtaaacctctttcgacacggaagaagctttcgggtgacggtacgtgtagaagaagcgccggctaactacgtgc

SEQ ID NO: 3659 - DNA, 490 bp, Unknown
  Ascusbbf_1567613, encodes 16S rRNA
agagtttgatcctggctcaggatgaacgctagctacaggcttaacacatgcaagtcgagcggtaaggcaccttcgggtgtacacgagcggcgaacgggtgagtaacacgtgaacaatctgcccttttctttggaataagcgttggaaacgacgtctaatgccgaatatgactctgggaggcatctcctggggtggaaagctccggcggaagaggatgagttcgcggcctatcagcttgttggtggggtaatggcccaccaaggcgacgacgggtagccggcctgagagggtgaccggccacactgggactgagacacggcccagactcctacgggaggcagcagtggggaatattggacaatgggcgaaagcctgatccagcaacgccgcgtgagggatgacggccttcgggttgtaaacctctttcagcaccgacgaagcgagagtgacggtaggtgcagaagaaggaccggccaactacgtgccagca

SEQ ID NO: 3660 - DNA, 490 bp, Unknown
  Ascusbbf_1545591, encodes 16S rRNA
agagtttgatcctggctcaggatgaacgctggcggcgtgcctaacacatgcaagtcgaacggggtacagacgccgttgaagcttcggccgaaacatgtctgtacttggtggcgaacgggtgagtaacgcgtgggcaacctgccccgtaccgggggatagcagcgggaaactgctgataataccgcataagcgcacagcacggcatcgtgtagtgtgaaaaactccggtggtacgggatgggcccgcgtctgattagctagttggcggggtaacggcccaccaaggcgacgatcagtagccgggctgagagaccggacggccacattgggactgagacacggcccagactcctacgggaggcagcagtgggggatattgcacaatgggggaaaccctgatgcagcgacgccgcgtgagtgaatgaagtatttcggtgtgtaaagctctatcagcagggaagaaagcccgcttcggcggggatgacggtacc

SEQ ID NO: 3661 - DNA, 490 bp, Unknown
  Ascusbbf_94, encodes 16S rRNA
agagtttgatcctggctcaggataaacgctggcggcgcacataagacatgcaagtcgaacggacttaactcattcttaacgattgagagcggttagtggcggactggtgagtaatgtataagtaacctgcctatcagaggggaacaacagttggaaacgactgctaataccgcatatgccacgagaatcacatggttcaagtgggaaaggagcaatccgctgatagatggacttatatctgattagctagttggtggggtaacggcctaccaaggcgacgatcagtagccggactgagaggttaaacggccacattgggactgagatacggcccagactcctacgggaggcagcagtcgggaatattgcgcaatggaggaaactctgacgcagtgacgccgcgtgcaggaagaaggttttcggattgtaaactgctttagacagggaagaaaaaagacagtacctgtagaataagctccggctaactacg

SEQ ID NO: 3662 - DNA, 490 bp, Unknown
  Ascusbbf_1354, encodes 16S rRNA
agagtttgatcctggctcaggatgaacgctggcggcgtgcctaatacatgcaagtcgaacgaggtttctcttcggggaaaccgagtggcgaacgggtgagtaacacataggtaatctacctttcagaatgggatacccaagagaaattttggctaataccgtatacaatcatttctccgcatggagatttgatgaaaggggctccaaagcctcgctgttagatgaacctgtggcacattagctagttggtgagataacagcccaccaaggcgaagatgtgtagccgatctgagaggataatcggccacaatgggactgagacacggcccatactcctacgggaggcagcagtagggagttttcggcaatgggggaaaccctgaccgagcaacgccgcgtgatttagaaggccctctgggtcgtaagaatctgttgtaaaggagaaatggtagtgggaggaaatgcccattatttgatagtactttattag

SEQ ID NO: 3663 - DNA, 490 bp, Unknown
  Ascusbbf_1476, encodes 16S rRNA
agagtttgatcctggctcaggatgaacgctggcggcgtgcttaacacatgcaagtcgaacgaagcatttttcgattcttcggaaaaggaaaatgactgagtggcggacgggtgagtaacgcgtgggaaacctgccttataccgggggatagcagttggaaacgactggtaaaaccgcataagcgcacgggtacgcatgtatctgtgtgaaaaactctggtggtataagatggtcccgcgtctgattaggcagttggcggggcagcggcccaccaaaccgacgatcagtagccgacctgagagggtgaccggccacattgggactgagacacggcccagactcctacgggaggcagcagtggggaatattgcacaatggaggaaactctgatgcagcgacgccgcgtgagtgaagaagtatttcggtatgtaaagctctttcggcagggaagataatgacggtacctgcagaagaagcaccggctaaatac

SEQ ID NO: 3664 - DNA, 490 bp, Unknown
  Ascusbbf_4725, encodes 16S rRNA
agagtttgatcctggctcaggatgaacgctagcggcaggcttaacacatgcaagtcgaggggcagcgcgggagtagcaatacttctggcggcgaccggcggaagggtgagtaacgcgtgagcaacatgcccgtaacagggggataaccgttggaaacgacgactaatatcccgtaatatatcgagaggcatctcttgatattgaaagcttcggtggttacggattggctcgcgtctgattaggcagttggcggggtaacggcccaccaaaccgacgatcagtaggggttctgagaggaaggtcccccacattggaactgagacacggtccagactcctacgggaggcagcagtgaggaatattggacaatggccggaaggctgatccagccatgccgcgtgaaggacgaaggccctatgggtcgtaaacatcttttgttgtggagcaataaggggttcgtgcagccccgatgagagtacacagcgaataa

SEQ ID NO: 3665 - DNA, 490 bp, Unknown
  Ascusbbf_594219, encodes 16S rRNA
agagtttgatcatggctcaggacgaacgctggcggcgtgcttcatacatgcaagtcgaacgataaggttccttcgggaatacataagtggcggacgggtgagtaatatgtagagaatctaccttcaagagggggacaacagagggaaactcctgctaataccccatatgcgcgtagctgagatgctattcgtgaaaactccggtgcttgaagatgagtctgcatctgattagctagttgggggtgtaacggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgatcgcagacgcccttcggggtgtaaagatctgtcagtagggacgaaaaatgactgtacctacagaggaagcaccggctaactccgtgccagcagcgcgg

SEQ ID NO: 3666 - DNA, 490 bp, Unknown
  Ascusbbf_2115, encodes 16S rRNA
agagtttgatcatggctcaggatgaacgctagcggcaggcttaacacatgcaagtcgaggggtaacaggcggtagcaatactgtgctgacgaccggcgcacgggtgcgtaacgcgtatgcaacctaccttgtacagggggataacggagtgaaaattccactaatatcccatagtgttggggaatcgcatggttcttcaactaaagcttcggtggtacaagatgggcatgcgtgacattaggtagttggcggggcaacggcccaccaagccgacgatgtctaggggagctgagaggcttatcccccacactggtactgagacacggaccagactcctacgggaggcagcagtgaggaatattggtcaatggacggaagtctgaaccagccatgccgcgtggaggaagaaggtcctatgggttgtaaactccttttgtccgagagtaataaggggcatgcgtgcctcgatgagagtatcgggcgaataagc

SEQ ID NO: 3667 - DNA, 490 bp, Unknown
  Ascusbbf_13382, encodes 16S rRNA
agagtttgatcctggctcaggacgaacgctggcggcgtgcctaatacatgcaagttgaacgcttgattttcaccgaagcttgcttcaccgaaaatcaagagtagcgaacgggtgagtaacgcgtgggtaacctacctatcagcgggggataactattggaaacgatagctaataccgcataacaattgagattgcataatcttaatttgaaagtaccaattggtacactgagagatggacccgcgttgtattagctagttggtagtgtaatggactaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacgttgcatagagtggaaagttatgcaagtga

SEQ ID NO: 3668 - DNA, 490 bp, Unknown
  Ascusbbf_10432, encodes 16S rRNA
agagtttgatcatggctcaggatgaacgctagctacaggcttaacacatgcaagtcgaggggcagcatgggcttagcttgctaagcccgatggcgaccggcgcacgggtgagtaacacgtatccaaccttccggtaactccggtatagcctttcgaaagaaagattaatcccggatagtatggtgattccgcatggtttctccattaaaggattccggttaccgatggggatgcgttccattaggcagttggcggggtaacggcccaccaaacctacgatggataggggttctgagaggaaggtcccccacattggaactgagacacggtccaaactcctacgggaggcagcagtgaggaatattggtcaatgggcggaagcctgaaccagccaagtagcgtgaaggatgactgccctatgggttgtaaacttcttttataagggaataattgtgggtacgcgtacccatttgcatgtaccttatgaata

SEQ ID NO: 3669 - DNA, 490 bp, Unknown
  Ascusbbf_7663, encodes 16S rRNA
agagtttgatcatggctcaggatgaacgctagcggcaggcttaacacatgcaagtcgaggggtaacgcggtgtagcaatacaccggcgacgaccggcgcacgggtgcgtaacgcgtatgcaacctgcctcgcacagggggataacggagtgaaaattccactaatatcccatggtgttggagatccgcatggttttccaactaaagcttcggtggtgcgagatgggcatgcgtgacattaggtagttggcggggcaacggcccaccaagccgacgatgtctaggggagctgagaggcttatcccccacactggtactgagacacggaccagactcctacgggaggcagcagtgaggaatattggtcaatggacggaagtctgaaccagccatgccgcgtggaggaagaaggtcctatgggttgtaaactccttttgtccgagagtaataaggggcatgcgtgccccgatgagagtatcgggcgaataagc

SEQ ID NO: 3670 - DNA, 470 bp, Unknown
  Ascusbbf_7474, encodes 16S rRNA
agagtttgatcatggctcagaacgaacgctggcggcaggcttaacacatgcaagtcgaacgatctcttcggagatagtggcagacgggtgagtaacacgtgggaatctacctagttcttcgggataactgagggaaacttcagctaataccggatacgcccttttggggaaagatttatcggaattagatgagcccgcgttggattagctagttggtgaggtaatggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcaccggtgaagataatgacggtaaccggagaagaagccccggctaacttcgtgccagcagccgcggtaat

SEQ ID NO: 3671 - DNA, 490 bp, Unknown
  Ascusbbf_98164, encodes 16S rRNA
agagtttgatcctggctcaggatgaacgctggcggcgtgcctaatacatgcaagtcggacggtatcagcgatgatatagtggcgaacgggtgagtaacacgttggtgacctgccccaaagatgggaatatcacctggaaacgggtggcaaaaccgaataagcttataggagttagagagctataagtaaaagagtgatctactttgggaggggcctgcggcccatcagttagttggtgagggtaacggcccaccaagacagcgacgggtaggggacctgagagggtggtcccccacaatggaactgaaacacggtccatacacctgcgggtggcagcagtagggaatattgctaaatgggcgaaagcctgaagcagcaacgccgcgtggacgaaggaggccttcgggtcgtaaagtccttttataggggaaaaggaaggatggtaccctatgaataagtctcggctaactacgtgccagcagccgcggta

SEQ ID NO: 3672 - DNA, 490 bp, Unknown
  Ascusbbf_63167, encodes 16S rRNA
agagtttgatcctggctcaggacgaacgctggcggcgtgcttaacacatgcaagtcgaacggtaaggcccttcggggtacacgagtggcgaacgggtgagtaacacgtgagtgacctgccctctacttcgggataacttccagaaatggtggctaataccggatattcacatgttcctgcatgggggtgtgtggaaagccttgtgcggtaggggatggactcgcggcctatcagcttgttggtgaggtagtggctcaccaaggcgtcgacgggtagccggcctgagagggtgaccggccacattgggactgagatacggcccagactcctacgggaggcagcagtggggaatattgcgcaatgggcggaagcctgacgcagcaacgccgcgtgcgggatgacggccttcgggttgtaaaccgctttcacgcatgacgaagcttttgtgacggtagtgcgagaagaagcaccggccaactacgtgccagca

SEQ ID NO: 3673 - DNA, 490 bp, Unknown
  Ascusbbf_56231, encodes 16S rRNA
agagtttgatcatggctcaggacgaacgctggcggcgtgcttaacacatgcaagtcgaacggggttttatttaagcttgcttttatggaacctagtggcaaacggatgagtaacgcgtagacaacctgcctttgagatggggacaacagatcgaaagatttgctaataccgaatgaagcagcattttcgcatgaaggagctgttaaaggtggcctctatttataagctaccacttaaagatgggtctgcgtctgattagctagttggtgaggtaacggctcaccaaggcgacgatcagtagccggtctgagaggatgaacggccatattgggactgagacacggcccaaactcctacgggaggcagcagtggggaatcttccgcaatgggcgaaagcctgacggagcaacgccgcgtgagtgaagaaggtcttcggatcgtaaagctctgttgttggggacgaatgttacctttgagaacattggaggta

SEQ ID NO: 3674 - DNA, 490 bp, Unknown
  Ascusbbf_8021, encodes 16S rRNA
agagtttgatcatggctcagaacgaacgctggcggcgcgttttaagcatgcaagtcgcagggtaaaattttagcaatagaattgagactggcgaacgggtgagtaacacgtgaaaatctaccttgagatgggggatagccggtagaaatatcgggtaataccgcatatgccgagaggtgaaaggggcaactgctccgtcttgagatgagtttgcgtctgattagatagttggcgaggtaaaggctcaccaagtctacgatcagtagccggcctgagagggtgatcggccacattgggactgagacacggcccagactcctacgggaggcagcagctaagaatattccgcaatgggagaaatcctgacggagcgacgccgcgtgaacgattgaaggcagaaatgttgtaaagttcttttattagggaagaataaggctggtagtggaaagatcagtcgatgacggtacctaatgaataagccacggctaac

SEQ ID NO: 3675 - DNA, 490 bp, Unknown
  Ascusbbf_8019, encodes 16S rRNA
agagtttgatcatggctcaggatgaacgctagctacaggcttaacacatgcaagtcgaggggcagcatgaatcaagcttgcttgatttgatggcgaccggcgcacgggtgcgtaacgcgtatccaatctaccctattctcagggatagccttgcgaaagtaagattaatacctgatggtcttggcgggtggcatcacctgccaagtaaagatttatcggaatgggatggggatgcgtccgattagcttgacggcggggtaacggcccaccgtggcgacgatcggtaggggttctgagaggaaggtcccccacactggaactgagacacggtccagactcctacgggaggcagcagtgaggaatattggtcaatggccgtaaggctgaaccagccaagtagcgtgagggatgacggccctacgggttgtaaacctcttttgttggggaataaagtcaggtacgtgtacctgtttgtatgtaccttacgaat

SEQ ID NO: 3676 - DNA, 490 bp, Unknown
  Ascusbbf_1324140, encodes 16S rRNA
agagtttgatcctggctcaggacgaacactggcggtatgcttaacacatgcaagtcgaacgcgaagcttcttaatgatccttcgggagatttaagaagtggatagtggcgaacgggtgagtaacgcgtgggcaacctgcctttcggagcggaatagcctcgggaaaccgggagtaaagccgcataacattattttttcgcatgaagaaataatcaaaactccggtgccgaaggatggtcccgcgtcctattagctggttggtgaggcaacggctcaccaaggcgacgatcggtagccggtcgacgaaggcgaacggccaaactggaactgagacacggtccagactcctacgggaggcagcagtggggaatattgcgcaatgggggcaaccctgacgcagcaataccgcgtgagtgaagaaggttttcggatcgtaaagctctgttattggggaagaagaagtgacggtacccaatgaggaagtcccggc

SEQ ID NO: 3677 - DNA, 471 bp, Unknown
  Ascusbbf_7829, encodes 16S rRNA
agagtttgatcatggctcagaacgaacgctggcggcaggcctaaaacatgcaagttgaacggctgtagcaatacagcagtagcgcacgggtgagtaatatatgggaacatgtcttttggtggggaatattctctggaaacggagagcaataccgcataagccctacgggggaaagatttatcgccgattgagtggcccatattggattagctagttggttgggtaacggctgaccaaggcgacgatccatagctgatctgagaggatgatcagccacactgggactgagacacggcccagactcctacgggaggcagcagttaggaatattggacaatgggggcaaccctgatccagccatgccgcgtgagtgttaaggccttcgggttgtaaagctcttttgtatgggaaaatgatgatggtaccataagaataagcaccggctaacttcgtgccagcagccgcggtaat

SEQ ID NO: 3678 - DNA, 470 bp, Unknown
  Ascusbbf_28974, encodes 16S rRNA
agagtttgatcctggctcagaacgaacgctggcggcaggcttaacacatgcaagtcgagcgggcccttcggggtcagcggcagacgggtgagtaacgcgtgggaatctacccatccctacggaacaactccgggaaactggagctaataccgtatacgccctttgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgaatgatgaaggccttagggttgtaaagttctttcaccggagaagataatgacggtatccggagaagaagccccggctaacttcgtgccagcagccgcggtaat

SEQ ID NO: 3679 - DNA, 489 bp, Unknown
  Ascusbbf_27824, encodes 16S rRNA
agagtttgatcatggctcagaacgaacgctggcggcatggattaggcatgcaagtcgaacgaagcagcaatgcttagtggcggaagggtgaggaacgcgtgagtaatctgcccccaagttgggaataacagttggaaacgactgctaataccgaatgtggctgcgaggtcgcatgattttgcagttaaagatttattgcttggggatgagctcgcgtcccattagttagttggcggggcaacggcccaccaagacgatgatgggtagctggtctgagaggatggtcagccacactgggactgagacactgcccagactcctacgggaggctgcagtcgagaatcttgggcaatgcgcgaaagcgtgacccagcaatgccgcgtgcgtgatgaaggtcttcggattgtaaagcgctgtcaaccgggacgaaattctgacggtaccggtgaaggaagccacggctaactacgtgccagcagccgcggtaat

SEQ ID NO: 3680 - DNA, 490 bp, Unknown
  Ascusbbf_127786, encodes 16S rRNA
agagtttgatcctggctcaggacgaacgctggcggcgtgcttaacacatgcaagtcgaacggggcgattgaaagcttgcttttgagagcctagtggcaaacgggtgagtaacgcgtaggcaacctgcctttgggatggggacaacaggacgaaagccctgctaataccgaatgaagtattcttcctgcatgggaaggatatgaaagatggcctctgaaaatgctatcgcctgaagatgggcctgcgtctgattagctggttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgttggggacgaatggcgctgaggcgaacagtcttggtgaatg

SEQ ID NO: 3681 - DNA, 468 bp, Unknown
  Ascusbbf_39962, encodes 16S rRNA
agagtttgatcctggctcagaacgaacgctggcggcaggcttaacacatgcaagtcgagcgcctcgcaagaggagcggcagacgggtgagtaacgcgtgggaatctaccgagccctaaggaataactccgggaaactggaactaataccttatacgccctacgggggaaagatttatcggggtttgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccgatgaagataatgactgtagtcggagaagaagccccggctaacttcgtgccagcagccgcggtaat

SEQ ID NO: 3682 - DNA, 490 bp, Unknown
  Ascusbbf_74993, encodes 16S rRNA
agagtttgatcatggctcaggacgaacgctggcggcgtgcttcacacatgcaagtcgaacggaaaggccctttcgggggtactcgagtggcgaacgggtgagtaacacgtgagtaatctgcctttggctttgggataagcctcggaaacggggtctaataccggatatgacacttcaccgcatggtgtgggtgtggaaagtttttcggctgaagatgggctcgcggtctatcagcttgttggtggggtaatggctcaccaaggctttgacgggtagccggcctgagagggcgaccggccacactgggactgagacacggcccagactcctacgggaggcagcagtggggaatattgcgcaatgggcggaagcctgacgcagcgacgccgcgtgagggatgacggccttcgggttgtaaacctctttcggtaccgacgaagcgttaagtgacggtaggtgcagaagaagcgccggctaactacgtgccagc

SEQ ID NO: 3683 - DNA, 490 bp, Unknown
  Ascusbbf_38141, encodes 16S rRNA
agagtttgatcatggctcaggatgaacgctagcggcaggcctaatacatgcaagtcgaacggtaaatgccccttcgggggtatgagagtggcgcacgggtgcgtaacgcgtatgcaacccacccgctgtcgggggatagcccggagaaattcggattaataccccatgaggagttctggaggcatctccgggatttcaaaactacggtgacggcggacgggcatgcgtgccattagatagttggcggggtaacggcccaccaagtcgacgatggctaggggatctgagaggacggtcccccacactggtactgagacacggaccagactcctacgggaggcagcagtaagggatattggtcaatggggggaaccctgaaccagccatgccgcgtgagggaataaggccctatgggtcgtaaacctcttttgccgggggataaagacagctacgtgtagttgtttgaaggtacccggagaataagcatcgg

SEQ ID NO: 3684 - DNA, 490 bp, Unknown
  Ascusbbf_117131, encodes 16S rRNA
agagtttgatcatggctcagaacgaacgctggcggcgtggttgatacatgcaagtcgaacgggaatgagggcttcggccctttagtacagtggcggacgggtgagtaacacgtaatcaacctgccctcaagatggggatagccttccgaaagggagggtaatacctgataagcccacagtgcggcatcgcacagtggtaaaaggtggggaccttcgggcctgccgcttgaggatgggattgcgtcctattagcttgttggcggggtaacggcccaccaaggcgatgatgggtaaccggcctgagagggtgaacggtcacattggaactgagacacggtccagactcctacgggaggcagcagtgctgaatcattcgctaatgcgcgaaagcgtgacggtgcgacgccgcgtgcaggaagaaggccttcgggttgtaaactgctgtcagtatttaggaaacaacatattttaatagaatatgtcttgacta

SEQ ID NO: 3685 - DNA, 490 bp, Unknown
  Ascusbbf_137361, encodes 16S rRNA
agagtttgatcatggctcagaacgaacgctggcggcaggcctaacacatgcaagtcgagcgtgaaagggaacttcggttcctgagtaaagcggcgcacgggtgagtaacacgtgaataatctgcccttatgaccgggataacagaccgaaaggactgctaataccggataagcttccgcgccaaccgggcgagtggagaaaagtacgggaccttcgggccgtacgcatgaggatgagttcgcgttccattagatagttggtgaggtaatggctcaccaagtctacgatggatagctggtctaagaggatgatcagccacactggaactgagacacggtccagactcctacgggaggcagcagtggggaatcttgcgcaatggaggaaactctgacgcagccatgccgcgtgagtgatgaaggccctcgggttgtaaagctctgtctaaggggacgaatggcgttatgaacaagacacatgacgattgacg

SEQ ID NO: 3686 - DNA, 490 bp, Unknown
  Ascusbbf_25994, encodes 16S rRNA
agagtttgatcatggctcaggatgaacgctagctacaggcttaacacatgcaagtcgagcggaacaccttcgggtgtttagcggcagacgggtgagtaacacgtatccaacctttcccttacccgggtatagcctctggaaacggagagtaatccccgatgtggtgcacgttccgcatgttatgcgcaccaaagattcatcggtaaggggtggggatgcgttccattaggtagtaggcggggcaacggcccacctagccgatgatggataggggttctgagaggaaggtcccccacattggaactgcgacacggtccaaactcctacgggaggcagcagtgaggaatattggtcaatgggcgagagcctgaaccagccaagtagcgtgcaggatgacggccctatgggttgtaaactgcttttgtacgggaataacggtctttacgtgtagagatgtgcatgtaccgtacgaataaggatcggctaactc

SEQ ID NO: 3687 - DNA, 490 bp, Unknown
  Ascusbbf_29347, encodes 16S rRNA
agagtttgatcatggctcaggacgaacgctggcggcgtgcttaatacatgcaagtcgaacgtgtactttcgggtacaagtggcgcacgggtgagtaacgcgtagatgatctacccttgagattgagataaccttgggaaactggggctaataccgaacaacgcacatctgttggttcagatgtgttaaagtggcgcaagtcacgcttgaggatgagtctgcggcctatcagttagttggtggggtaacggcctaccaagacgaagacgggtagctgatctgagaggatgatcagccacattgggactgagacacggcccaaactcctacgggaggcagcagtagggaatattgcgcaatggaggcaactctgacgcagcgacgccgcgtgagtgatgacggccattttggttgtaaagctctgtagagggggaagaatgttacggtgcagagccgtaagtgacggtacccctaaagtaaggaccggctaa

SEQ ID NO: 3688 - DNA, 490 bp, Unknown
  Ascusbbf_46657, encodes 16S rRNA
agagtttgatcatggctcaggacgaacgctggcggcgtgcttcatacatgcaagtcgaacgagaagctcacttcggtgagtggaaagtggcggacgggtgagtaacatgtagggaatctacccttgggatggggacaacagctggaaacggctgctaaaacccgatatgagtattgttgagatataatacttgaaaactccggtgcccaaggatgagcctgcacctgattagctagttggtggtgtaatggactaccaaggcgacgatcagtagctggtttgagaggatgatcagccacaatgggactgagacacggcccatactcctacgggaggcagcagtagggaattttgcgcaatgggggaaaccctgacgcagcaacgccgcgtggacgaagaagcccttcggggtgtaaagttctgtcagtggggacgaacgaatgacggtacccacagaggaagcaccggctaactccgtgccagcagccgc

SEQ ID NO: 3689 - DNA, 490 bp, Unknown
  Ascusbbf_33697, encodes 16S rRNA
agagtttgatcctggctcaggacgaacgctggcggcgtgcctaacacatgcaagtcgaacgggatgaaagaagcttgcttctggaatctagtggcggacgggtgagtaacacgtgagcaacctgcctttcagaggggaataatgtctggaaacggacactaataccgcatgacatattctgatcgcatgataaggatatcaaaggagcaatccgctgaaagatgggctcgcgtctgattagccagttggcggggtaacggcccaccaaagcgacgatcagtagccggactgagaggttgaacggccacattgggactgagacacggcccagactcctacgggaggcagcagtgggggatattgcacaatgggcgcaagcctgatgcagcaacgccgcgtgcgggaagacggtcttcggattgtaaaccgctgtcctctgtgacgataatgacggtagcagaggaggaagccacggctaactacgtgccag

SEQ ID NO: 3690 - DNA, 490 bp, Unknown
  Ascusbbf_124296, encodes 16S rRNA
agagtttgatcctggctcaggatgaacgctagcggcaggcttaacacatgcaagtcgaggggcagcgagggtagcaatacctgtcggcgaccggcggaagggtgcgtaacgcgtgagcaacttgcccgtatctgggggatagtcactggaaacggtgcgtaataccccataacaacggatcccgcatgggaactgtttgaaagaatttcggatacggataggctcgcgagacattagctagttggcggggtaacggcccaccaaggcgacgatgtctaggggttctgagaggaaggtcccccacattggaactgagacacggtccaaactcctacgggaggcagcagtgaggaatattggtcaatggccgaaaggctgaaccagccatgccgcgtgcaggattaaggccctatgggtcgtaaactgcttttgtggtggagcaataagacgtacgtgtacgtcgatgagagtacatcacgaataagcatcg

SEQ ID NO: 3691 - DNA, 490 bp, Unknown
  Ascusbbf_1139841, encodes 16S rRNA
agagtttgatcatggctcaggacgaacgctggcggcgtgcttaaaacatgcaagtcgaacgagaaaggggcttcggccctgagtagagtggcgcacgggtgagtaacacgtgaataatctacctgaggatttgggataacattccgaaaggagtgctaataccggataagcccacgacttcttcgaaagttgcgggaaaaggcgggaacttgttcctgctgtcttcagatgagttcgcggcccattagctagttggtgaggtaagggctcaccaaggcgacgatgggtagctggtctgagaggatgatcagccacactggaactgagacacggtccagactcctacgggaggcagcagtggggaattttgcgcaatgggcgaaagcctgacgcagcaacgccgcgtgagtgatgaaggctttcgagtcgtaaagctctgtcagaggggaagaacaacctggagttgaacaagctctgggcctgacggtac

SEQ ID NO: 3692 - DNA, 490 bp, Unknown
  Ascusbbf_91611, encodes 16S rRNA
agagtttgatcatggctcaggatgaacgctggcggcaggcttaatacatgcaagtcggacggtaacgcgctggtagcaatactggtggcgacgagtggcggatgggtgcgtaacgcgtatgcaacctgccccttattggaggataacgttgtgaaaacggcgataatattccatgtgcacgctggggggcatcctctggtgtgtaaagattcattgataagggatgggcatgcgtatcattaggtagttggcggggtaacggcccaccaagccgacgatgattaggggtcctgagagggcaaccccccacactggaactgagacacggtccagactcctacgggaggcagcagtagggaatattgggcaatggaggcaactctgacccagccatgccgcgtgaaggaagacggccctatgggttgtaaacttcttttgttgcagagtaaaggcggggacgtgtccccgtgtgagagtatgcgacgaataa

SEQ ID NO: 3693 - DNA, 490 bp, Unknown
  Ascusbbf_76245, encodes 16S rRNA
agagtttgatcctggctcaggacgaacgctggcggcgtgcttaaaacatgcaagtcgaacggagttaaattaagcttgcttaatttaacttagtggcggacgggtgagtaacgcgtgagcaatctgcctatcacaggggaataacgactggaaacgggcgctaataccgcatatgaccacaacctggcatcaggaaggggtgaaaggagagatccggtgatagatgagcttgcgtctcattagctagttggcgaggtaacggcccaccaaggcaacgatgagtagccgatctgagaggatgaacggccacattggaactgagaaacggtccaaactcctacgggaggcagcagttaggaatattgggcaatggaggaaactctgacccagcaacgccgcgtgaaggaagaaggtcttcggattgtaaacttctgatctgtggaaaaaataaagtgatggtaccacaggagcaagccacggctaactacgt

SEQ ID NO: 3694 - DNA, 490 bp, Unknown
  Ascusbbf_330869, encodes 16S rRNA
agagtttgatcatggctcaggatgaacgctggcggcatgcctaagacatgcaagtcgaacgaggtggcccaatgaagatggagtgcttgcacaaagttggatttggatttccacctagtggcggacgggtgagtaacacgtgggtgacctacctttaagactgggataactactagaaatggtagctaataccggataacacatagtttcgtttctatgttaaaaggagcctttaaagcttcacttttagatgggcctgcggtgtattagctagtcggtggggtaacggcctaccgaggcaacgatgcatagccgaactgagaggttgatcggccacattgggactgagacacggcccaaactcctacgggagacagcagttaggaatattcgtcaatgggggaaaccctgaacgagcaatgccgcgtgaacgatgaaggccctatgggttgtaaagttctgttgtatgggaagaatggttaggatagga

SEQ ID NO: 3695 - DNA, 490 bp, Unknown
  Ascusbbf_103585, encodes 16S rRNA
agagtttgatcatggctcaggacgaacgctggcggcgcgcctaacacatgcaagtcgaacggagcattgcgctgaaatgagaacagcttgctggaggaatttcatgcaatgcttagtggcggacgggtgagtaacacgtgagcaacctgcctttgtgagggggacaacatctggaaacggatgctaataccgcataatgtgtgcagatcgcatgatcagcacaccaaagatttatcgcacaaagatgggctcgcggctgattagatagttggcggggtaacggcccaccaagtcgacgatcagtagccggactgagaggttgaacggccacattgggactgagacacggcccagactcctacgggaggcagcagtgggggatattgcacaatggggggaaccctgatgcagcgacgccgcgtgagggaagaaggttttcggattgtaaacctctgtcttgcgggacgataatgacggtaccgcaggagga

SEQ ID NO: 3696 - DNA, 490 bp, Unknown
  Ascusbbf_100737, encodes 16S rRNA
agagtttgatcatggctcaggataaacgctggcaccatgcctaatacatgcatgtcgtacgagagcttcggctcgagtggcaaatgggtgagtaacacgtaaggaacctgccctagcgacgaggataacggttggaaacgactgctaatactggatagtatatcgaaccgcatgatttgatatttaaagcagcttcggctgcacgctaggatggccttgcggcgcattagatagttggtgaggtaacggcccaccaagtcagtgatgcgtagctgaactgagaggttaaacagccacattgggactgagacacggcccaaactcctacgggaggcagcagtagggaattttcggcaatgggcgaaagcctgaccgagcaatggtgcgtgaacgatgaagatccttggatcgtaaagttcttttataagggaagaatacattaagtaggtaatgacttagtgctgacggtaccttttgaataagctccggc

SEQ ID NO: 3697 - DNA, 490 bp, Unknown
  Ascusbbf_50222, encodes 16S rRNA
agagtttgatcatggctcaggacgaacgctggcggcgtgcttaatacatgcaagtcgaacgtgtaccttcgggtacaagtggcgcacgggtgagtaacgcgtagatgatctacccttgagtttgagataacctcgggaaactggggctaataccgaacaacgcatcggaattgggtttctgatgttaaagtggcgcaagtcacgcttgaggatgagtctgcggcctatcagttagttggtggggtaacggcctaccaagacgaagacgggtagctgatctgagaggatgatcagccacattgggactgagacacggcccaaactcctacgggaggcagcagtagggaatattgcgcaatggaggcaactctgacgcagcgacgccgcgtgagtgatgacggccattttggttgtaaagctctgtagagggggaagaatgttacggtgcagagccgtaagtgacggtacccctaaagtaaggaccggctaa

SEQ ID NO: 3698 - DNA, 490 bp, Unknown
  Ascusbbf_138255, encodes 16S rRNA
agagtttgatcatggctcaggacgaacgctggcggcgtgcttaacacatgcaagtcgaacgggatttagtagacagaagcttcggtggaagattactaatgagagtggcgaacgggtgagtaacgcgtgagcaacctgcctatgacagtgggatagcctcgggaaaccgggattaataccgcataaaatcgtagaaacacatgttttaacggtcaaagaattatcggtcatagatgggctcgcgtctgattagctagttggtgagataacagcccaccaaggcgacgatcagtagccggtctgagaggatgaacggccacattggaactgagacacggtccaaactcctacgggaggcagcagtggggaatattgcacaatgggggaaaccctgatgcagcgacgccgcgtgaacgaagaaggtattcgtatcgtaaagttctgtcctatgggaagataatgacagtaccatagaagaaagctccggcta

SEQ ID NO: 3699 - DNA, 490 bp, Unknown
  Ascusbbf_92899, encodes 16S rRNA
agagtttgatcatggctcaggatgaacgctggcggcgtgcctaacacatgcaagtcgaacgaagctctggttacggaggcttcggccaaagcaaccggatgactgagtggcggacgggtgagtaacgcgtgggcaacctgccccattatgggggatagcagttggaaacgactggtaataccgcataagcgcacgggaaggcatctttctgtgtgaaaagatttatcgtaatgggatggacccgcgtctgattagatagttggtgaggtaacggcccaccaagtcgacgatcagtagccggactgagaggtcggacggccacattgggactgagagacggcccaaactcctacgggaggcagcagtgggggatattgcacaatggggggaaccctgatgcagcgacgccgcgtgagtgaagaagtatttcggtatgtaaagctctatcgacagggaagaaaggccccgcaaggggagatgacggtacctg

SEQ ID NO: 3700 - DNA, 490 bp, Unknown
  Ascusbbf_205992, encodes 16S rRNA
agagtttgatcatggctcaggatgaacgctagcggcaggcttaacacatgcaagtcgaggggcagcgcgggtagcaatacctggcggcgaccggcgcaagggtgcgtaacgcgtgagcaatctgcccgtgtcagggggataagcgatggaaacgtcgtctaataccgcataacaacggtcacggcatcatgaccgtttgaaagatacgtcggacacggatgagctcgcgagacattagctggttggcggggtaacggcccaccaaggctgcgatgtctaggggaactgagaggttggtcccccacactggaactgagacacggtccagactcctacgggaggcagcagtgaggaatattggacaatggtcggaagactgatccagccatgccgcgtggaggttaaggtcctatggattgtaaactccttttgagagggagcaataagtgtcacgtgtgacacgatgagagtacctttcgaataagcatcg

SEQ ID NO: 3701 - DNA, 490 bp, Unknown
  Ascusbbf_57276, encodes 16S rRNA
agagtttgatcatggctcaggatgaacgctagcgacaggcctaacacatgcaagtcggggggcagcatgagcgtagcaatacgtttgatggcgaccggcgtacgggtgcgtaacgggtgtgcaatctgtccacagtcgggggatagcccgccgaaaggcgaattaagactccatgtgatgttatgaggcatcttgtgacattgaaacgcgaggactgtgggtgagcacgcttctgattagatagttggtagggtaacggcctaccaagtcgacgatcagtaggggttctgagaggaagatcccccacattggaactgagacacggtccagactcctacgggaggcagcagtgaggagtattggtcaatgggcgagagcctgaaccagccaagtcgcgtgaaggaagaaggttctatggattgtaaacttcttttattcgagggtaaagtgtgtcatgcgtggcatattgcaagtatcgaatgaataagca

SEQ ID NO: 3702 - DNA, 490 bp, Unknown
  Ascusbbf_199816, encodes 16S rRNA
agagtttgatcctggctcaggacgaacgctggcggcgtgcttaacacatgcaagtcgaacggattaggtctagtacttgtactagtcttaattagtggcggactggtgagtaacgcgtgagcaacctacctctaacagggggataacacttagaaataggtgctaataccgcataatattgtttaccggcatcggtgaatgatcaaagtgaatatagcggttagagatgggctcgcgtatcattagctagttggtgaggtaacggcccaccaaggcgacgatgattagccgatctgagaggatgaccggccacactgggactgagatacggcccagactcctacgggaggcagcagtggggaatattgggcaatggaggaaactctgacccagcaacgccgcgtgaaggaagaaggccttcgggttgtaaacttctgttatgagggaaaaagaagtgatggtacctcatgagaaagctacggctaactac

SEQ ID NO: 3703 - DNA, 490 bp, Unknown
  Ascusbbf_181971, encodes 16S rRNA
agagtttgatcatggctcaggatgaacgctggcggcgtgcctaacacatgcaagtcgaacgaagctcccctacggatctcttcggagtgaaggaggggatgactgagtggcggacgggtgagtaacgcgtgggtaatctgccctgtacagggggacaacagccagaaatagctgctaataccgcatgagcgcacagcaccgcatggtgcagtgtgaaaaactgaggtggtacaggatgagcccgcgtctgattagttagttggcagggtaacggcctaccaagacgacgatcagtagccggcctgagagggtgaacggccacattgggactgagacacggcccagactcctacgggaggcagcagtggggaatattgcacaatgggggaaaccctgatgcagcaacgccgcgtgagtgaagaagtatctcggtatgtaaagctctatcagcagggaagaaaatgacggtacctgactaagaagctccggc

SEQ ID NO: 3704 - DNA, 490 bp, Unknown
  Ascusbbf_422659, encodes 16S rRNA
agagtttgatcctggctcaggatgaacgctagctacaggcttaacacatgcaagtcgaggggcagcatgatcttagcttgctaagattgatggcgaccggcgcacgggtgcgtaacgcgtatccaacctgccgtgtacttggggatagccctctgaaaggaggattaatacccgatgtggttacggagagacatctctctgtaattaaagatttatcggtacaccgatggggatgcgtacgattagctagttggcggggtaacggcccaccaaggcgacgatcgttaggggttctgagaggaaggtcccccacataggaactgagacacggtcctaactcctacgggaggcagcagtgaggaatattggtcaatgggcgagagcctgaaccagccaagtagcgtgaaggaagactgccctatgggttgtaaacttcttttatcggggaataaagtgcgtcacgtgtggcgttttgtatgtacccgatgaa

SEQ ID NO: 3705 - DNA, 490 bp, Unknown
  Ascusbbf_108551, encodes 16S rRNA
agagtttgatcatggctcagaacgaacgctggcggcgcgtcttaagcatgcaagtcgaacggcaagatggaagcttgcttctatcctagagtggcggactggtgagtaacgcgtgggtgatttgccctccggacgggaatagccggtagaaataccggataatgccggatacggtgcagtgtgtcagaggcactgcaggaaaggaactttagttccgccggaggagaagcccgcgtaccattagctagttggtgaggtaacggcccaccaaggcgatgatggttacccggcctaagagggtgatcgggcacattgggactgagatacggcccagactcctacgggaggcagcagctaagaatattccgcaatggacgaaagtctgacggagcgacgccgcgtggatgatgaaggccggaaggttgtaaaatccttttaagcatgaagaataaggagactgagagaaacggtctctggtgacggtagtgct

SEQ ID NO: 3706 - DNA, 470 bp, Unknown
  Ascusbbf_84323, encodes 16S rRNA
agagtttgatcatggctcagaacgaacgctggcggcaggcctaacacatgcaagtcgaacgcatccttcgggatgagtggcagacgggtgagtaacacgtgggaatctacccaatggtgcggaataacacagggaaacttgtgctaataccgcataagcccttcgggggaaagatttatcgccattggatgagcccgcgtcggattagcttgttggtagggtaatggcctaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagcggggaagataatgacggtacccgcagaagaagccccggctaacttcgtgccagcagccgcggtaat

SEQ ID NO: 3707 - DNA, 490 bp, Unknown
  Ascusbbf_212954, encodes 16S rRNA
agagtttgatcatggctcaggatgaacgctggcggcgtgcctaacacatgcaagtcgagcggagatagatggaagcctagcgatgtctatcttagcggcggatgggtgagtaacacgtgggtaacctgccctgtactgggggataacagctggaaacggctgttaataccgcatatgcgcacggagccgcatggccctgggcggaaagattaatcggtacaggatgggcccgcgccggattaacttgttggcggggtaacggcccaccaaggtgatgatccgtagccgacctgagagggtgaccggccacattgggactgagacacggcccaaactcctacgggaggcagcagtgggggatattgcacaatgggggaaaccctgatgcagcgacgccgcgtgaaggatgacgtatttcggtatgtaaacttctatcagcggggaagaagatgacggtacccgcacaagaagccccggctaactacgtgcc

SEQ ID NO: 3708 - DNA, 490 bp, Unknown
  Ascusbbf_1425345, encodes 16S rRNA
agagtttgatcctggctcaggatgaacgctggcggcgtgcctaatacatgcaagtcgagcgaatgaatgggagcttgctccctgacattagcggcggacgggtgagtaacacgtgggcaacctgccctgcagatggggataactccgggaaaccggggctaataccgaataatcagttcctccgcatggaggaactctgaaagacggtttcggctgtcactgcaggatgggcccgcggcgcattagctagttggtggggtaatggcctaccaaggcaacgatgcgtagccgacctgagagggtgatcggccacactgggactgagacacggcccagactcctacgggaggcagcagtagggaatcttccacaatggacgaaagtctgatggagcaacgccgcgtgagcgaagaaggttttcggatcgtaaagctctgttgtgagggaagaacaagtacgggagtaactgcccgtaccttgacggtacctc

SEQ ID NO: 3709 - DNA, 490 bp, Unknown
  Ascusbbf_672647, encodes 16S rRNA
agagtttgatcatggctcaggacgaacgctggcggcgtgcttaacacatgcaagtcgaacgagacttagggaagagcttgctcggaactatgtcgagtggcggacgggtgagtaacgcgtgaataatctgtctcatacagggggataacgcatcgaaagatatgctaataccgcgtaggaccacagtgtcgcatggcacaggggtgaaaggagcaatccagtatgaggtgagttcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgaaagcctgacccagcaacgccgcgtgaaggaagaaggttttcggatcgtaaacttctgtcctatatgaagagcagtagacggtagtataggaggaagccccggctaacta

SEQ ID NO: 3710 - DNA, 490 bp, Unknown
  Ascusbbf_739065, encodes 16S rRNA
agagtttgatcctggctcaggatgaacgctggcggcgtgcctaacacatgcaagtcgaacgaagctctgagacggaatcttcggaggaagtcgaggaagacttagtggcggacgggtgagtaacgcgtgagcaacctgcctttcggagggggataacgattggaaacgatcgctaataccgcataacatatacatatcgcatggtatatatatcaaagctgaggcgccgaaagatgggctcgcgtccgattagatagttggtgaggtaacggctcaccaagtcgacgatcggtagccggactgagaggttgaacggccacattgggactgagacacggcccagactcctacgggaggcagcagtgggggatattgcacaatgggcgaaagcctgatgcagcaacgccgcgtgagggaagacggttttcggattgtaaacctctgtctttggtgaagaagcaagtgacggtaaccgaggaggaagccacgg

SEQ ID NO: 3711 - DNA, 490 bp, Unknown
  Ascusbbf_158082, encodes 16S rRNA
agagtttgatcatggctcaggatgaacgctagcggcaggcctaacacatgcaagtcgaggggtaacgcgaggtagcaataccttggcgacgaccggcgcacgggtgcgtaacgcgtatgcaacctacctttaagagggggataacggagggaaacttccactaataccccgtatagtcacagggccgcatgaccctgtgacgaaagcttcggtgcttaaagatgggcatgcgtgacattagctagttggcggggcaacggcccaccaaggctgcgatgtctaggggagctgagaggctaatcccccacactggtactgagacacggaccagactcctacgggaggcagcagtgaggaatattggtcaatggtcggaagactgaaccagccatgccgcgtgagggaagaaggccctatgggttgtaaacctcttttgcacgggagtaataagggtcttgcgaggtccgatgagagtaccgtgcgaataagc

SEQ ID NO: 3712 - DNA, 490 bp, Unknown
  Ascusbbf_298595, encodes 16S rRNA
agagtttgatcatggctcaggatgaacgctggcggcgtgcgtaacacatgcaagttgagcgacgacgtttctgaagtggcaacatggaagggacgagcggagcagcggacgggtgagtaagacatgagaagctgtcctgtggtggggggcaacgtctggaaacggacgctaataccccatatgccgagaggtgaaagccgcaaggtgccataggaggtgctcgtggcctatcagctagttggtgaggtaatggctcaccaaggcgacgacgggtagccggcctgagagggtgaccggccacactgggactgagatacggcccagactcctacgggaggcagcagtggggaatattgggcaatgggagcaatcctgacccagcgacgccgcgtgaatgacgaaggccttcgggtcgtaaagttcttttatgtgggaagaagaaagtgacggtaccacatgaataagccccggctaactacgtgccagcagc

SEQ ID NO: 3713 - DNA, 490 bp, Unknown
  Ascusbbf_181725, encodes 16S rRNA
agagtttgatcatggctcagagtgaacgctggcggcgtggctaagacatgcaagtcgggcggtcatatgctttcgggcatatgatagcggcaaacgggtgagtaacacgtaagtaacctacccttaagactgggatagcccagcgaaagttggggtaataccggatgataaccgtgggagcattttcatggatttaaaggtatgagaagacgcttaaggaggggcttgcggcctatcagctagttggaggtgtaacggacccccaaggcgaagacgggtagccggtctgagaggacgaacggccacattggaactgagacacggtccagacatctacggatggcagcagtttcgaattattcacaatgggcgaaagcctgatggtgcgacgtcgcgtggaggaagaaggtctttggattgtaaactcctgtcattagggagcaaagtgcaagtggagagcttgttttgagttaacctaaagaggaagcag

SEQ ID NO: 3714 - DNA, 490 bp, Unknown
  Ascusbbf_648223, encodes 16S rRNA
agagtttgatcatggctcaggatgaacgctagctacaggcttaacacatgcaagtcgaggggcagcatggtcttagcttgctaaggctgattgcgaccggcgcacgggtgagtaacgcgtatccaacctttcccctggtagggcatagcccggcgaaagtcggattaataccctatgttatccgaagaggacatctgattcggatcaaagatttatcgccatgggatggggatgcgtccgattaggttgacggcggggtgacggcccaccgtgcccgcgatcggtaggggttctgagaggaaggtcccccacattggaactgagacacggtccaaactcctacgggaggcagcagtgaggaatattggtcaatgggcgtaagcctgaaccagccaagtagcgtgcgggacgacggccctatgggttgtaaaccgcttttgcaggggaataaagtgaggcacgtgtgcctttttgcatgtaccctgagaat

SEQ ID NO: 3715 - DNA, 490 bp, Unknown
  Ascusbbf_423786, encodes 16S rRNA
agagtttgatcctggctcagaacgaacgctggcggcgcgtcttaagcatgcaagtcgaacggcagggcgggtgcttgcacctgcctcagagtggcggactggtgagtaacacgtgggtgacttacccttcggatggggatagcctttagaaataaggggtaataccgaatacggttgccggcgataagggccggtaaggaaaggagctacggctccgccgaaggagaggcctgcggcctattagttagttggtggggtaacggcctaccaaggcaatgacgggtatccggcctgagagggtgaacggacacattgggactgagatacggcccagactcctacgggaggcagcagctaagaatattccgcaatggacgaaagtctgacggagcgacgccgcgtggacgatgaaggccggaaggttgtaaagtccttttggatatgaggaataaacactgcagggaatggcagtgcggtgactgtagtatct

SEQ ID NO: 3716 - DNA, 490 bp, Unknown
  Ascusbbf_89651, encodes 16S rRNA
agagtttgatcatggctcaggatgaacgctagcgacaggcctaacacatgcaagtcgaggggcagcggggtgcttgcaccgccggcgaccggcgcacgggtgagtaacgcgtatgcgacctgcccgccaccgcgggatagcctcccgaaagggagattaacaccgcatggtccggagcctataaaggggttccggcaaacgcgagggtggcggatgggcatgcgtcccattaggcagcaggcggggtaacggcccacctggccgacgatgggtaggggtcctgagagggaggtcccccacactggtactgagacacggaccagactcctacgggaggcagcagtgaggaatattggtcaatgggcgagagcctgaaccagccatgtcgcgtgcaggactacggccctacgggtcttaaactgcttttgattggggataaaggaggggacgcgtccccttttgcaggtaccaatcgaataaggatcggcta

SEQ ID NO: 3717 - DNA, 490 bp, Unknown
  Ascusbbf_188084, encodes 16S rRNA
agagtttgatcatggctcaggatgaacgctggcggcgtgcctaacacatgcaagtcgagcgggagtatcgcaaacagagattcgtcaaagtgagcgatatgagagcggcggacgggtgagtaacgcgtaggtaacctaccttaagctgagggataacccagggaaacttgggataataccacataacgcggtgaagtcacatggctttaccgccaaagatttatcggcgtaagatggacctgcgtctgattagccagttggtggggtaacggcctaccaaagcaacgatcagtagccgacctgagagggtgatcggccacattggaactgagacacggtccaaactcctacgggaggcagcagtggggaatattgcacaatgggcgcaagcctgatgcagcaacgccgcgtgagcgaagaaggtcttcggatcgtaaagctctgtccttggggacgaaggaagtgacggtacccaaggaggaagccccgg

SEQ ID NO: 3718 - DNA, 490 bp, Unknown
  Ascusbbf_302055, encodes 16S rRNA
agagtttgatcatggctcaggatgaacgctagcggcaggcttaacacatgcaagtcgaggggcagcgcggggagcaatctctggcggcgaccggcggaagggtgagtaacgcgtgagcaacatgccctgtggagggggatagtcactggaaacggtgcgtaataccccgtaacaacggaggaggcatctcttctgtttaaaagattcattgtcacaggattggctcgcgtctgattaggtagttggcggggtaacggcccaccaagccgacgatcagtaggggttctgagaggaaggtcccccacattggaactgagacacggtccagactcctacgggaggcagcagtgaggaatattggacaatggccgagaggctgatccagccatgccgcgtgatggaataaggccctatgggtcgtaaacatcttttgagagggagcaataaggacgtcgtgacgtccgatgagagtacctttcgaataagcatc

SEQ ID NO: 3719 - DNA, 490 bp, Unknown
  Ascusbbf_254264, encodes 16S rRNA
agagtttgatcatggctcaggatgaacgctggcggcgtgcgtaacacatgcaagttgagcgacgacgtgctggaagtggcgacatggaaggcatgagcggagcagcggacgggtgagtataacatgagaagctgtccaatggcggggggcaacgtctggaaacggacgctaataccccataagccgagaggtaaaagccgaaaggcgccaagggaggcgctcgtgccctatcagctagttggtgaggtaatggctcaccaaggcgacgacgggtagccggcctgagagggtgaccggccacactgggactgagatacggcccagactcctacgggaggcagcagtggggaatattgggcaatgggagaaatcctgacccagcgacgccgcgtgaacgaagaaggccttcgggtcgtaaagttcttttatgggggaagaaggaagtgacggtaccccatgaataagccccggctaactacgtgccagcagc

SEQ ID NO: 3720 - DNA, 481 bp, Unknown
  Ascusbbf_92821, encodes 16S rRNA
agagtttgatcatggctcagaacgaacgctggcggcaggcctaacacatgcaagtcgaaggagaagttcctcttcggagggatggacactggcgcacgggtgagtaacgcgtgggaatctaccccggggtggggaataaccgctggaaacggcggctaataccgcatacgccgtattgggaaagctttagcgccctgggatgagcccgcgttagattagctagttggtggggtaatggcccaccaaggcgacgatctatagctggtctgagaggatgatcagccacactgggactgagacacggcccagactcctacgggaggcagcagtggggaatattggacaatgggggcaaccctgatccagccatgccgcgtgcgtgaagaaggccttagggttgtaaagcgctttcactggtgaagatgatgacggtagccagagaagaagccccggctaactccgtgccagcagccgcggtaat

SEQ ID NO: 3721 - DNA, 490 bp, Unknown
  Ascusbbf_77405, encodes 16S rRNA
agagtttgatcatggctcaggacgaacgctggcggtatgcttaacacatgcaagtcgaacgggcgttaaagagcttgctctttttctgctagtggcggacgggtgagtaacgcgtgagtaatctgccttgaagtgggggataacacttagaaatgagtgctaataccgcgtgatgtactagcttcgcatgaagcctgtaccatagtttttcgcttcaagatgagctcgcgtccgattagtttgttggcgaggtaaatgctcaccaagactgcgatcggtagccgggttgagagaccgaccggccacattgggactgagacacggcccagactcctacgggaggcagcagtggggaatattgcacaatgagggaaaccttgatgcagcaataccgcgtgagggatgaaggctcttgggttgtaaacctctgtccaaagggacgaattttgacggtacctttgaagaaagctccggctaactacgtgccagc

SEQ ID NO: 3722 - DNA, 490 bp, Unknown
  Ascusbbf_759206, encodes 16S rRNA
agagtttgatcatggctcaggacgaacgctggcggcgtgcctaatacatgcaagtcgagcggacgaatcgaaagcttgcttttgattcgttagcggcggacgggtgagtaacacgtgggcaacctgccctgtagacggggataacaccgagaaatcggtgctaataccggataacacgaaatgtcgcatgacgtttcgttgaaagacggcgcaagctgtcgctacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtaacgcagtaactggcgttaccgtgacggtacc

SEQ ID NO: 3723 - DNA, 490 bp, Unknown
  Ascusbbf_289467, encodes 16S rRNA
agagtttgatcatggctcagaacgaacgttagcggcgcgcttaacacatgcaagtcgaacgagaaagggtgccttcgggtaccccggtaaagtggcgcacgggtgagtaacacgtgggtaacctacccccgggcgggggataacgtaccgaaagggacgctaataccgcataagaccacggcctgaaacggttgaggtcaaagtgagcctcttcatgaaagctcacacctggggatgggcccgcggcccatcaggttgttggtggggtaacggcctaccaagcctaagacgggtagctggtctgagaggatgatcagccacactggaactgagacacggtccagactcctacgggaggcagcagtggggaatcttgcgcaatgggcgaaagcctgacgcagcgacgccgcgtgagtgatgaaggccctagggttgtaaagctctgtggagagggacgaataagccatggttaatagccatggtgatgacg

SEQ ID NO: 3724 - DNA, 490 bp, Unknown
  Ascusbbf_1595900, encodes 16S rRNA
agagtttgatcatggctcaggatgaacgctagcggcaggcttaacacatgcaagtcgaacggagcttgagagcttgctttcaagcttagtggcggacgggtgagtaacgcgtgagcaacctgcctctaagtggggaataatgtactgaaaaggacactaataccgcataatgtatatgagtcgcatggcttgtgtaccaaagatttatcgcttagagatgggctcgcgtccgattagccagttggtggggtaacggcctaccaaagcaacgatcggtagccggactgagaggttgaacggccacattgggactgagacacggcccagactcctacgggaggcagcagtgggggatattgcgcaatgggggaaaccctgacgcagcaatgccgcgtgaaggatgaaggtcttcggattgtaaacttcttttgttggggatgaataatgacggtacccaacgaataagctccggctaactacgtgccagcag

SEQ ID NO: 3725 - DNA, 490 bp, Unknown
  Ascusbbf_1484439, encodes 16S rRNA
agagtttgatcatggctcaggatgaacgctggcggcgtgcctaacacatgcaagtcgaacggacttttcatcttagaggcttcggccaaagaggtttaaagttagtggcggacgggtgagtaacgcgtggagaacctgcctcatgctgggggataacagtgagaaatcactgctaataccgcataagcgcacgaaggcgcatgcctttgtgtgaaaaactccggtggcatgagatggctccgcgttggattagccagttggcggggtaacggcccaccaaagcatcgatccatagccggcctgagagggtgaacggccacattgggactgagacacggcccagactcctacgggaggcagcagtggggaatattgcacaatggggggaaccctgatgcagcgacgccgcgtgaaggaagaagtatctcggtatgtaaacttctatcgacagggaagataatgacggtacctgaataagaagccccggcta

SEQ ID NO: 3726 - DNA, 490 bp, Unknown
  Ascusbbf_376252, encodes 16S rRNA
agagtttgatcctggctcaggatgaacgctagctacaggcttaacacatgcaagtcgaggggcatcaggaagaaagcttgctttctttgctggcgaccggcgcacgggtgagtaacacgtatccaacctgccctttactcggggatagcctttcgaaagaaagattaatacccgatggcataatgattccgcatggtttcattattaaaggattccggtaaaggatggggatgcgttccattaggttgttggtgaggtaacggcccaccaagccttcgatggataggggttctgagaggaaggtcccccacattggaactgagacacggtccaaactcctacgggaggcagcagtgaggaatattggtcaatgggcgctagcctgaaccagccaagtagcgtgaaggatgaaggctctatgggtcgtaaacttcttttatataagaataaagtgcagtatgtatactgttttgtatgtattatatgaata

SEQ ID NO: 3727 - DNA, 490 bp, Unknown
  Ascusbbf_228896, encodes 16S rRNA
agagtttgatcctggctcaggacgaacgctggcggcatgcctaacacatgcaagtcgaacggagctgagagagcttgctttttcagcttagtggcggacgggtgagtaacgcgtgagtaacctgcctttcagtggggaataatgttctgaaaaggacactaataccgcataacgtatagaggccgcatgacctttgtaccaaagatttatcgctgagagatggactcgcgtccgattagccagttggtggggtaacggcctaccaaagcaacgatcggtagccggactgagaggttgaacggccacattgggactgagacacggcccagactcctacgggaggcagcagtgggggatattgcgcaatggggggaaccctgacgcagcaatgccgcgtgaaggatgaaggtcttcggattgtaaacttcttttgtcaaggacgaaagttgacggtacttgacgaataagctccggctaactacgtgccagc

SEQ ID NO: 3728 - DNA, 490 bp, Unknown
  Ascusbbf_162375, encodes 16S rRNA
agagtttgatcatggctcagagtgaacgctggcggcgtggttaagacatgcaagtcgagcgggatttatcatcatgagtcttcggataaatgaggatgatgagagcggcaaacgggtgcgtaacacgtaaacaacttgccctttagtctgggatagctcaccgaaaggtggattaataccggatgtggttttctttcgcatgaaagagatactaaagcttgcaatggcgctagaggagaggtttgcgtcctatcagcttgatggtgaggtgaaggcttaccatggctaagacgggtagctggtctgagaggatgatcagccacagtggaactgagatacggtccacacacctacgggtggcagcagtttcgaatcattcacaatgggcgaaagcctgatggtgcaacgccgcgtgggggatgaaggttctcgaatcgtaaacccctgtcgccgaggaacaaaatctgggttcatagtccggcttgagtta

SEQ ID NO: 3729 - DNA, 490 bp, Unknown
  Ascusbbf_125948, encodes 16S rRNA
agagtttgatcatggctcaggatgaacgctggcggcaggcttaatacatgcaagtcggacggtaacatgcgggtagcaatacctgtgatgacgagtggcggatgggtgcgtaacgcgtatgcaacctgccccttattggaggataacgttgtgaaaacggcgataatattccatgtgtaccctggggggcatcccttggggtataaagattcattgataagggatgggcatgcgtatcattaggtagttggcggggtaacggcccaccaagccgacgatgattaggggtcctgagagggcaaccccccacactggaactgagacacggtccagactcctacgggaggcagcagtagggaatattgggcaatggaggcaactctgacccagccatgccgcgtgaaggaaggcggtcctatggattgtaaacttcttttgttgcagagtaaaggcggggacgcgtccccgtgtgagagtatgcgacgaataa

SEQ ID NO: 3730 - DNA, 490 bp, Unknown
  Ascusbbf_211093, encodes 16S rRNA
agagtttgatcatggctcaggatgaacgctggcggcgtgcttaacacatgcaagtcgaacggagagaaatataggaagttttcggatggaatatatggatcttagtggcggacgggtgagtaacgcgtaaacaatctgccttagagagggggataacagatagaaatatttgctaataccgcataagaccacagtgaggcatctcacaggggtaaaaggagaaatccgctttaagatgagtttgcgtactattagctagttggtgaggtaacggcccaccaaggcaacgatggttagccggcctgagagggtgaacggccacattggaactgagaaacggtccagactcctacgggaggcagcagtgaggaatattgggcaatggaggaaactctgacccagcaacgccgcgtgaaggaagaaggttttaggattgtaaacttctgttataggggaagaaaaagatgacggtaccctatgagaaagctac

SEQ ID NO: 3731 - DNA, 490 bp, Unknown
  Ascusbbf_83865, encodes 16S rRNA
agagtttgatcatggctcaggatgaacgctggcggcgtgcttaacacatgcaagtcgaacggaggttatgacttcggttgtaaccttagtggcggacgggtgagtaacgcgtgggcaacctgccttacaccgggggataacagttggaaacgactgctaataccgcataagaccacagtaccgcatggtacaggggtaaaagccgagacgatgtaagatggacccgcgtctgattagctggttggtgaggtaacggcccaccaaggcgacgatcagtagccgacctgagagggtgatcggccacattgggactgagacacggcccaaactcctacgggaggcagcagtggggaatattgcacaatggggggaaccctgatgcagcgacgccgcgtgagtgaagaagtatttcggtatgtaaagctctatcagcagggaagataatgacggtacctgactaagaagcaccgactaaatacgtgccagcagc

SEQ ID NO: 3732 - DNA, 490 bp, Unknown
  Ascusbbf_191122, encodes 16S rRNA
agagtttgatcatggctcaggatgaacgctggcggcgtgcctaacacatgcaagtcgaacggactgataggtgcttgcaccttgaaagttagtggcggacgggtgagtaacgcgtgagtaacctgcccttcagagggggacaacagttggaaacgactgctaataccgcataagaccacactatcgcatggtagagaggtcaaaggagcaatccgctgaaggatggactcgcgtccgattagatagttggcggggtaacggcccaccaagtcgacgatcggtagccggactgagaggttgaacggccacattgggactgagacacggcccagactcctacgggaggcagcagtgagggatattgcacaatgggcgcaagcctgatgcagcaacgccgcgtgaaggatgaaggttttcggattgtaaacttcttttctcattgacgaactcttgacggtaaatgaggaataagccacggctaactacgtgc

SEQ ID NO: 3733 - DNA, 490 bp, Unknown
  Ascusbbf_179140, encodes 16S rRNA
agagtttgatcctggctcaggacgaacgctggcggcgtgcctaacacatgcaagtcgaacggagccaaccgacggaagccttcgggcagaagatggtgaagcttagtggcggacgggtgagtaacgcgtgagtaacctgcctgtaagagggggataacacagagaaatctgtgctaataccccatattgaatatatttcgcatggaaaatatttgaaagatttatcgcttacagatggactcgcgtctgattagatagttggtagggtaacggcctaccaagtcgacgatcagtagccgaactgagaggttgatcggccacattgggactgagacacggcccagactcctacgggaggcagcagtgggggatattgcgcaatggggggaaccctgacgcagcaacgccgcgtgaaggaagaaggtcttcggattgtaaacttctgttcttagggaagaataagatgacggtacctaaggagcaagtcacg

SEQ ID NO: 3734 - DNA, 490 bp, Unknown
  Ascusbbf_714263, encodes 16S rRNA
agagtttgatcatggctcagagcgaacgctagctacaggcttaacacatgcaagtcgagcggaacaccttcgggcgtttagcggcagacgggtgagtaacacgtatccaacctttcccttactcgggtatagcctcgggaaactgagagtaatccccgatgtggtgcactgaaagcattttttgcgcacgaaagatttatcggtaaggggtggggatgcgttccattaggtagtaggcggggtaacggcccacctagccgatgatggataggggttctgagaggaaggtcccccacattggaactgcgacacggtccaaactcctacgggaggcagcagtgaggaatattggtcaatgggcgagagcctgaaccagccaagtagcgtgcaggatgacggccctatgggttgtaaactgcttttgtacgggaataaagtgacccacgtgtgggtttttgcatgtaccgtaagaataaggaccggctaattc

SEQ ID NO: 3735 - DNA, 473 bp, Unknown
  Ascusbbf_183632, encodes 16S rRNA
agagtttgatcatggctcagaacgaacgctggcggcaggcctaagtcatgcaagttgaacggctgtagcaatacagcagtagcggacgggtgagtaatgtatgggaacgtatcttctagtggggaatattctttggaaacgaagagcaataccgcataagtcctacgggagaaagtcgcaagacgctagatgagcggcccatattggattagctagttggttgggtaatggctgaccaaggcaacgatccatagctggtctaagaggacgatcagccacattgggactgagacacggcccagactcctacgggaggcagcagtcaggaatattggacaatgggggcaaccctgatccagccatgccgcgtgagtgttaaggtcttcggattgtaaagctcttttgtgtgggaaaatgatgatggtaccacaagaataagcaccggctaacttcgtgccagcagccgcggtaat

SEQ ID NO: 3736 - DNA, 490 bp, Unknown
  Ascusbbf_310885, encodes 16S rRNA
agagtttgatcctggctcagattgaacgctggcggcaggcctaacacatgcaagtcgagcggcagcgacaacattgaaccttcgggggatttgttgggcggcgagcggcggacgggtgagtaatgcctgggaaattgccctgatgtgggggataaccattggaaacgatggctaataccgcatgatagcttcggctcaaagagggggaccttcgggcctctcgcgtcaggatatgcccaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagcagtgaggaagggggtatcgttaatagcggtatcctttgacgtta

SEQ ID NO: 3737 - DNA, 490 bp, Unknown
  Ascusbbf_150905, encodes 16S rRNA
agagtttgatcatggctcaggatgaacgctggcggcgtgcttaacacatgcaagtcgaacggagatgcgtagtagaagttttcggatggaaattgcacatcttagtggcggacgggtgagtaacacgtaaacaatctgccttcaagagcgggacaacagatagaaatatttgctaataccgcataagaccacagaaacgcatgttttaggggtaaaagggagcaattcgcttgaagatgagtttgcggactattagctagttggtgaggtaacggcccaccaaggcaaagatggttagccgacctgagagggtgatcggccacactggaactgagatacggtccagactcctacgggaggcagcagtgaggaatattgggcaatggaggaaactctgacccagcaacgccgcgtgaaggaagaaggttttaggattgtaaacttctgttatggaggaaaaaggaagtgatggtactccatgagcaagcta

SEQ ID NO: 3738 - DNA, 490 bp, Unknown
  Ascusbbf_126975, encodes 16S rRNA
agagtttgatcatggctcaggatgaacgctagcggcaggcttaacacatgcaagtcgaggggtaacaggcggtagcaatactgtgctgacgaccggcgcacgggtgcgtaacgcgtatgcaacctaccttcaacagggggataagcgggagaaattctgtctaataccccatagagtctagagggcacatgttttttagactaaagccttggtggttggagatgggcatgcgtgacattaggtagttggcggggcaacggcccaccaagccgacgatgtctaggggagctgagaggctagacccccacactggtactgagacacggaccagactcctacgggaggcagcagtgaggaatattggtcaatggagggaactctgaaccagccatgccgcgtgagggaagacggtcctatgggttgtaaacctcttttgcacgggagcaataagtgtcctgcggggcatgatgagagtaccgtgcgaataagc

SEQ ID NO: 3739 - DNA, 490 bp, Unknown
  Ascusbbf_502853, encodes 16S rRNA
agagtttgatcctggctcagaacgaacgctggcggcgcgtcttaagcatgcaagtcgaatggcaagataagagcttgctcttatcctagaatggcggactggtgagtaacgcgtgggtgacgtacctcttggatggggatagctactggaaacagtagataataccgaataagctgcatggatttagaggccatgcaggaaagcagcttttgctgcaccgagagagcggcccgcgggctattagcttgttggcggggtaacggcccaccaaggcgacgatagctacccggcctaagagggtgatcgggaacattgggactgagatacggcccagactcctacgggaggcagcagctaagaatattccgcaatggacgaaagtctgacggagcgacgccgcgtggacgaggaaggccggaaggttgtaaagtccttttatgactgaggaataagcagagtgagagaaacgctttgtggtgactgtaggtca

SEQ ID NO: 3740 - DNA, 490 bp, Unknown
  Ascusbbf_212131, encodes 16S rRNA
agagtttgatcatggctcagagtgaacgctggcggcgtggctaagacatgcaagtcgagcggtcatatgctttcgggcatatgatagcggcaaacgggtgagtaacacgtaagtaacctacccttaagacagggatagcccgatgaaagttggggtaataccggatgaggaccattggtgcatgctaatggatcgaaaggtaaggaagtacgcttaaggaggggcttgcggcctatcagctagttggtggtgtaacggaccaccgaggcgaagacgggtagccggtctgagaggacgaacggccacattggaactgagacacggtccagacatctacggatggcagcagtttcgaattattcacaatgggcgaaagcctgatggtgcgacgtcgcgtggaggaagaaggtctttggattgtaaactcctgtcattagggagcaaagtgcaagtggagagcttgttttgagttaacctaaagaggaagcag

SEQ ID NO: 3741 - DNA, 490 bp, Unknown
  Ascusbbf_400903, encodes 16S rRNA
agagtttgatcctggctcagattgaacgctggcggcatgctttacacatgcaagtcgaacggtaacagggagcttgctccgctgacgagtggcgaacgggtgagtaatgcatcggaacgtgcctatttgtgggggataacgtagcgaaagttacgctaataccgcatacgccctgagggggaaagcgggggattcgtaagaacctcgcgcaattagagcggccgatgtcggattagctagttggtggggtaaaggctcaccaaggcgacgatccgtagcgggtctgagaggatgatccgccacactgggactgagacacggcccagactcctacgggaggcagcagtggggaattttggacaatgggcgaaagcctgatccagccatgccgcgtgagtgaagaaggccttcgggttgtaaagctctttcagccggaaagaaatcgcgcaggctaatactctgcgtggatgacggtaccggaagaagaagc

SEQ ID NO: 3742 - DNA, 490 bp, Unknown
  Ascusbbf_95498, encodes 16S rRNA
agagtttgatcctggctcaggacgaacgctggcggcacgcttaacacatgcaagtcgaacggagtaattgagagcttgcttttgattacttagtggcggacgggtgagtaacacgtgagcaacctgcctttgagagtggaatagcttctggaaacggatggtaataccgcataacattacggggccgcatgaccctgtaatcaaagatttatcgctcaaagatgggctcgcgtctgattaggtagttggtgaggtaacggctcaccaagccgacgatcagtagccggactgagaggttgaacggccacattgggactgagacacggcccagactcctacgggaggcagcagtggggaatattgcacaatgggcggaagcctgatgcagcgatgccgcgtggaggaagaaggttttcggattgtaaactcctgatctgagggacgataatgacggtacctcaggagaaagctccggctaactacgtgccag

SEQ ID NO: 3743 - DNA, 490 bp, Unknown
  Ascusbbf_501614, encodes 16S rRNA
agagtttgatcatggctcaggatgaacgctagcgaaatgcctaacacatgcaagtcgaacggaccttgcgtcgtagtaatacgtagtaaggttagtggcaaacgagcgagtaacgcgtgcttaacctgccccgaagttgggtataactacagagatgtagctaattcccaatatgctcacgatggtgaaatcccaatgggaggaaagatttatcgcttcgggaggggggtgcgtcctatcagatagttggtgaggtaacggcttaccaagtctatgacgggtaaccggtctgagatgatgtccggtcgcgatgggactgagatacggcccatactcctacgggaggcagcagtggggaatcttgcacaatggacgaaagtctgatgcagcaatttcgcgtgaaggatgaagcattacggtgtgtaaacttcttttttggcagaagacgaatgacggtatgtcaagaataagagacggctaactacgtgcc

SEQ ID NO: 3744 - DNA, 490 bp, Unknown
  Ascusbbf_644149, encodes 16S rRNA
agagtttgatcatggctcaggatgaacgctagctacaggcttaacacatgcaagtcgagcggtccagcaatggatagcggcgaacgggtgagtaacgcgtaagcaatctgccccctgctcgggaatagccgtgccaacgcgcggataataccggatatcgtggggccccgcatagggccttgacaaaagatttatcggcaggggatgagcttgcgtccgattagctagttggcggggcaacggcccaccaaggcgacgatcggtagccggcctgagagggtgatcggccacattgggactgagatacggcccagactcctacgggaggcagcagtagggaatattgcacaatgggggaaaccctgatgcagcaacgccacatgtgggaagaagcatttcggtgtgtaaaccactgtcgtgagggaataaggctatttttcggagtagttgaatgtacctcgagaggaagcaccggcaaacttcgtgccag

SEQ ID NO: 3745 - DNA, 490 bp, Unknown
  Ascusbbf_502229, encodes 16S rRNA
agagtttgatcatggctcaggatgaacgctggcggcgtgcctaacacatgcaagtcgaacggaaggtaagcgcttcggagacttcggtcaatgtttgcttatctttagtggcggacgggtgagtaacgcgtggataacctgcctcacacagggggataacagttagaaatgactgctaataccgcataagcgcacagtctcgcatgggacagtgtgaaaaaccgaggtggtgtgagatggatccgcgtctgattagccagttggcggggtaacggcccaccaaagcgacgatcagtagccggcctgagagggtgaacggccacattgggactgagacacggcccaaactcctacgggaggcagcagtgggggatattgcacaatgggggaaaccctgatgcagcgacgccgcgtgagtgaagaagtatttcggtatgtaaagctctatcagcagggaagataatgacggtacctgactaagaagcaccgg

SEQ ID NO: 3746 - DNA, 490 bp, Unknown
  Ascusbbf_724524, encodes 16S rRNA
agagtttgatcatggctcaggacgaacgctggcggcatgcctaatacatgcaagtcgagcgaacagatgaggagcttgctcctctgacgttagcggcggatgggtgagtaacacgtgggcaacctgccctgcagatggggataactccgggaaaccggtgctaataccgaataacccattctctcgcatgagagaatgttaaaagacggcttcggctgtcactgcaggatgggcccgcggcgcattagctagttggtaaggtaacggcttaccaaggccacgatgcgtagccgacctgagagggtgatcggccacactgggactgagacacggcccagactcctacgggaggcagcagtagggaatcttccacaatggacggaagtctgatggagcaatgccgcgtgagcgaagaaggttttcggatcgtaaagctctgttgtgagggaagaacaagtataggagtaactgcctgtaccttgacggtacc

SEQ ID NO: 3747 - DNA, 490 bp, Unknown
  Ascusbbf_182818, encodes 16S rRNA
agagtttgatcatggctcaggatgaacgctggcggcgtgcttaacacattcaagtcgaacgggaagtcgggagcttgctcctgatggatagtggcggacgggtgagtaacgcgtgagcaacctgccttgatgtggggaataacacagggaaacttgtgctaataccgcataatgtatatgtatcacatggtactgtataccaaagctacggtgcattgagatgggctcgcgttggattagatagttggtggggtaacggcctaccaagtcaacgatccatagccggactgagaggttgaacggccacattggaactgagatacggtccagactcctacgggaggcagcagtgaggaatattgggcaatgggcataagcctgacccagcgacgccgcgtgagggaagaaggtcttcggattgtaaaccttagttatcagggaagaagaaagtgacggtacctgaagagaaagccacggctaactacgtgcc

SEQ ID NO: 3748 - DNA, 490 bp, Unknown
  Ascusbbf_62991, encodes 16S rRNA
agagtttgatcatggctcaggattaacgctggcggcatgcctaatacatgcaagtcgaacggaatgaatgagtagcttgctacgagttcatttagtggcggacgggtgagtaacgcgtgaacaatctgcctgtgagaggggaataacacttagaaataggtgctaattccgcataacactactttacggcatcgtagagtggtcaaaggtttcgcaagattccgctcacagatgagtttgcgtatcattagctagttggtgaggtaacggcccaccaaggcaacgatggttagccggcctgagagggtgaacggccacattggaactgagaacggttcagactcctacgggaggcagcagtaaggaatattgggcaatgggcgaaagcctgacccagcaatgccgcgtgaaggatgaatgtcttcggattgtaaacttctaagcatggggaaaatagtgatggtacccatagataagtcacggcaaacta

SEQ ID NO: 3749 - DNA, 490 bp, Unknown
  Ascusbbf_1874186, encodes 16S rRNA
agagtttgatcctggctcaggagaaacgctggcggcgcacataagacatgcaagtcgaacggaactttattgaatgtttacaggatataaagtttagtggcggacgggtgagtaacacgtgagcaacctgcctttaagagggggataacattgagaaatcagtgctaataccgcataaagcatatccaccgcatgatggatataagccaaaggagaaatccgcttaaagatgggctcgcgtctgattagttagttggtggggtaacggcctaccaagacgatgatcagtagccgagctgagaggcacaacggccacattgggactgagatacggcccagactcctacgggaggcagcagtcgggaatattgcacaatgggggaaaccctgatgcagtgacgccgcgtataggaagaaggtctttggattgtaaactattgtcgacagggaagaaaaaaatgacagtacctgtggaggaagccccggcaaa

SEQ ID NO: 3750 - DNA, 490 bp, Unknown
  Ascusbbf_283583, encodes 16S rRNA
agagtttgatcctggctcaggacgaacgctggcggcacgcctaacacatgcaagtcgaacggagtattttggagcttgctttgaaatacttagtggcggacgggtgagtaacacgtgagcaacctgcctttaagagcggaatagcttctggaaacggatggtaataccgcataacattaccggatcgcatggtctggtaatcaaagatttatcgcttaaagatgggctcgcgtctgattagatagttggtggggtaacggcctaccaagtcgacgatcagtagccggactgagaggttgaacggccacattgggactgagacacggcccagactcctacgggaggcagcagtggggaatattgcacaatgggcggaagcctgatgcagcgatgccgcgtggaggaagaaggttttcggattgtaaactccttttatcagggacgaagaatgacggtacctgaagaaaaagctccggctaactacgtgcca

SEQ ID NO: 3751 - DNA, 490 bp, Unknown
  Ascusbbf_294972, encodes 16S rRNA
agagtttgatcatggctcaggacgaacgctggcggcgtgcctaacacatgcaagtcgaacggagatataccgaatgaaggtttcgattggattttagtatatcttagtggcggacgggtgagtaacgcgtgagtaacctgccaatgagagtggaataacgttctgaaaagaacgctaataccgcataacatatcgaagccgcatgactttgatatcaaagattttatcgctcattgatggactcgcgtccgattagccagttggcggggtaacggcccaccaaagcgacgatcggtagccggactgagaggttgaacggccacattgggactgagacacggcccagactcctacgggaggcagcagtgggggatattgcgcaatgggggaaaccctgacgcagcaacgccgcgtgaaggaagacggtcttcggattgtaaacttcttttgtcgaggacgaagaaagtgacggtactcgacgaataagctc

SEQ ID NO: 3752 - DNA, 490 bp, Unknown
  Ascusbbf_273807, encodes 16S rRNA
agagtttgatcatggctcagattgaacgctggcggcaggcctaacacatgcaagtcgagcggcagcgggaccttcgggtcgccggcgagcggcggacgggtgagtaatgcctaggaatctgcctgttagtgggggataacgcggggaaactcgcgctaataccgcatacgtcctacgggagaaagtgggggaccctcgggcctcacgctaacagatgagcctaggtcggattagctagttggtggggtaaaggcccaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcgctcggtgaatacccaggcgtcttgacgttaccgacagaataagcac

SEQ ID NO: 3753 - DNA, 490 bp, Unknown
  Ascusbbf_436698, encodes 16S rRNA
agagtttgatcctggctcaggatgaacgctagcggcaggcctaacacatgcaagtcgaggggcagcggggtgtagcaatacactgccggcgaccggcgcacgggtgcgtaacgcgtatgcaacctgccccgtacaggggtataacggagagaaatttccactaattccccatgaagtcacgaggtcgcatggccttgtgtctaaagcctcggtggtacgggatgggcatgcgtgacattagctagttggcggggcaacggcccaccaaggcgacgatgtctaggggagctgagaggctaatcccccacactggtactgagacacggaccagactcctacgggaggcagcagtgaggaatattggtcaatggagggaactctgaaccagccatgccgcgtgagggaagaaggccctacgggttgtaaacctcttttgcacgggagtaataagggcggtgcgccgtccgatgagagtaccgtgcgaataagc

SEQ ID NO: 3754 - DNA, 367 bp, Unknown
  Ascusbbf_350906, encodes 16S rRNA
agagtttgatcatggctcaggacgaacgctggcggcgtgcctaacacatgcaagtcgagcggggatgatggaagagcttgctcggaaatcatcctagcggcggacgggtgagtaacgcgtgagcaacctgtcccagacagggggataccagatggaaacatctgctaataccgcataagaccacggggtcgcatggctctggggtaaaaggagcaatccggtttggggtgggctcgcgtccgattagctggttggtgaggtaacggcccaccaaggcgacgatcggtagccgacctgagagggtgatcggccacattggaactgagacacggtccaaactcctacgggagccagcagccgcggtaat

SEQ ID NO: 3755 - DNA, 490 bp, Unknown
  Ascusbbf_281040, encodes 16S rRNA
agagtttgatcatggctcaggacgaacgctggcggcgtgcttaaaacatgcaagtcgaacggaaagtttgggagcttgcttctagacttttagtggcaaacgggtgagtaacgcgtgggtaatctgccttatacagggggataacagttggaaacgactgctaataccgcataagaccacaatgtcatgaggacataggggtaaaagggataactggtataagatgagcctgcgtttcattagctagttggtgaggtaacggcccaccaaggcaacgatggatagccggtctgagaggacgaacggccacaatggaactgagacacggtccatactcctacgggaggcagcagttaggaatattgggcaatggaggaaactctgacccagcaacgccgcgtgaaggaagaaggttttcggattgtaaacttctgtattatgagacaaagaaagtgatggtatcataatagaaagctacggcaaactacgt

SEQ ID NO: 3756 - DNA, 490 bp, Unknown
  Ascusbbf_1721409, encodes 16S rRNA
agagtttgatcctggctcagaacgaacgctggcggcaggcctaacacatgcaagtcgagcgagaaaggggcttcggccctgagtagagcggcgcacgggtgagtaacacgtgaataatctgccccttagaccgggataacagaccgaaaggactgctaataccggataagcccacgtcccaaccggggatgcgggaaaagcacgggaccgcaaggccgtgcgctttgggatgagttcgcgttccattagatagttggtgaggtaatggctcaccaagtcgacgatggatagctggtcttagaggatgatcagccacactggaactgagacacggtccagactcctacgggaggcagcagtggggaatcttgcgcaatgggggaaaccctgacgcagccatgccgcgtgagcgatgaaggccttcgggttgtaaagctccgtctaaggggacgaatggcgctgtgaacaagacacacggcgattgacggta

SEQ ID NO: 3757 - DNA, 490 bp, Unknown
  Ascusbbf_390709, encodes 16S rRNA
agagtttgatcatggctcaggatgaacgctggcggcgtgcttaacacatgcaagtcgaacgaagcattttggaatgcggcttcggccaaaggaagagatgacttagtggcggacgggtgagtaacgcgtgggtaacctgcctcttactgggggataacagttagaaatgactgctaataccgcataagaccacggtaccgcatggtacaggggtaaaagatttattgataagagatggacccgcgtctgattagttagttggtgaggtaacggcccaccaagaccgcgatcagtagccgacctgagagggtgatcggccacattgggactgagacacggcccaaactcctacgggaggcagcagtggggaatattgcacaatgggggaaaccctgatgcagcgacgccgcgtgagtgaagaagtatttcggtatgtaaagctctttaagcagggaagataatgacggtacctgcagaataagcaccggct

SEQ ID NO: 3758 - DNA, 490 bp, Unknown
  Ascusbbf_1525410, encodes 16S rRNA
agagtttgatcctggctcaggacgaacgctggcggcgtgcctaacacatgcaagtcgaacgggacttaaattttgaagttttcggatggaaagatttaagtttagtggcggacgggtgagtaacgcgtgagtaacctgcctttcagagggggataacgtactgaaaaggacgctaataccgcataacatattgaagccgcatgactttaatatcaaaggagcaatccgctgaaagatggactcgcgtccgattagctagttggcgggataaaggcccaccaaggcgacgatcggtagccggactgagaggttgaacggccacattgggactgagacacggcccagactcctacgggaggcagcagtgggggatattgcgcaatgggggaaaccctgacgcagcaacgccgcgtgaaggaagacggttttcggattgtaaacttcttttgtcagggacgataatgacggtacctgacgaataagctccggc

SEQ ID NO: 3759 - DNA, 490 bp, Unknown
  Ascusbbf_503843, encodes 16S rRNA
agagtttgatcatggctcaggacgaacgctggcggcgtgcctaacacatgcaagtcgaacggaagcgtacattagaagttttcggatggaagatatacgttttagtggcggacgggtgagtaacgcgtgagtaacctgcctttcagagggggataacgttttgaaaagaacgctaataccgcataacgtaaaggagtcgcatggcttcattaccaaaggagcaatccgctgagagatggactcgcgtccgattagccggttggcggggtaacggcccaccaaagcaacgatcggtagccggactgagaggttgaacggccacattgggactgagacacggcccagactcctacgggaggcagcagtgggggatattgcgcaatgggggaaaccctgacgcagcaacgccgcgtgaatgaggaaggtcttcggattgtaaaattcttttgtcagggacgaagaagtgacggtacctgacgaataagctccg

SEQ ID NO: 3760 - DNA, 490 bp, Unknown
  Ascusbbf_1796360, encodes 16S rRNA
agagtttgatcctggctcaggacgaacgctggcggcgtgcttaacacatgcaagtcgaacgatgaagccgaagcttgctttggtggattagtggcgaacgggtgagtaatacgtgagcaacctgccctccgcttcgggataagccctggaaacggggtctaataccggatgtttccttccttccgcatggttggttggggaaaggtgttttctggcgggggatgggctcgcggcctatcagcttgttggtggggtgatggcctaccaaggcgtcgacgggtagccggcctgagagggtgaccggccacattgggactgagatacggcccagactcctacgggaggcagcagtgggggatattgcgcaatgggcggaagcctgacgcagcgacgccgtgtgggggatgaaggctttcgggttgtaaacccctttcggccaggaacaaggcagggtttcctgttgagggtactggcataagaagcgccggct

SEQ ID NO: 3761 - DNA, 490 bp, Unknown
  Ascusbbf_297893, encodes 16S rRNA
agagtttgatcatggctcaggatgaacgctggcggcgtgcctaacacatgcaagtcgagcgggaatgtccggaatgaaacttcggtcgaatgaagggcaggatagcggcggacgggtgagtaacgcgtaggtaagctgccccttgcacagggatagcctcgggaaactgggattaatacctgataaagcgcagacagcacatgctgactgcgccaaagatttatcggcgagggatgcacctgcgtctgattagttagttggtggggtaacggcccaccaagacagcgatcagtagccgacctgagagggtgatcggccacattggaactgagacacggtccaaactcctacgggaggcagcagtggggaatattgcacaatggagggaactctgatgcagcaacgccgcgtgagcgaagaaggtcttcggatcgtaaagctctgtcctaagggacgagaaaggacggtaccttaggaggaagccccggct

SEQ ID NO: 3762 - DNA, 490 bp, Unknown
  Ascusbbf_141279, encodes 16S rRNA
agagtttgatcatggctcaggacgaacgctggcggcgtgcctaacacatgcaagtcgaacggaaattgccatcggaagttttcggatggaagaaggcagttttagtggcggacgggtgagtaacgcgtgagtaacctgcctttcagagggggataacgtactgaaaaggacgctaataccgcataacatacagataccgcatggtgactgtatcaaaggagcaatccgctgaaagatggactcgcgtccgattagctagttggcgggataaaggcccaccaaggcgacgatcggtagccggactgagaggttgaacggccacattgggactgagacacggcccagactcctacgggaggcagcagtgggggatattgcgcaatgggggaaaccctgacgcagcaacgccgcgtgaaggaagacggttttcggattgtaaacttcttttgtcagggacgaagaatgacggtacctgacgaataagctccgg

SEQ ID NO: 3763 - DNA, 490 bp, Unknown
  Ascusbbf_1294359, encodes 16S rRNA
agagtttgatcatggctcaggataaacgctggcggcgcacataagacatgcaagtcgaacggaagtcgtaacttttgaagtggattgaagatttatcagattgaaatggatttagttacaatggctttagtggcggactggtgagtaacacgtaagcaacctgcctattagaggggaataacaatgagaaatcattgctaataccgcataagcttgtaggaccgcatggtctagcaagaaaaggagcaatccgctaatagatgggcttgcggctgattagctagttggtaaggtaacggcttaccaaggcaacgatcagtagccgggctgagaggctctgcggccacattgggactgagatacggcccagactcctacgggaggcagcagtcgggaatattgcgcaatggaggaaactctgacgcagtgacgccgcgtataggaagaaggttttcggattgtaaactattttagacagggaagaaaaatg

SEQ ID NO: 3764 - DNA, 490 bp, Unknown
  Ascusbbf_291509, encodes 16S rRNA
agagtttgatcatggctcaggacgaacgctggcggcgtgcctaacacatgcaagtcgaacgggacttacgattggaagttttcggatggaaggttgtaagtttagtggcggacgggtgagtaacgcgtgagtaacctgcctttcagagggggataacgtactgaaaaggacgctaataccgcataacgtattgaggtcgcatggcaacaataccaaaggagcaatccgctgaaagatggactcgcgtccgattagctagttggtgagataaaggcccaccaaggcgacgatcggtagccggactgagaggttgaacggccacattgggactgagacacggcccagactcctacgggaggcagcagtgggggatattgcgcaatgggggaaaccctgacgcagcaacgccgcgtgaaggaagacggttttcggattgtaaacttcttttgtcagggacgaacgatgacggtacctgacgaataagctccgg

SEQ ID NO: 3765 - DNA, 490 bp, Unknown
  Ascusbbf_283142, encodes 16S rRNA
agagtttgatcctggctcagagtgaacgctggcggcgtggctaagacatgcaagtcgggcggttgtgtactttcgggtacgcaatagcggcaaacgggtgagtaacacgtaagtaacctacccttaagactgggatagcccagcgaaagttggggtaataccggatgaggaccatgtgtgcatacacatggatcgaaaggtaaggaagtacgcttaaggaggggcttgcggcctatcagctagttggtggtgtaacggacccccaaggcgaagacgggtagccggtctgagaggacgaacggccacattggaactgagacacggtccagacatctacggatggcagcagtttcgaattattcacaatgggcgaaagcctgatggtgcgacgtcgcgtggaggaagaaggtctttggattgtaaactcctgtcattagggagcaaagtgcgagtggagagcttgttttgagttaacctaaagaggaagcag

SEQ ID NO: 3766 - DNA, 490 bp, Unknown
  Ascusbbf_384209, encodes 16S rRNA
agagtttgatcatggctcaggatgaacgctagcgacaggcctaacacatgcaagtcgaggggtaacaggggagcttgctcccgctgacgaccggcgcacgggtgagtaacgcgtatgcaacctgcccgtaagagggggataacccggagaaattcggactaacaccgcataacaccatgagagggatcatcctcatgtggttaaatatttatagcttacggatgggcatgcgtatgattagctagttggcagggtaacggcctaccaaggcgacgatcattaggggtcctgagagggaaatcccccacattggtactgagacacggaccaaactcctacgggaggcagcagtgaggaatattggtcaatgggcgagagcctgaaccagccatgtcgcgtgaaggaagaatgtcctatggattgtaaacttcttttgtaggggggtaaagtgagcggtgcgccgcttattgcaagtaccctacgaataagc

SEQ ID NO: 3767 - DNA, 490 bp, Unknown
  Ascusbbf_190470, encodes 16S rRNA
agagtttgatcatggctcaggatgaacgctggcggcgtgcctaacacatgcaagtcgaacggagagtcattcttcggaagggctcttagtggcggacgggtgagtaacgcgtgggtaacctgccttacacagggggacaacagttggaaacgactgctaataccgcataagcccacggtaccgcatggtactgtgagaaaagatttatcagtgtaagatgggcccgcgtctgattagttagttggcggggtaacggcccaccaagacgacgatcagtagccgacctgagagggtgatcggccacattgggactgagacacggcccaaactcctacgggaggcagcagtggggaatattgcgcaatggggggaaccctgacgcagcaacgccgcgtgagtgaagaagtatttcggtatgtaaagctctatcagcagggaagaagatgacggtacctgcagaagaagtcccggctaactacgtgccagcagc

SEQ ID NO: 3768 - DNA, 490 bp, Unknown
  Ascusbbf_1516809, encodes 16S rRNA
agagtttgatcatggctcaggatgaacgctggcggcgtgcctaatacatgcaagtcggacgcactttcgttaaatgaattagagatgcttgcatcgaagatgattttaaccataaagtgagtggcgaacgggtgagtaacacgtgggtaacctgcccagaagcgggggataacacctggaaacagatgctaataccgcataataacgaaaaccgcatggttttcgtttaaaagatggcttcggctatcacttctggatggacccgcggcgtattagctagttggtgagataatggctcaccaaggcagtgatacgtagccgacctgagagggtaatcggccacattgggactgagacacggcccagactcctacgggaggcagcagtagggaatcttccacaatggacgcaagtctgatggagcaacgccgcgtgagtgatgaaggctttcgggtcgtaaaactctgttgttggagaagaacgtgtgtga

SEQ ID NO: 3769 - DNA, 490 bp, Unknown
  Ascusbbf_1784610, encodes 16S rRNA
agagtttgatcctggctcaggatgaacgctagctacaggcttaacacatgcaagtcgagcggaatgctttcgggcatttagcggcagacgggtgagtaacacgtatccaacctttcccttactcgggtatagcctcgggaaactgagagtaatccccgatgcagtgtacgaacagcattatttgcacactaaagattcatcggtaaggggtggggatgcgttccattaggtagtaggcggggcaacggcccacctagccgatgatggataggggttctgagaggaaggtcccccacattggaactgcgacacggtccaaactcctacgggaggcagcagtgaggaatattggtcaatggacgtgagtctgaaccagccaagtagcgtgcaggatgacggccctatgggttgtaaactgcttttatgcggggataaagtgcgccacgtgtggcgttttgtaggtaccgcatgaataaggaccggctaattc

SEQ ID NO: 3770 - DNA, 362 bp, Unknown
  Ascusbbf_441678, encodes 16S rRNA
agagtttgatcatggctcagaacgaacgctggcggcgcgtcttaagcatgcaagtcgagcggtaagttgtagcttgctacaacctagagcggcggactggtgagtaacgcgtgggtgacgtacccttttgacggggatagcctgtggaaacacagggtaataccggataagttcggatgtgtcagaggcattcgaagaaaggttcttttgaaccgcgaaaggagcggcccgcgtgctgttagttagttggcggggtaacggcccaccaagacgacgatagctacccggcctaagagggtgaacgggcacattgggactgagatacggcccagactcctacgggagccagcagccgcggtaat

SEQ ID NO: 3771 - DNA, 490 bp, Unknown
  Ascusbbf_720604, encodes 16S rRNA
agagtttgatcatggctcagaacgaacgctggcggcgtgcttaacacatgcaagtcgagcgagaaagggcttcggcctgagtacagcggcgaacgggtgcgtaacacgtggataatctaccttcaggctcggaataaccttccgaaaggagggctaatgccgaataagctcacgggtcctttgggacctgcgggaaaaggtggcctctgcttgcaagctatcacctgaagatgagtccgcggcccatcagctagttggcggggtaatggcccaccaaggctacgacgggtagctggtctgagaggacgatcagccacactgggactgagacacggcccagactcctacgggaggcagcagtggggaatcttgcgcaatgggcgaaagcctgacgcagcaacgccgcgtgagcgatgaaggtctttggatcgtaaagctctttcggcagggaagaaacgcccggtggccaatacccatcgggtttgacggt

SEQ ID NO: 3772 - DNA, 490 bp, Unknown
  Ascusbbf_241448, encodes 16S rRNA
agagtttgatcctggctcaggatgaacgctggcggcgtgcttaacacatgcaagtcgaacggacttgctccgctgtaagatgaagtgcttgcatcgattcttacttggaacaagttagtggcggacgggtgagtaacgcgtggggaacctgcctgtatctgggggataacagttagaaatgactgctaataccgcataagcgcacgagaccgcatggtcctgtgtgaaaaactgaggtggatacagatggacccgcgttggattagccagttggtggggtaacggcctaccaaagcgacgatccatagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaa

SEQ ID NO: 3773 - DNA, 490 bp, Unknown
  Ascusbbf_1877734, encodes 16S rRNA
agagtttgatcatggctcagaacgaacgctggcggcgcgtcttaagcatgcaagtcgagcgggaatacctagcttgctaggtatgagagcggcggactggtgagtaacgcgtgggtgacgtaccctatggatggggatagctactagaaatagtagataataccgaataagctgcatgatgtcagaggtcatgcaggaaaggagcatatgcttcgccaaaggatcggcccgcgagctattagcttgttggcggggtaacggcccaccaaggcgacgatagctacccggcctaagagggtgatcgggcacattgggactgagatacggcccagactcctacgggaggcagcagctaagaatattccgcaatggacgaaagtctgacggagcgacgccgcgtggacgaggaaggtcggaagattgtaaagtccttttatatgtggagaataagcaggggagtggaaagcccttgtggtgactgtagcatatg

SEQ ID NO: 3774 - DNA, 490 bp, Unknown
  Ascusbbf_220751, encodes 16S rRNA
agagtttgatcatggctcaggatgaacgctggcggcgtgcctaacacatgcaagtcgaacgaagcgcactccttcgggggtgtgactgagtggcggacgggtgagtaacgcgtgggtaacctgccctctgcagggggacaacagttagaaatgactgctaataccgcatgagcgcacagtaaggcatcttacggtgtgaaaagcaattacggcagaggatgggcccgcgtctgattagctggttggcagggtaaaggcctaccaaggcgacgatcagtagccggtctgagaggatgaacggccacattggaactgagacacggtccaaactcctacgggaggcagcagtgagggatattgcacaatggggggaaccctgatgcagcaacgccgcgtgggtgaagaagtatttcgatatgtaaagccctatcagcagggaagatgatgacggtacctgactaagaagctccggctaaatacgtgccagcag

SEQ ID NO: 3775 - DNA, 490 bp, Unknown
  Ascusbbf_189679, encodes 16S rRNA
agagtttgatcatggctcaggacgaacgctggcggcgtgcctaacacatgcaagtcgaacggactgattcccttcggggatgaaagttagtggcggacgggtgagtaacgcgtgagcaacctgcctttcagagggggataacgttcggaaacgaacgctaataccgcataacatatggaagtcgcatggctatcatatcaaaggagcaatccgctgaaagatgggctcgcgtctgattagatagttggtggggtaacggcctaccaagtcgacgatcagtagccggactgagaggttgatcggccacattgggactgagacacggcccagactcctgcgggaggcagcagtgggggatattgcacaatgggcgcaagcctgatgcagcaacgccgcgtgagtgatgaaggtcttcggattgtaaaactctgtccttggtgacgaaacaaatgacggtagccgaggaggaagccacggctaactacgtgcc

SEQ ID NO: 3776 - DNA, 490 bp, Unknown
  Ascusbbf_240423, encodes 16S rRNA
agagtttgatcctggctcagaacgaacgctggcggcgtgcctaacacatgcaagtcgagcgcgaataggggcaacccttagtagagcggcgcacgggtgcgtaacacgtggataatctgcctgagtgctcgggataaccagtcgaaagattggctaataccggataagcccacggtttcttcggagactgagggaaaaggtggcctctgcatgcaagctatcacattcagatgagtccgcggcccatcagctagttggcggggtaatggcccaccaaggcgacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggaagaaaccctgttggctaacatccaacagcttgacggtac

SEQ ID NO: 3777 - DNA, 490 bp, Unknown
  Ascusbbf_414069, encodes 16S rRNA
agagtttgatcctggctcaggatgaacgctagcgggaggcctaatacatgcaagtcgaggggtaacagggtcttcggaccgctgacgaccggcgcacgggtgagtaacgcgtacacaacctacctttaagagggggatagcctttggaaacgaagattaataccccatggtattatgatcctgcatgggattataattaaagctgaggcgcttaaagatgggtgtgcgtcccattagctagttggtgaggtaacggctcaccaaggcgatgatgggtagggggcgtgagagcgtggccccccacacgggtactgagacacggacccgactcctacgggaggcagcagtaaggaatattggacaatgggcgcaagcctgatccagccatcccgcgtgcaggatgactgccctatgggttgtaaactgcttttattagggaagaaacccctggatttatccggggctgccggtacctaatgaataagcaccg

SEQ ID NO: 3778 - DNA, 490 bp, Unknown
  Ascusbbf_745190, encodes 16S rRNA
agagtttgatcatggctcaggacgaacgctggcggcgcgcctaacacatgcaagtcgaacggagagtgggttttgattctttcgggatgatgaattcatttcttagtggcggacgggtgagtaacacgtgagcaacctgccttgcagagcgggataacggttggaaacgatcgctaataccgcataacatatgattgtcgcatggctatcatatcaaagatttatcgctgcaggatgggctcgcgtctgattagatagttggtggggtaatggctcaccaagtcgacgatcagtagccggactgagaggttgaacggccacattgggactgagacacggcccagactcctacgggaggcagcagtgggggatattgcacaatggggggaaccctgatgcagcgacgccgcgtgagggaagaaggttttcggattgtaaacctctgtctttggggacgataatgacggtacccaaggaggaagctctggct

SEQ ID NO: 3779 - DNA, 490 bp, Unknown
  Ascusbbf_406952, encodes 16S rRNA
agagtttgatcatggctcagattgaacgctggcggcaggcctaacacatgcaagtcgagcggggttttcggacctagcggcggacgggtgagtaatgtatagggagctgcccgacagagggggataccagttggaaacggctgttaataccgcataacgtctacggaccaaagtatgggaccttcgggccatatgctgtcggatgcacctatatgggattagctagttggtggggtaatggctcaccaaggcgacgatccctagctggtttgagaggatgatcagccacactggaactgagacacggtccagactcctacgggaggcagcagtggggaatattggacaatgggcgcaagcctgatccagccatgccgcgtgtgtgaagaaggccttcgggttgtaaagcactttcagcgaggaggaagggtgttgttttaatagagcagcattttgacgttactcgcagaagaagcaccggctaactccg

SEQ ID NO: 3780 - DNA, 490 bp, Unknown
  Ascusbbf_1381043, encodes 16S rRNA
agagtttgatcatggctcaggacgaacgctggcggcgtgcttaacacatgcaagtcgagcggaaaggcccttcggggtactcgagcggcgaacgggtgagtaacacgtgagtaacctgccctaggctttgggataaccccgggaaaccggggctaataccggatatgacctggtgccgcatggtgttgggtggaaagttttttcggcctgggatgggctcgcggcctatcagcttgttggtggggtgatggcctaccaaggcgatgacgggtagccggcctgagagggcgaccggccacactgggactgggacacggcccagactcctacgggaggcagcagtgggaatattgcacaatgggcggaagcctgatgcagcgacgccgtgtgagggatgaaggccttcgggttgtaaacctctttcagcagggacgaagcgtgagtgacggtacctgcagaagaagcgccggccaactacgtgccagcagcc

SEQ ID NO: 3781 - DNA, 490 bp, Unknown
  Ascusbbf_1885519, encodes 16S rRNA
agagtttgatcctggctcaggacgaacgctggcggcgtgcctaacacatgcaagtcgagcggggatatcggaagagcttgctcggaagatattccagcggcggacgggtgagaaacgcgtgagcaacctgtccctgacagggggataccagatggaaacatctgctaataccgcataagaccacagccccgcatgagggagtggtaaaaggagagatccggtttggggtgggctcgcgtccgattagctggttggtgaggtaacggcccaccaaggcgacgatcggtagccgacctgagagggtgatcggccacattggaactgagacacggtccaaactcctacgggaggcagcagtggggaatattgggcaatgggcgaaagcctgacccagcaacgccgcgtgagggaagaaggttttcggattgtaaacctctgtcctaagtgacgaaggaagtgacggtagcttaggaggaagccccggctaact

SEQ ID NO: 3782 - DNA, 490 bp, Unknown
  Ascusbbf_500173, encodes 16S rRNA
agagtttgatcctggctcaggacgaacgctggcggcgtgcctaatacatgcaagtcgagcggactaataggttcttcggaacctgttggttagcggcggacgggtgagtaacacgtaggcaacctgcccgtaagactgggataactaccggaaacggtagctaataccggatacgcaagttcctcgcatgggggatttgggaaaggcggagcaatctgtcacttacggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgaagaaggttttcggatcgtaaagctctgttgccagggaagaacgtcctctagagtaactgctaggggagtgacggtacc

SEQ ID NO: 3783 - DNA, 490 bp, Unknown
  Ascusbbf_392912, encodes 16S rRNA
agagtttgatcatggctcagaacgaacgctggcggcgcgtcttaagcatgcaagtcgaacggcaagatggagcttgctccatcctagagtggcggactggtgagtaacacgtgggtgacatgcctttcagttggggatagctactagaaatagtagataataccgaatacggtggcatatcttggaagtatgccaagaaaggagctaaggctccgctgagagattggcccgcggcccattagctagttggtgaggtaaaggcccaccaaggcaatgatgggtatccggcctgagagggtgatcggacacattgggactgagatacggcccagactcctacgggaggcagcagctaagaatattccgcaatggacgaaagtctgacggagcgacgccgcgtggatgatgaaggccgaaaggttgtaaaatccttttggattggaagaagaagcagtgtagggaatgacattgtggtgacggtacaatctga

SEQ ID NO: 3784 - DNA, 490 bp, Unknown
  Ascusbbf_237297, encodes 16S rRNA
agagtttgatcatggctcaggatgaacgctggcggcgtgcttaacacatgcaagtcgaacggacttaaggcaccgaagcggatttagcttgctattgaagcttcaccgttttaagttagtggcggacgggtgagtaacgcgtgggcaacctgcctttatccgggggataacagttagaaatgactgctaataccgcataagcgcacagcatcgcatgatgcagtgtgaaaaactccggtggatagagatggacccgcgttagattagccagttggcggggtaacggcccaccaaagcgacgatctatagccggcctgagagggcgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaaaggacggtacctgcac

SEQ ID NO: 3785 - DNA, 490 bp, Unknown
  Ascusbbf_269917, encodes 16S rRNA
agagtttgatcctggctcaggacgaacgctggcggcgtgcctaacacatgcaagtcgaacgaagcttttgatttcggttgagagcttagtggcggacgggtgagtaacgcgtgagtaacctgccttacagagggggataacgtctggaaacggacgctaataccgcatgacatttctttatcacatggtagagaaatcaaaggagcaatccgctgtaagatggactcgcgtccgattagctagatggtgagataacagcccaccatggcgacgatcggtagccggactgagaggttgaacggccacattgggactgagacacggcccagactcctacgggaggcagcagtgggggatattgcacaatggaggaaactctgatgcagcaacgccgcgtgaaggatgaaggtcttcggattgtaaacttttgtacttggggacgataatgacggtacccaagcagcaagctccggctaactacgtgccagca

SEQ ID NO: 3786 - DNA, 490 bp, Unknown
  Ascusbbf_305548, encodes 16S rRNA
agagtttgatcatggctcaggacgaacgctggcggcgtgcttaatacatgcaagtcgaacgaaatcaaattgtagcttgctatgatttgatttagtggcggacgggtgagtaacgcgtgaataatctacctttcacagggggataacaagtagaaatatttgctaataccgcatatgaccacagtttggcatcaaacaggggtgaaagatttttcggtgaaagatgagttcgcgtatcattagttagttggtggggtaatggcctaccaagactacgatggttagccgacctgagagggtgatcggccacattggaactgagatacggtccagactcctacgggaggcagcagtaaggaatattgggcaatggaggcaactctgacccagcaacgccgcgtgaaggaagaaggtcttcggattgtaaacttctgttattagggaagaagatagtgacggtacctaatgagtaagccccggctaactacgt

SEQ ID NO: 3787 - DNA, 486 bp, Unknown
  Ascusbbf_344803, encodes 16S rRNA
agagttgatcctggctcaggatgaacgctggcggcgtgcctaacacatgcaagtcgaacggacccttcggggttagtggcgcacgggtgaggaacacgtagcttacctgccctttacactgagataactctgcgaaagcagagctaatatcggataagctcacggggaacagtattcttgtgagaaaagctccggcggtaaaggagggggctgcggcccatcagctagttggtgaggtaatggctcaccaaggcgacgacgggtaggggacctgagagggtgaccccccacactgggactgagacacggcccagactcctacgggaggcagcagtgaggaatattgctcaatgggcgaaagcctgaagcagcgacgccgcgtggacgatgaaggtcttcggatcgtaaagtccttttctgtgtgacgaggaaggacggtagcacaggaataagtgtcggctaactacgtgccagcagccgcggtat

SEQ ID NO: 3788 - DNA, 490 bp, Unknown
  Ascusbbf_1501886, encodes 16S rRNA
agagtttgatcctggctcagagcgaacgttagcggcgcgcctaacacatgcaagtcgcacgcgaaagggggcaaccctgagtaaagtggcgcacgggtgcgtaacacgtagataacctgccctctgaagggggataacgttccgaaaggagcgctaataccgcgtaacgctgcgagtgctacggcgcttgcagacaaaggctgggaccggcaacggccagtcgtcagaggaggggtctgcggcccatcagctagttggcgaggtaatggctcaccaaggcaaagacgggtagctggtctgagaggatgatcagccacactggtactggaacacggaccagactcctacgggaggcagcagtggggaatcttggtcaatgggcgcaagcctgaaccagcgacgccgcgtgagtgatgaaggccttcgggttgtaaagctctgtggggagggacgaaagaactcggtcgaataggccgagcgttgacggtac

SEQ ID NO: 3789 - DNA, 490 bp, Unknown
  Ascusbbf_1885587, encodes 16S rRNA
agagtttgatcatggctcaggacgaacgctggcggcgtgcttaacacatgcaagtggagcgacgaaccagggcttgccctggggcagagccgcgaacgggtgagtaacacgtgggtaacctgccctgatgattgggacaacccggggaaactcgggctaataccaaatgtgctcttcgactctaaggtcgtcgaggaaaggtagcttcggcttccgcatcaggatgggcccgcggcccattagcttgttggtgaggtaacggctcaccaaggctgcgatgggtagctggtctgagaggacgatcagccacactgggactgagacacggcccagactcctacgggaggcagcagtggggaatcttgcgcaatgcgcgaaagcgtgacgcagcaacgccgcgtggaggaagacggtcttcggattgtaaactccttttcagttgggacgaagcttcggcggtgaatagccgttcggagtgacggtaccttca

SEQ ID NO: 3790 - DNA, 490 bp, Unknown
  Ascusbbf_950777, encodes 16S rRNA
agagtttgatcatggctcaggacgaacgctggcggcatgcctaatacatgcaagtcgagcggacgtttcagagagcttgctctttgaaacgttagcggcggacgggtgagtaacacgtgggcaacctgccctacagatggggataactccgggaaaccggggctaataccgaataaacagttggttcgcatgaaccaactctgaaagacggtttcggctgtcactgtaggatgggcccgcggcgcatcagctagttggtggggtaatggcctaccaaggcgacgatgcgtagccgacctgagagggtgatcggccacactgggactgagacacggcccagactcctacgggaggcagcagtagggaatcttccacaatggacgaaagtctgatggagcaatgccgcgtgagcgaagaaggttttcggatcgtaaagctctgttgtaagggaagaacacgtacgggagtaactgcccgtaccttgacggta

SEQ ID NO: 3791 - DNA, 490 bp, Unknown
  Ascusbbf_1724806, encodes 16S rRNA
agagtttgatcctggctcaggatgaacgctagctacaggcttaacacatgcaagtcgaggggcatcggggaggtagtttgctatctctgccggcgaccggcgcacgggtgagtaacgcgtatccaacctgccgcatagtcgggcacagccctctgaaaggaggattaatgccggatgtggtcattgtgggacatcccattatgactgaagatatattgctatgcgatggggatgcgtccgattagcttgttggcggggtaacggcccaccaaggcgacgatcggtaggggctctgagaggaggatcccccacactggaactgagacacggtccagactcctacgggaggcagcagtgaggaatattggtcaatggaggcaactctgaaccagccaagtagcgtgagggacgactgccctacgggttgtaaacctcttttgttcgggaataaagtgcgggacgcgtcccgctttgtatgtaccgtacgaat

SEQ ID NO: 3792 - DNA, 490 bp, Unknown
  Ascusbbf_716647, encodes 16S rRNA
agagtttgatcatggctcaggatgaacgctggcggcgtgcttaacacatgcaagtcgaacgaagctcctagaatgatttcttcggattgacttttaggatgacttagtggcggacgggtgagtaacgcgtgaggaacctgccttgcagtggggaataacagatggaaacgtctgctaataccgcataacacggagagatcgcatgttttcttcgtcaaagatttatcgctgtgagatggcctcgcgtctgattagctggttggcggggtaacggcccaccaaggcgacgatcagtagccggactgagaggttgatcggccacattgggactgagacacggcccagactcctacgggaggcagcagtggggaatattgggcaatgggcgcaagcctgacccagcaacgccgcgtgaaggaagaaggctttcgggttgtaaacttcttttaagtgggacgataatgacggtaccacttgaataagctccggc

SEQ ID NO: 3793 - DNA, 490 bp, Unknown
  Ascusbbf_399293, encodes 16S rRNA
agagtttgatcctggctcaggacgaacgctggcggcgtgcctaacacatgcaagtcgaacgggacttataggaatgagacttcggtcaaaggaatataagtttagtggcggacgggtgagtaacgcgtgagcaacctgcctttcagagggggacaacagttggaaacgactgctaataccgcataacgtaccgggagggcatccttttggtaccaaagatttatcgctgaaagatgggctcgcgtctgattagatagttggtggggtaacggcctaccaagtcgacgatcagtagccggactgagaggttgaacggccacattgggactgagatacggcccagactcctacgggaggcagcagtggggaatattggtcaatgggggcaaccctgaaccagcaacgccgcgtgaaggaagaaggctttcgggttgtaaacttcttttgtcggggacgaaacaaatgacggtacccggcgaataagccacgg

SEQ ID NO: 3794 - DNA, 490 bp, Unknown
  Ascusbbf_1749413, encodes 16S rRNA
agagtttgatcatggctcaggataaacgctggcggcgtgcataacacattcaagtcgaacggactgatttgagagcttgctctcgatgaaagttagtggcggacgggtgagtaacgcgtgagcaacctgccttcgtgagggggataacacagagaaatttgtgctaataccgcatgacgcatcgaggctgcatagtcttgatgttaaaggagcaatccgcacgaagatgggctcgcgtctgattagatagttggtgaggtaacggcccaccaagtctgcgatcagtagccggactgagaggttgaacggccacattggaactgagaaacggtccagactcctacgggaggcagcagtggggaatattgggcaatgggcgcaagcctgacccagcgacgccgcgtgagcgaagaaggtcttcggattgtaaaactctgttgacagggaagaagaaagtgacggtacctgtcgaggaagccacggctaacta

SEQ ID NO: 3795 - DNA, 490 bp, Unknown
  Ascusbbf_1326273, encodes 16S rRNA
agagtttgatcatggctcaggacgaacgctggcggcgcgcctaacacatgcaagtcgaacgaagagtgcgctttgaatccttcgggacgattagctcatttcttagtggcggacgggtgagtaacacgtgagcaacctgccttgcagagcgggataacggttggaaacgatcgctaataccgcataatatatgattgtcgcatggctttcatatcaaagatttatcgctgcaagatgggctcgcgtctgattagattgttggtggggtgatggctcaccaagtcgacgatcagtagccggactgagaggttgaacggccacattgggactgagacacggcccaggctcctacgggaggcagcagtgggggatattgcacaatgggggaaaccctgatgcagcgacgccgcgtgagggaagaaggttttcggattgtaaacctctgtctttggggacgataatgacggtacccaaggaggaagctccggct

SEQ ID NO: 3796 - DNA, 490 bp, Unknown
  Ascusbbf_938661, encodes 16S rRNA
agagtttgatcctggctcagaatgaacgctggcggcgggtcttaagcatgcaagtcggacggcaagaaagtgcttgcactttcctagagtggcggactggtgaggaacacgttggtgacgtaccctttggatggggatagccggtagaaataccgggtaataccgaataaggtcggtggtcttggaagccaccgaggaaagcggctttggccgcgccgaaggaacggcctgcgtcccatcagcttgttggcggggtaaaagcccaccaaggcaatgacgggtatctggcctgagagggtgagcagacacattgggactgagatacggcccagactcctacgggaggcagcagctaagaatattccacgatgggcgaaagcctgatggagccacgccgcgtggacgatgaaggccggaaggttgtaaagtcctttagcaagtgaggaataagcgggatagggaatgatcccgtggtgactgtagcttgaga

SEQ ID NO: 3797 - DNA, 490 bp, Unknown
  Ascusbbf_477046, encodes 16S rRNA
agagtttgatcctggctcaggacgaacgctggcggcatgcctaacacatgcaagtcgaacggagtatagagagcttgctttctgtacttagtggcggacgggtgagtaacgcgtgagcaacctgcctttcagtggggaataatattctgaaaagagtactaataccgcataacgtattgttgtcgcatgatgatgataccaaagatttatcgctgagagatgggctcgcgtccgattagccagttggtggggtaacggcctaccaaagctacgatcggtagccggactgagaggttgaacggccacattgggactgagacacggcccagactcctacgggaggcagcagtgggggatattgcgcaatgggggaaaccctgacgcagcaatgccgcgtgaaggatgaaggtcttcggattgtaaacttcttttgtcagggacgaaagatgacggtacctgacgaataagctccggctaactacgtgccagc

SEQ ID NO: 3798 - DNA, 490 bp, Unknown
  Ascusbbf_448037, encodes 16S rRNA
agagtttgatcatggctcagaacgaacgctggcggcatggattaggcatgcaagtcgaacgccggtagcaataccggagtggcgcaagggtgaggaacgcgtgagtgatctgccctcaagttgggaatagctcctggaaacgggaattaataccgaatgtgatcgtattactgcatggtgatatgattaaaggcgcaagtcgcttgaggaggagctcgcgtcccattagctagttggtgaggtaacggcccaccaaggcgatgatgggtagctggtctgagaggacgaccagccacactgggactgagaactgcccagactcctacgggaggctgcagtcgagaattttgggcaatgggcgaaagcctgacccagcaatgccgcgtgcgggatgaaggtcttcggattgtaaaccgctgtcgagagggacgaaaaatgacggtacctctggaggaagccacggctaactacgtgccagcagccgcggtaa

SEQ ID NO: 3799 - DNA, 490 bp, Unknown
  Ascusbbf_474937, encodes 16S rRNA
agagtttgatcatggctcaggatgaacgctggcggcgtgcttaacacatgcaagtcgaacgagccttgtcggacggatcccttcggggtgaagaccggcgctggcgagtggcggacgggtgagtaacgcgtggggaacctgcctcattccgggggataccagtcggaaacggctgttaataccgcataagcgcacggtgtggcatcacacagtgtgaaaaactccggtggaatgagatggccccgcgtctgattaggcagttggcggggtaacggcccaccaaaccgacgatcagtagccgacctgagagggtgaccggccacattgggactgagacacggcccagactcctacgggaggcagcagtggggaatattgcacaatgggcgcaagcctgatgcagcgacgccgcgtgagcgatgaagtatttcggtatgtaaagctctatcagcagggaagataatgacggtacctgactaagaagctccgg

SEQ ID NO: 3800 - DNA, 490 bp, Unknown
  Ascusbbf_426142, encodes 16S rRNA
agagtttgatcatggctcaggacgaacgctggcggcgtgcttaacacatgcaagtcgagcggggaacttcggttcccagcggcggacgggtgagtaacacgtgggtaacctgccttacagtggggaatagccttccgaaaggaagattaataccgcataatactcagagatcacatgatctttgagccaaaggaatttatttcgctgtaagatggacccgcggcgcattagcttgttggtgaggtaacggctcaccaaggcttcgatgcgtagccgacctgagagggtgatcggccacattggaactgagacacggtccagactcctacgggaggcagcagtggggaatattgcacaatggaggaaactctgatgcagcaacgccgcgtgagtgatgaaggtcttcggatcgtaaaactctgtcttatgggacgataatgacggtaccataggaggaagccacggctaactacgtgccagcagccgcggt

SEQ ID NO: 3801 - DNA, 490 bp, Unknown
  Ascusbbf_382041, encodes 16S rRNA
agagtttgatcctggctcaggatgaacgctagcggcaggcctaacacatgcaagtcgaggggcatcacggaaaagcttgcttttctggtggcgaccggcgcacgggtgaggaacacgtatggaacctgcccctgtcaggggaatagcccagggaaacttggattaatgccccatggtaccgggacaccgcatggtgttccggttaaagattcatcggacagggatggccatgcgcaccattagttagttggcagggtaacggcctaccaagacagcgatggttaggggccctgagagggggatcccccacactggtactgagacacggaccagactcctacgggaggcagcagtgaggaatattggacaatggccgagaggctgatccagccatgccgcgtgcaggatgactgccctatgggttgtaaactgcttttatacgggaagaaacccacctacgtgtaggtggctgacggtaccgtaagaataa

SEQ ID NO: 3802 - DNA, 490 bp, Unknown
  Ascusbbf_1002259, encodes 16S rRNA
agagtttgatcatggctcaggattaacgctggcggcgtgcctaatacatgcaagtcgaatggtagcaataccatggtgaacgggtgagtaacacgtaggtaacctgtccttaagacgaggataaccgatggaaacgtcggataatactggataggaatggataaggcatcttattcattttaaagatttatcacttgaggaggggcctgcggcgcattagctagatggcggggtaaaagcccaccatggcgatgatgcgtagccggactgagaggttgaacggccacaatggaactgagaacggtccatactcctacggggggcagcagtagggaattttcggcaatgggcgcaagcctgaccgagcaacgccgcgtgaacgaagaagtatttcggtatgtaaagttcttttattagggaagaaaaaattaaaattgacggtacctaatgaataagctccggctaactacgtgccagcagccgcggtaat

SEQ ID NO: 3803 - DNA, 490 bp, Unknown
  Ascusbbf_910364, encodes 16S rRNA
agagtttgatcctggctcaggatgaacgctggcggcgtgcttaacacatgcaagtcgaacggaggacccttgaacgagttttcggacaagtgaaaggaatccttagtggcggacgggtgagtaacgcgtgaggaacctgccttggagaggggaataacacagagaaatttgtgctaataccgcatgaagcaattgtatcgcatgatagagattgccaaagatttatcgctctgagatggcctcgcgtctgattagctggttggcggggtaacggcccaccaaggcgacgatcagtagccggactgagaggttggccggccacattgggactgagacacggcccagactcctacgggaggcagcagtggggaatattgggcaatgggcgcaagcctgacccagcaacgacgcgtgaaggaagaaggctttcgggttgtaaacttctttcatgagggacgaaggaagtgacggtacctcatgaataagctcc

SEQ ID NO: 3804 - DNA, 490 bp, Unknown
  Ascusbbf_308687, encodes 16S rRNA
agagtttgatcatggctcaggacgaacgctggcggcatgcctaacacatgcaagtcgaacggagataaagagcttgctttttatcttagtggcggacgggtgagtaacgcgtgagcaacctgcctttaagtggggaataatgtactgaaaaggacactaataccgcataaagtatgataaccgcatggttattgtaccaaagatttatcgcttagagatgggctcgcgtccgattagctagttggagaggtaacggctccccaaggcgacgatcggtagccggactgagaggttgaacggccacattgggactgagacacggcccagactcctacgggaggcagcagtgggggatattgcgcaatgggggaaaccctgacgcagcaatgccgcgtgaaggaagaaggtcttcggattgtaaacttcttttgtcagggacgaaaatgacggtacctgacgaataagctccggctaactacgtgccagcagc

SEQ ID NO: 3805 - DNA, 490 bp, Unknown
  Ascusbbf_786075, encodes 16S rRNA
agagtttgatcctggctcaggacgaacgctggcggcacgcctaacacatgcaagtcgaacggagattatttaacagaattcttcggaaggaagatagataatcttagtggcggacgggtgagtaacgcgtgagtaacctgcctttcagagggggataacgtttggaaacgaacgctaataccgcataacatgtaactatcgcatgatagatatatcaaaggagcaatccgctgaaagatggactcgcgtccaattagctggttggtgaggtaatggctcaccaaggcgacgattggtagccggactgagaggttgaacggccacattgggactgagacacggcccagactcctacgggaggcagcagtgggggatattgcacaatgggggaaaccctgatgcagcgatgccgcgtgagggaagaaggttttcggattgtaaacctctgtcctaggtgaagataatgacggtagcctaggaggaagctacg

SEQ ID NO: 3806 - DNA, 490 bp, Unknown
  Ascusbbf_598515, encodes 16S rRNA
agagtttgatcatggctcaggacgaacgctggcggcgtgcctaacacatgcaagtcgagcgaagtgagtactacggtacgaacttagcggcggacgggtgagtaacgcgtggacaatctaccctgtagactgggataacacctcgaaaggggtgctaataccggataatgtcgagaagcggcatcgcttttcgaagaaaggagagaatccgctataggaggagtccgcgtcccattagctagttggtgagggtaacggcccaccaaggcgacgatgggtagccggcctgagagggtgaacggccacactggaactgagacacggtccagactcctacgggaggcagcagtggggaatattgtgcaatgggggaaaccctgacacagcaacgccgcgtgagcgaagaaggccttcgggttgtaaagctcaatagtatgggaagataatgacggtaccatacgaaagccccggctaactacgtgccagcagc

SEQ ID NO: 3807 - DNA, 490 bp, Unknown
  Ascusbbf_317771, encodes 16S rRNA
agagtttgatcatggctcaggatgaacgctggcggcgtgcttaacacattcaagtcgaacggacgatgcgacttcggtcgcaaagttagtggcggacgggtgagtaatgcatgagcaacctgcctttccgcggggaataacacagggaaaccggtgctaataccgcatacgccattcgggtcgcatggtctgaatgggaaaggatttattcacggaaagatgggctcatgtctgattagatagttggtgaggtaacggcccaccaagtctgcgatcagtagccggactgagaggttgaacggccacattggaactgagatacggtccagactcctacgggaggcagcagtggggaatattgggcaatgggggaaaccctgacccagcgacgccgcgtgaaggaagaaggtcttcggattgtaaactttaaatagcagggacgaaaaaaatgacgttacctgcagggaagccacggctaactacgtgccag

SEQ ID NO: 3808 - DNA, 490 bp, Unknown
  Ascusbbf_249132, encodes 16S rRNA
agagtttgatcatggctcaggacgaacgctggcggcgtgcctaacacatgcaagtcgaacggagcaccgcgctgaacttgagaccagcttgctggaggaaggttcttgcgatgcttagtggcggacgggtgagtaacgcgtgagcaacctgccttgcacagggggataacgtttggaaacgaacgctaataccgcataagaccacacaccggcatcggtgagaggtcaaaggagcaatccggtgcaagatgggctcgcgtccgattaggtagttggtggggtaacggcccaccaagccgacgatcggtagccggactgagaggttgaacggccacattgggactgagacacggcccagactcctacgggaggcagcagtgggggatattgcacaatgggcgcaagcctgatgcagcaacgccgcgtgagggaagaaggtcttcggattgtaaacctctgtccttggtgacgaagaaagtgacggtagccg

SEQ ID NO: 3809 - DNA, 490 bp, Unknown
  Ascusbbf_1808258, encodes 16S rRNA
agagtttgatcatggctcaggacgaacgctggcggcgcgcttaacacatgcaagtcgaacggagcttgcttttgaaggtccttcgggaacggatgttgcaagcttagtggcggacgggtgagtaacgcgtgagcaacctgcctttcagagggggataacacaacgaaagctgtgctaataccgcatgacattgcgacaccgcatggtgatgcaatcaaaggagcaatccgctgaaagatgggctcgcgtccgattagatagttggcggggtaacggcccaccaagtcgacgatcggtagccggactgagaggttggccggccacattgggactgagacacggcccagactcctacgggaggcagcagtgggggatattgcacaatgggcgaaagcctgatgcagcgacgccgcgtgagggaagaaggtcttcggattgtaaacctttgtcctatgggaagataatgacggtaccatgggaggaagccacg

SEQ ID NO: 3810 - DNA, 490 bp, Unknown
  Ascusbbf_308733, encodes 16S rRNA
agagtttgatcctggctcaggatgaacgctggcggcgtgcctaacacatgcaagtcgaacgagcagagaggagcttgctccttgaagctagtggcggacgggtgagtaacgcgtggataacctaccctgtacaggggaataacagttagaaatgactgctaatgccgcataagcgcacactgccgcatggcagagtgtgaaaagccgagacggtacaggatggatccgcgtctgattagctagttggtgaggtaacggcccaccaaggcgacgatcagtagccgacttgagagagtgaccggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagataatgacggtacctgactaagaagccccggctaactacgtgccagca

SEQ ID NO: 3811 - DNA, 490 bp, Unknown
  Ascusbbf_482446, encodes 16S rRNA
agagtttgatcctggctcagaacgaacgctggcggcgcgtcttaagcatgcaagtcgagcgggattacctagcttgctaggtatgagagcggcggactggtgagtaacgcgtgggtgacgtaccctcctgtctggaatagccggtagaaataccggataatgccggatgaggtccgaggcattggaggccttggaggaaaggagctattgttccgcagggggagcggcccgcgtcccatcagctggttggcggggaaaaggcccaccaaggcgatgacgggtacccggcctcagagggcgaccgggcacattgggactgagatacggcccagactcctacgggaggcagcagctaagaatattccgcaatgggggaaaccctgacggagcgacgccgcgtggacgatgaaggccggaaggttgtaaagtccttttatggcggaggaagaagcgtgcgttggaagcgcgcgtggtgactgtatgccatgaa

SEQ ID NO: 3812 - DNA, 490 bp, Unknown
  Ascusbbf_739639, encodes 16S rRNA
agagtttgatcatggctcaggatgaacgctggcggcgtgcttaacacatgcaagtcgaacggggatatgagacggatttcttcggagtgaagtttcatatcttagtggcggacgggtgagtaacgcgtgggtaacctgcctatgacagggggacaacagttggaaacgactgctaataccgcataagccgggagaggggcatccctccaccggaaaagatttatcggtcatagatggacccgcgtctgattagcttgttggtgaggtaacggcccaccaaggcgacgatcagtagccgaactgagaggttgaccggccacattgggactgagacacggcccaaactcctacgggaggcagcagtggggaatattgcacaatggggggaaccctgatgcagcgacgccgcgtgagtgacgaagtatttcggtatgtaaagctctatcgatggggaagaaaacgacggtacccaagtaagaagccccggcta

SEQ ID NO: 3813 - DNA, 490 bp, Unknown
  Ascusbbf_1429523, encodes 16S rRNA
agagtttgatcctggctcaggatgaacgctagctacaggcttaacacatgcaagtcgaacgaacttaacctttagtttactaatggagcggttagtggcggactggtgagtaacacgtaagcaacctgcctatcagaggggaacaacagttagaaatgactgctaataccgcatatgccttgagtaacgcatgttacaaaagggaaaggagcaatccgctgatagatgggcttgcgtctgattagatagttggtggggtaacggcctaccaagtcaacgatcagtagccggactgagaggttgaacggccacattgggactgagatacggcccagactcctacgggaggcagcagtcgggaatattgcgcaatggaggaaactctgacgcagtgacgccgcgtgcaggaagaaggttttcggattgtaaactgctttagacagggaagaacaaggacagtacctgtagaataagctccggctaactacgt

SEQ ID NO: 3814 - DNA, 490 bp, Unknown
  Ascusbbf_834081, encodes 16S rRNA
agagtttgatcatggctcagattgaacgctggcggcgtgcttcatacatgcaaatcgaacgagaaactcacttcggtgagtggaaagtggcggacgggtgagtaatgtgtagagaatctgccccagagtgggggacaacagagggaaacttctgctaataccccatatgagcgtagttgcgatactattcttgaaagatttattgctctgggatgagtctgcatctgattagctagttggaggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgattgcagacggccttcgggttgtaaagatctgtcagtagggacgaacaatgactgtacctacagaggaagcaccggctaactccgtgccagcagccgcg

SEQ ID NO: 3815 - DNA, 490 bp, Unknown
  Ascusbbf_720246, encodes 16S rRNA
agagtttgatcctggctcaggatgaacgctagctacaggcttaacacatgcaagtcgaggggcagcatggtggtagcttgctaccaccgatggcgaccggcgcacgggtgagtaacacgtatccaacctgcccatgacccggggatagccctctgaaaggaggattaatacccgatacggtggttgcgggacatcccgctcttaccaaagattcatcggtcacggatggggatgcgtctgattagcttgtcggcggggtaacggcccaccgaggcgacgatcagtaggggttctgagaggaaggtcccccacataggaactgagacacggtcctaactcctacgggaggcagcagtgaggaatattggtcaatggccgcaaggctgaaccagccaagtagcgtgaaggatgactgccctacgggttgtaaacttcttttatgcgggaataaagtgccgtacgcgtacggttttgcatgtaccgcatgaat

SEQ ID NO: 3816 - DNA, 490 bp, Unknown
  Ascusbbf_731513, encodes 16S rRNA
agagtttgatcctggctcaggacgaacgctggcggcgtgcctaacacatgcaagtcgagcgatgatcggaagatgaggccctcgggcggattcttctgagattagcggcggatgggtgagtaacgcgtgggcaatctgccctccacagggggataacacagggaaacttgtgctaataccgcataacatctttttaaggcatcttgagaagatcaaaggagcgatccggtgaaggaggagcccgcgtctgattagctagttggtgaggtaacggctcaccaaggcgacgatcagtagccgaactgagaggttgatcggccacattgggactgagacacggcccagactcctacgggaggcagcagtggggaatattgcacaatggaggaaactctgatgcagcaacgccgcgtgaaggatgacggccttcgggttgtaaacttctttggcaggggacgaagacagtgacggtaccctgagaacaagccac

SEQ ID NO: 3817 - DNA, 490 bp, Unknown
  Ascusbbf_468211, encodes 16S rRNA
agagtttgatcatggctcaggacgaacgctggcggcacgcttaacacatgcaagtcgaacgaggtccatggagcttgctccggaagacctagtggcgaacgggtgcgtaacacgtgagaaacctgtcccgaacttgggaataacagtcggaaacgactgctaataccgaatatcttcgtagcgtcgcatggcgcatcgaagaaagcttttgcggtttgggagggtctcgcggcctatcagctagttggtgaggtaacggctcaccaaggcatcgacgggtagctggtctgagaggatgatcagccacactgggactgagacacggcccagactcctacgggaggcagcagtggggaatattgcacaatgggcgcaagcctgatgcagcgatgccgcgtgcgggaagaaggccttagggttgtaaaccgctttcagcagggaagaaactgacggtacctgcagaagaaggagcggccaactacgtgccagc

SEQ ID NO: 3818 - DNA, 490 bp, Unknown
  Ascusbbf_1787298, encodes 16S rRNA
agagtttgatcatggctcaggatgaacgctagctacaggcttaacacatgcaagtcgaggggcatcacgtggcagcaatgtcatggtggcgaccggcgcacgggtgagtaacgcgtatccgacctggccttcactccgggacagccctccgaaagggggattaatccgggatgtgtggagaagtcgcatggaatctccatgaaagattcatcggtgaaggatggggatgcgtcccattaggtagtcggcggggtaacggcccaccgagcccgcgatgggtaggggtactgagaggtaggtcccccacactggaactgagacacggtccagactcctacgggaggcagcagtgaggaatattggtcaatggggggaaccctgaaccagccaagtagcgtggaggatgacggccctacgggttgtaaactccttttatgcgggggtaatgtacgccacgtgtggtgtattgcaagtaccgcatgaataagca

SEQ ID NO: 3819 - DNA, 490 bp, Unknown
  Ascusbbf_1841847, encodes 16S rRNA
agagtttgatcatggctcaggacgaacgctggcggcgtgcctaatacatgcaagtcgagcggaccaatggagagcttgctctcctgcggttagcggcggacgggtgagtaacacgtaggcaacctgcctgtacgaccgggataactccgggaaaccggagctaataccggataggatttcagaccgcatggtttggaatggaaagaccctgtgtcacgtacagatgggcctgcggcgcattagctggttggtggggtaacggcctaccaaggcgacgatgcgtagccgacctgagagggtgaacggccacactgggactgagacatggcccagactcctacgggaggcagcagtagggaatcttccgcaatggacgaaagtctgacggagcaacgccgcgtgaacgaagaaggttttcggatcgtaaagttctgttgttagggaagaaccgccgggataacctcccggtctgacggtacctaacgagaaa

SEQ ID NO: 3820 - DNA, 490 bp, Unknown
  Ascusbbf_528889, encodes 16S rRNA
agagtttgatcatggctcaggatgaacgctagcggcaggcttaacacatgcaagtcgaggggcagcggggatagcaatatccgccggcgaccggcgaaagggtgcgtaacgcgtgagcaacttgcccgtatcagggggataaccgatggaaacgtcgcctaataccccataacaacagggttcgcatggatcttgtttgaaagctctggcggatacggataggctcgcgagacattagctagttggagtggtaacggcacaccaaggcgacgatgtctaggggttctgagaggaaggtcccccacattggaactgagacacggtccaaactcctacgggaggcagcagtgaggaatattggtcaatggacggaagtctgaaccagccatgccgcgtgcaggaataaggccctatgggtcgtaaactgcttttgtggtggagcaataaggtgtacgtgtacaccgatgagagtacatcacgaataagcatc

SEQ ID NO: 3821 - DNA, 490 bp, Unknown
  Ascusbbf_1371561, encodes 16S rRNA
agagtttgatcctggctcaggatgaacgctagcggcaggcttaacacatgcaagtcgaggggcagcgcggggtagcaatactctggcggcgaccggcggaagggcgcgtaacgcgtgcgcaacttgcccgtcactgggggataggcactggaaacggtgtgtaatactccatcacatatggattcacatggatttatattgaaagattcgttggtgacggatgggctcgcgtaacattaggtcgtcggcggggtaacggcccaccgaggctacgatgatgagaggttctgagaggaaggtcccccacactggaactgagacacggtccaaactcctacgggaggcagcagtgaggaatattggccaatgggcgggagcctgaaccagccatgccgcgtgcaggaataaggccctatgggtcgtaaactgcttttccttgggagcaataagggtcacgagtggccctatgagagtatcaggggaataagca

SEQ ID NO: 3822 - DNA, 490 bp, Unknown
  Ascusbbf_165764, encodes 16S rRNA
agagtttgatcatggctcaggattaacgctggcggcgtgcctaatacatgcaagtcgaacggacaagatgaatagcttgctaggaatcttgttagtggcggacgggtgagtaacgcgtgagcaatctgcctatgaaagggggataacacttagaaataggtgctaataccgcataatactatttagatgcatgtctttatagtcaaaggagaaatccgatcatagatgagcttgcgtatcattagctagttggtgaggtaacggcccaccaaggcaacgatggttagccggcctgagagggtgaacggccacattggaactgagatacggtccagactcctacgggaggcagcagtaaggaatattgggcaatgggcgaaagcctgacccagcaacgccgcgtgatggaagaaggtcttcggattgtaaacatctaaaagtggggaaaaataagatgatggtacccacagataagtcacggcaaactatg

SEQ ID NO: 3823 - DNA, 488 bp, Unknown
  Ascusbbf_1479115, encodes 16S rRNA
agagtttgatcctggctcaggatgaacgctggcggcgtgcctaatacatgcaagtcgaacgaagcagcaatgcttagtggcggaagggtgaggaacgcgtgagcaacctgccctcaagttgggaataacagttggaaacgactgctaataccgaatgtggcttttgaaccgcatggtttattggctaaagatttattgcttgaggatgggctcgcgtcccattagctagatggtgaggcaacggctcaccaaggcgatgatgggtagctggtctgagaggatggtcagccacactgggactgagacactgcccagactcctacgggaggctgcagtcgagaatcttgggcaatgcgcgaaagcgtgacccagcaatgccgcgtgcgggatgaaggtcttcggattgtaaaccgctgtcacccgggacgaaagttgactgtaccgggggaggaagccacggctaactacgtgccagcagccgcggtaat

SEQ ID NO: 3824 - DNA, 490 bp, Unknown
  Ascusbbf_736198, encodes 16S rRNA
agagtttgatcatggctcagaacgaacgctggcggcgcgcctaacacatgcaagtcgagcggttaaacttctttcgggaagatataaagcggcggacgggtgagtagtgcataggtgacctgcctcaaagtgggggatagcctggggaaactcgggttaataccgcgtaagctgcatgggtgaataccatgcagtaaaggcttcggccgctttgagatgggcctatgtttgattagttagttggtgaggtaacggcttaccaagacttcgatcaatagctggtctgagaggatgatcagccacactggaactgagacacggtccagactcctacggggggcagcagtgaggaattttgcgcaatgggggaaaccctgacgcagcgacgccgcgtggaggatgaagtctttcgagatgtaaactcctgtcagtggggaagataatgacggtacccacagaggaagcaccggctaactccgtgccagcagcc

SEQ ID NO: 3825 - DNA, 490 bp, Unknown
  Ascusbbf_748555, encodes 16S rRNA
agagtttgatcatggctcagattgaacgctggcggcatgccttacacatgcaagtcgaacgcgaaagcggggcaacccgcaagtagagtggcgaacgggtgagtaatacatcggaacgtatccagtagcgggggataacctgtcgaaagataggctaataccgcatacgatctacggatgaaagcgggggaccgcaaggcctcgcactattggagcggccgatgtcggattagctagttggtggggtaaaagcttaccaaggcgacgatccgtagctggtctgagaggacgatcagccacactggaactgagacacggtccagactcctacgggaggcagcagtggggaattttggacaatgggcgcaagcctgatccagccatgccgcgtgagtgaagaaggccttcgggttgtaaagctctttcggtgaagacgaaacggttagcgttaataacgctgactaatgacggtactcacagaagaagcacc

SEQ ID NO: 3826 - DNA, 490 bp, Unknown
  Ascusbbf_750928, encodes 16S rRNA
agagtttgatcatggctcagaacgaacgctggtagcgtggattaggcatgcaagtcgaacgggatcggggaggtagcaatatttccccgtgagagtggcggaagggcgaggaacacgtgaacaacctgtccatcaggtggggaaaaccgttggaaacgacggctaataccgaatgtggcgtcgcgacacatgtcgcgaacgctagagggggcccgcgagggctctccctgaacgaagggttcgcgcaccatcagctagttggcggggtaacggcccaccaaggcctacggttagctggtctgagaggatgaccagccgcactgggactgagatactgcccagactcctacgggaggctgcagtcgaggatcatttgcaatgggcgaaagcctgacaatgcgacgctgcgtggaggatgaaggccttcgggttgtaaactcctgtcataagggaaaaggagatgacacccaatacgtgtcaaatttgatgg

SEQ ID NO: 3827 - DNA, 490 bp, Unknown
  Ascusbbf_406882, encodes 16S rRNA
agagtttgatcatggctcaggatgaacgctggcggcgtgcttaacacatgcaagtcgaacgagaaagcaccttcgggtgttagtagagtggcgaacgggtgagtaacacgtgagcaacctgccccccgctccgggataacttggcgaaagccatgctaataccggatactccgctttgagcgcatgctctttgtgggaaagttcaggcggcgggggatgggctcgcggcccattaggtagtaggcggggtaacggcccacctagccgacgatgggtagccgggttgagagaccgaccggccacattgggactgagacacggcccagactcctacgggaggcagcagtggggaattttgcgcaatgggcgaaagcctgacgcagcaacgccgcgtgcgggatgaaggccttcgggttgtaaaccgctttcagcagggaagatactgacggtacctgcagaagaagccccggctaactacgtgccagcagcc

SEQ ID NO: 3828 - DNA, 150 bp, Unknown
  Ascusbbf_300456, encodes 16S rRNA
agagtttgatcctggctcagtgaccgaatcgccatccataccgccagcagccgcggtaatgccagcagccgcggtaatgccagcagccgcggtaatgccagcagccgcggtaatgccagcagccgcggtaatgccagcagccgcggtaat

SEQ ID NO: 3829 - DNA, 490 bp, Unknown
  Ascusbbf_1811565, encodes 16S rRNA
agagtttgatcctggctcaggacgaacgctggcggcgtgcctaacacatgcaagtcgaacgagaaatatggaaaggaatccttcggggtaaatagaaatatggacagtggcggacgggcgagtaacgcgtgagtaacctgcccataagcgggggatagccgatggaaacgtcgagtaataccccatgacatacagttgtcgcatggtagctgtatcaaagatttatcgtttatggatggactcgcgtctgattagatagttggtgaggtaacggctcaccaagtcgacgatcagtagccgaactgagaggttgatcggccgcattgggactgagacacggcccagactcctacgggaggcagcagtgggggatattgcgcaatggggggaaccctgacgcagcaacgccgcgtgcaggaagaaggtcttcggattgtaaactgttgtcgcaagggaagaagacagtgacggtaccttgtgagaaagtcac

SEQ ID NO: 3830 - DNA, 490 bp, Unknown
  Ascusbbf_442948, encodes 16S rRNA
agagtttgatcctggctcagaacgaacgctggcggcgtgcttaacacatgcaagtcgcacgagaaacggggcttcggcccccgagtaaagtggcgaatgggtgagtaacacgtgagtaacatgccttggagcgggggataaccattcgaaaggatggctaataccgcataagaccacaccggcttcggctggagcggtcaaagccttcgggtgctccaagattggctcgcggaccattagctagttggtggggtaatggcccaccaaggcagtgatggatagctggtctgagaggacgatcagccacactgggactgagacacggcccagactcctgcgggaggcagcagtggggaatcttgcgcaatgggcgaaagcctgacgcagcaacgccgcgtgtgtgaagaaggccctcgggtcgtaaagcactgtcagaggggaagaacgcctacattgttaggtttgacggtaccctcaaaggaagcaccgg

SEQ ID NO: 3831 - DNA, 490 bp, Unknown
  Ascusbbf_948826, encodes 16S rRNA
agagtttgatcctggctcagattgaacgctggcggcatgcttaacacatgcaagtcgaacggcagcatgacttagcttgctaagttgatggcgagtggcgaacgggtgagtaatgcgcaggaacatgccttaaagtgggggacaacttggggaaactcaagctaataccgcataatttccgaggaaaaaagctggggaccttcgggcctggcgctttaagattggcctgcgtccgattagctagttggtaaggtaaaggcttaccaaggcgacgatcggtagctggtctgagaggatgatcagccacactgggactgagacacggcccagactcctacgggaggcagcagtggggaatattggacaatgggggcaaccctgatccagcaatgccgcgtgtgtgaagaaggcctgagggttgtaaagcactttcagtggggaggaggtctaataggttaagagctaattagatggacgttacccacagaag

SEQ ID NO: 3832 - DNA, 490 bp, Unknown
  Ascusbbf_717512, encodes 16S rRNA
agagtttgatcatggctcagaatgaacgttggcggcatggattaggcatgcaagtcgcgcgatagccagcaatggtgaaagcggcgaaagggacagtaatgtatggattacgtacctccaggaccgggatagctgcgggaaactgcaattaataccggataacatctacggatcaaaggtgtgaatccgcctggagatcggtccatatcctattagcttgttggtgaggtaatggcttaccaaggcaatgatgggtagcgggtgtgagagcatggcccgcgtcactgggactgagacactgcccagacacctacgggtggctgcagtcgagaatcttcggcaatgggcgaaagcctgaccgagcgatgccgcgtgtgggatgaaggccttcgggttgtaaaccactgtcagtggggaggaaataatcggggttacctcggttttgacctatccgcagaggaagtacgggctaagttcgtgccagcagccg

SEQ ID NO: 3833 - DNA, 490 bp, Unknown
  Ascusbbf_1801768, encodes 16S rRNA
agagtttgatcatggctcaggacgaacgctggcggcgtgcctaatacatgcaagtggaacgcaattgattctcccgtagcttgctacatttgaattgattgagtcgcgaacgggtgagtaacgcgtaggtaacctaccttatagcgggggataactattggaaacgatagctaataccgcataaaagttggcaacacatgttgttaacttaaaaggagcaattgcttcactatgagatggacctgcgttgtattagctagttggtaaggtaacggcttaccaaggcatcgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttataagcgaagaacgggagtaagagtggaaagtttactctgt

SEQ ID NO: 3834 - DNA, 490 bp, Unknown
  Ascusbbf_1850301, encodes 16S rRNA
agagtttgatcctggctcaggacgaacgctggcggtatgcttaagacatgcaagtcgaacgaggtttgttttgtagtaatacaaaacaaatcgagtggcggacgggtgagtaacgcgtgagcaacctgcctctttcatcgggataccaattggaaacgattgctaataccggatatgaccacagcaccgcatggtgcaggggtgaaagggtttactggaaagagatgggctcgcgtctgattagctagttggcggtgcaacggaccaccaaggcgatgatcagtagccgacctgagagggtgatcggccacattgggactgagacacggcccagactcctacgggaggcagcagtcgggaatattgggcaatggaggaaactctgacccagcaataccgcgtgaaggatgaaggtcttcggattgtaaacttctgttataaaggaagaaacaaatgacggtactttataaggaagccccggcaaactatg

SEQ ID NO: 3835 - DNA, 490 bp, Unknown
  Ascusbbf_1139567, encodes 16S rRNA
agagtttgatcctggctcagaacgaacgctggcggcgcgtcttaagcatgcaagtcgggcggcaagggtgtgcttgcacacccccagagcggcggactggtgagtaacacgtgggtgacgcacccctgggacggggacagcccgtggaaacacagggtaataccggataaggacgcatgggctggagccatgcgtggaaaggagctcaggctccgccgagggagcggcccgcggcccatcagcttgtaggcggtgtaacggaccacctaggctatgacgggtatccggcctgggagggcgatcggacacattgggactgagatacggcccagactcctacgggaggcagcagctaagaatattccgcaatgcgcgaaagcgtgacggagcgacgccgcgtgggcgatgaaggccggaaggttgtaaagccctttggcaggcgaggaataagcgggggagggaatgcccccgcggtgactgtagcctggaa

SEQ ID NO: 3836 - DNA, 490 bp, Unknown
  Ascusbbf_732147, encodes 16S rRNA
agagtttgatcatggctcaggatgaacgctggcggcgtgcttaacacatgcaagtcgaacggagcctgaccttcgaagccctcgggtggaagaggtttgtgcttagtggcggacgggtgagtaacgcgtgggtaatctgccgtatacagggggataacagttggaaacgactgttaataccgcataagcgcacaggtaggcatctaccggtgtgaaaagctccgacggtatacgatgagcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagaaaaagtgacggtacctgactaagaagccccgg

SEQ ID NO: 3837 - DNA, 490 bp, Unknown
  Ascusbbf_949786, encodes 16S rRNA
agagtttgatcatggctcaggacgaacgctggcggcacgcctaacacatgcaagtcgaacggaggtacgaggagcttgctccttttaccttagtggcggacgggtgagtaacacgtgaggaacctgcttttcagtggggaatagcgtttggaaacgaacgataataccgcataacgtgtgttgaccgcatgatcgatacaccaaaggatttattcgctgagagatggcctcgcgtccgattagatagttggcggggtaacggcccaccaagtcgacgatcggtagccggactgagaggttgaacggccacattgggactgagacacggcccagactcctacgggaggcagcagtgggggatattgcacaatggaggaaactctgatgcagcgatgccgcgtgagggaagacggtcttcggattgtaaacctttgtcttaggggacgaagaatgacggtaccctaggaggaagcaccggctaactacgtgc

SEQ ID NO: 3838 - DNA, 490 bp, Unknown
  Ascusbbf_1811388, encodes 16S rRNA
agagtttgatcctggctcaggatgaacgctagcggcaggcctaatacatgcaagtcgtacggtaaacggcccttcggggctgtgagagtggcggacgggtgcgtaacgcgtatgcaaccaacccccgacaggcggacagccggtggaaacgccggataatacgccatacggccgcggtgaggcatctcaccgtggtcaaagcctcggcggtcggggacgggcatgcgtgccattagatagtcggcggggtgacggcccaccgagtcgacgatggctaggggatctgagaggacggtcccccacactggtactgagacacggaccagactcctgcgggaggcagcagtaagggatattgggcaatgggggtaaccctgacccagccatgccgcgtgagggaatgaggccctacgggtcgtgaacctcttttattcggggacaagggcgcgcacgcgatgcacgcttgagggtaccgaaggaataagcgtcg

SEQ ID NO: 3839 - DNA, 472 bp, Unknown
  Ascusbbf_1683980, encodes 16S rRNA
agagtttgatcctggctcagaacgaacgctggcggcaggcctaacacatgcaagtcgagcgcactcttcggagtgagcggcgcacgggtgagtaacgcgtgggaatatgccctggggtcgggaataacggcgggaaactgccgctaatacccggtacgccttgagagggaaaggagcaatccgccctgggagtagcccgcgttggattagctagttggtggggtaaaagcctaccaaggccgcgatccatagctggtctgagaggatgatcagccacactgggactgagacacggcccagactcctacgggaggcagcagtggggaatattggacaatgggggcaaccctgatccagccatgccgcgtgagtgaagaaggccttagggttgtaaagctctttcgacggggacgatgatgacggtacccgtagaagaagccccggctaacttcgtgccagcagccgcggtaat

SEQ ID NO: 3840 - DNA, 490 bp, Unknown
  Ascusbbf_1460924, encodes 16S rRNA
agagtttgatcatggctcaggacgaacgctggcggcgtgcttaacacatgcaagtcgagcgagagacttcggtctctagcggcggacgggtgagtaacacgtgggtaacctgcctcaaagagggggatagcctcccgaaagggagattaataccgcataatatcataccttcgcatgaaggaatgattaaaggagtaatccactttgagatggacccgcggcgcattagctagttggagaggtaacggctcaccaaggcgacgatgcgtagccgacctgagagggtgatcggccacattggaactgagacacggtccagactcctacgggaggcagcagtggggaatattgcacaatgggcgaaagcctgatgcagcaacgccgcgtgagtgaagaaggtcttcggattgtaaagctctgtcttttgggacgaaaaatgacggtaccaaaggaggaagccacggctaactacgtgccagcagccgcgggt

SEQ ID NO: 3841 - DNA, 490 bp, Unknown
  Ascusbbf_881477, encodes 16S rRNA
agagttgatcctggctcaggatgaacgctggcggcgtgcttaacacatgcaagtcgaacgagggattacttatgaagttttcggatggattgagtattcccgagtggcggacgggtgagtaacgcgtgggtaacctgccctgtactgggggacaacagagagaaatttctgctaataccgcataacccgctaaggccgcatggcccggacggaaaagatttatcggtacaggatggacccgcgtctgattagcttgttggcggggtaacggcccaccaaggcgacgatcagtagccgaactgagaggttgaccggccacattgggactgagacacggcccagactcctacgggaggcagcagtggggaatattgcacaatggggggaaccctgatgcagcaacgccgcgtgagtgaggaagtatttcggtatgtaaagctctatcagcagggaagagattgacggtacctgactaagaagccccggctaa

SEQ ID NO: 3842 - DNA, 490 bp, Unknown
  Ascusbbf_1802131, encodes 16S rRNA
agagtttgatcaggctcaggacaaacgctggcggcgtgcataacacatgcaagtcgaacgagaatccagagcgcttcgccttcgggtgaagcgctgtggaggacagtggcgaacgggtgagtaacgcgtaaaaaacctgccttgtacagagggatagcagctggaaacggctattaatacctcatgaagccgatccatcgcatgaaggaacggccaaagatttatcggtatgagatggtcttgcgtctgattagctggttggtggggtaacggcctaccaaggcgacgatcagtagccggcctgagagggtgtacggccacattgggactgagacacggcccaaactcctacgggaggcagcagtggggaattttgcacaatgggggaaaccctgatgcagcgacgccgcgtgaacgaagaaggttttcggattgtaaagttctgtccttggcgaagattgtgacggtagtcaaggaggaagccccggct

SEQ ID NO: 3843 - DNA, 490 bp, Unknown
  Ascusbbf_1463809, encodes 16S rRNA
agagtttgatcctggctcaggattaacgctggcggcgtgcctaatacatgcaagtcgaatggtagcaataccatggcgaacgggtgagtaacacgtaggtaacctgtcgataagccgaggataaccattggaaacgatggataatactggataggagatttgaaggcatctttaaatctttaaagatttatcacttattgaggggcctgcggcgcattagctagttggtgaggtaaaagcttaccaaggcgatgatgcgtagccggactgagaggttgaacggccacaatggaactgagaacggtccatactcctacgggaggcagcagtagggaattttcggcaatgggcgaaagcctgaccgagcaacgccgcgtgaacgaagaagtatttcggtatgtaaagctcttttattagggacgaaaaaaattaaaattgacggtacctaatgaataagctccggctaactacgtgccagcagccgcggtaa

SEQ ID NO: 3844 - DNA, 490 bp, Unknown
  Ascusbbf_887138, encodes 16S rRNA
agagtttgatcatggctcaggatgaacgctggcggcgtgcctaatacatgcaagtcgaacggagcaccttggtgctcagtggcgaacgggtgaggagaacataggtaacctgcccctccgagggggacaacagctggaaacggctgctaagaccgcatagacgcattcagggcatcctggatgcgctaaatgaccggatggtcagcggggggatggacctatgcagtattagctagttggcggggcaacggcccaccaaggcgacgatacttagccggcctgagagggcggacggccacactgggactgagacacggcccagactcctacgggaggcagcagtagggaattttcggcaatgggggaaaccctgaccgagcaacgccgcgtgaacgaagaaggccttcgggtcgtaaagttctgttgtacgggaagaacgtcggatggaggaaatgccatgcgagtgacggtaccgaacatagaaagccac

SEQ ID NO: 3845 - DNA, 490 bp, Unknown
  Ascusbbf_1579962, encodes 16S rRNA
agagtttgatcctggctcaggatgaacgctggcggcgtgcttaacacatgcaagtcgagcgagaaacctgtagatgacgcttcggtagattcagcaggcggaaagcggcggacgggtgagtaacgcgtaggcaacctgcccttagcagagggatagcctcgggaaaccgggatcaaaacctcataatactgatttgtcacatgtcggattagtcaaagatttatcggctaaggatgggcctgcgtctgattagctggttggtgaggtaacggctcaccaaggcaatgatcagtagccgacctgagagggtgatcggccacattggaactgagacacggtccaaactcctacgggaggcagcagtggggaatattgcacaatgggggaaaccctgatgcagcaacgccgcgtgagcgaagaaggcggaatcgtcgtaaagctctgtccttggggaagaaaaaaatgacggtacccttggaggaagccccgg

SEQ ID NO: 3846 - DNA, 490 bp, Unknown
  Ascusbbf_759160, encodes 16S rRNA
aggagtttgatcatggctcaggatgaacgctggcggcgcgcttaacacatgcaagtcgaacggggtttatgacttcggttataaattcagtggcggacgggtgagtaacacgtggataacttgcctttagtgggggatagctgagagaaatctcaattaataccgcataacgtaatttgttcgcatgaatgagttaataaaggtgaaaatcgctaaaagataggtctgcgtctgattagctagttggggtggtaatggcacaccaaggcgacgatcagtaaccggtttgagagaatgaacggtcacattgggactgagatacggcccagactcctacgggaggcagcagtggggaatattgcgcaatggaggaaactctgacgcagcgacgccgtgtgaaggatgaaggccttcgggttgtaaacttttatcgattgtgaaaaggatggatggtagcaaagtaagaagctccggctaattacgtgccagc

SEQ ID NO: 3847 - DNA, 490 bp, Unknown
  Ascusbbf_1862534, encodes 16S rRNA
agagtttgatcctggctcaggacgaacgctggcggcgcgcctaacacatgcaagtcgaacggacttacagagcttgctttgtaagttagtggcggacgggtgagtaacacgtgagcaacctgcctttcagagggggacaacagttggaaacgactgctaataccgcataacatcatcgaacggcatcgtttgatgatcaaagatttatcgctgaaagatgggctcgcgtctgattagatagttggtgaggtaacggcccaccaagtcgacgatcagtagccggactgagaggttgaacggccacattgggactgagacacggcccagactcctacgggaggcagcagtgggggatattggacaatggggggaaccctgatccagcgacgccgcgtgagggaagaaggttttcggattgtaaacctctgttgacagggaagaaaatgacagtacctgttcagaaaaccacggctaactacgtgccagcagc

SEQ ID NO: 3848 - DNA, 490 bp, Unknown
  Ascusbbf_1740332, encodes 16S rRNA
agagtttgatcatggctcagattgaacgctggcggcatgctttacacatgcaagtcgaacggcagcatgggcttcggcctgatggcgagtggcgaacgggtgagtaacacatcggaacatgcctagttgtgggggacaactactcgaaagagtagctaataccgcatgatatctaaggatgaaagcaggggacctttcggggccttgtgcaactagagtggccgatggcagattaggtagttggtgaggtaaaggctcaccaagcctgcgatctgtagctggtctgagaggacgaccagccacactggaactgagacacggtccagactcctacgggaggcagcagtggggaattttggacaatgggcgcaagcctgatccagcaatgccgcgtgcaggatgaaggccttcgggttgtaaactgcttttgtacagaacgaaacgagatttgctaataccaggtcttaatgacggtactgtaagaataagc

SEQ ID NO: 3849 - DNA, 471 bp, Unknown
  Ascusbbf_386766, encodes 16S rRNA
agagtttgatcatggctcagaacgaacattggcggcaggcctaatacatgcaagtcgagcgaggctacgagccgagcggcggacgggtgagtaatgcatgggaatctacctcgcactgggggataactgtcagaaatgatagctaataccgcatacgccacattgggaaaactccggtggtgtgagatgagcccatgtcagattagctagttggtgaggtaacggctcaccaaggcgacgatctgtagctggtttgagaggatgatcagccacactgggactgagacacggcccagactcctacgggaggcagcagtagggaatattggacaatgggcgaaagcctgatccagccatgccgcgtgagtgatgacggccttcgggttgtaaagctctttcgcaggggaagaatttaatgacggtaccctgataagaagtcccggctaactccgtgccagcagccgcggtaat

SEQ ID NO: 3850 - DNA, 490 bp, Unknown
  Ascusbbf_1413626, encodes 16S rRNA
agagtttgatcctggctcaggatgaacgctggcggcgtgcttaatacatgcaagtcgaacggggatgtccacccgatgaggccggagtgcttgcacaaaggccgattcaaccggatatcctagtggcggacgggtgagtaacgcgtgggtaacctgccttatacaggggaataacagtcagaaatggctgctaataccgcataagcgcacgaggccgcatggccatgtgtgaaaagatttcatcggtataagatggacccgcgtctgattagcttgttggtggggtaacggcctaccaaggcgacgatcagtagccgacttgagagagtgatcggccacattgggactgagacacggcccagactcctacgggaggcagcagtagggaatattgcacaatgggggaaaccctgatgcagcgacgccgcgtgagtgatgaagtatttcggtatgtaaagctctatcagcagggaagataatgacggtacct

SEQ ID NO: 3851 - DNA, 490 bp, Unknown
  Ascusbbf_732867, encodes 16S rRNA
agagtttgatcatggctcaggatgaacgctggcggcgtgcctaatacatgcaagtcgaacggacagagcaatctgttagtggcggacgggtgagtaacgcatgaataatctgcccatgagagggggataacacttagaaataggtgctaataccgcataagaccacaacacggcatcgtgaaggggtaaaaggagaaatccgcttatggatgagtttgtgtatcattagctagttggtagtgtaacggactaccaaggcttcgatggttagccggcctgagagggtgaacggccacactggaactgagatacggtccagactcctacgggaggcagcagtaaggaatattgggcaatgggcgaaagcctgacccagcaacgccgcgtgaaggaagaaggtcttcggattgtgaacttctaaaagtggggaaaagaaagtgatggtacccacagataagtcacggcaaactatgtgccagcagccgcggta

SEQ ID NO: 3852 - DNA, 490 bp, Unknown
  Ascusbbf_471782, encodes 16S rRNA
agagtttgatcatggctcaggatgaacgctggcggcgtgcctaacacatgcaagtcgagcgagaagttgctgacggagatttcggtcaacagaagcgatggatagcggcggacgggtgagtaacgcgtaggtaagctgccctacacacaggaatagcctagggaaacctggattaatgcctgatgacgcggcggagtcacatggctctgtcgccaaagatttatcggtgtgggatgcacctgcgtctgattagctggttggtgaggtaacggcccaccaaggcgacgatcagtagccgacctgagagggtaatcggccacattggaactgagacacggtccaaactcctacgggaggcagcagtgaggaatattgcacaatgggggaaaccctgatgcagcaacgccgcgtgagcgaagaaggtcttcggatcgtaaagctctgtcctaagggacgaagaagtgacggtaccttaggaggaagccccggc

SEQ ID NO: 3853 - DNA, 490 bp, Unknown
  Ascusbbf_1001884, encodes 16S rRNA
agagtttgatcatggctcagattgaacgctggcggcaggcttaacacatgcaagtcgaacgatgaatatttagcttgctagatatgattagtggcgaacgggtgagtaatatttaggaatctgccttgtagtgggggataacatagggaaacttatgctaataccgcatgatacctaagggtgaaagggtgcttaggcacttgctacgagatgagcctaaactagattagctagttggtggggtaaaggcttaccaaggcgacgatctatagctggtcttagaggatgatcagccacactgggactgagacacggcccagactcctacgggaggcagcagtggggaatattggacaatgggggaaaccctgatccagccatgccgcgtgtgtgaagaaggccttttggttgtaaagcactttaagtggggaggaagaattatgggggataagcccataatgatgacgttacccacagaacaagcaccggc

SEQ ID NO: 3854 - DNA, 488 bp, Unknown
  Ascusbbf_634270, encodes 16S rRNA
agagtttgatcatggctcagaatgaacgttggcagcgtggattaggcatgcaagtcgagcgacaaggttccttcggggactggaggagcggctaacggggtagtaaagcatcggaacgtaccctttcgtctgggatagccacgggaaactgtgagtaataccggataatctcttcggagcaaaggtccgccgcgtaaggagcggccgatgtgagactaggtagttggtagggtaatggcctaccaagccagagatctctagggggtgtgagagcatggcccccaccactggaactgagacactgtccagacacctacgggtggctgcagtcgagaatcttcggcaatgggcgaaagcctgaccgagcgacgctgcgtgcgggatgaaggcccttgggttgtaaaccgctgtcagaggggatgaaagcgcaagcttgacagagcctcagaggaagcgcgggctaagttcgtgccagcagccgcggtaat

SEQ ID NO: 3855 - DNA, 490 bp, Unknown
  Ascusbbf_1881617, encodes 16S rRNA
agagtttgatcatggctcaggacgaacgctggcggcacgcctaacacatgcaagtcgaacggaggtaagaggagcttgctccgcttaccttagtggcggacgggtgagtaacacgtgaggaacctgcctttcagtggggaatagcgtttggaaacgaacgataataccgcataatgtatcgggaccgcatgatctggataccaaaggatttattcgctgagagatggcctcgcgtccgattagatagttggcggggtaacggcccaccaagtcgacgatcggtagccggactgagaggttgaacggccacattgggactgagacacggcccagactcctacgggaggcagcagtgggggatattgcacaatggaggaaactctgatgcagcgatgccgcgtgagggaagacggtcttcggattgtaaacctttgtcttaggggacgaattttgacggtaccctaggaggaagcaccggctaactacgtgc

SEQ ID NO: 3856 - DNA, 490 bp, Unknown
  Ascusbbf_1772098, encodes 16S rRNA
agagtttgatcctggctcaggataaacgctggcggcgcacataagacatgcaagtcgaacggaagtcgttataaatggaaatgaagatttatcggattagaagtttgtaacaatggctttagtggcggactggtgagtaacacgtaagcaacctggctattagaggggaataacaatgagaaatcattgctaataccgcatatgctgtgaatatcgcatgataaaaacaggaaaggagaaatccgctaatagatgggcttgcgactgattagctagttggtgtggtaacggcataccaaggcaacgatcagtagccgaactgagaggttgaacggccacattgggactgagatacggcccagactcctacgggaggcagcagtcgggaatattgcgcaatggaggaaactctgacgcagtgacgccgcgtataggaagaaggttttcggattgtaaactattgtcgttagggaagaagaaggacagtacc

SEQ ID NO: 3857 - DNA, 490 bp, Unknown
  Ascusbbf_1365729, encodes 16S rRNA
agagtttgatcctggctcaggagaaacgctggcggcgcacataagacatgcaagtcgaacggaactcagacttttgtttacattagtcgaaagtttagtggcggactggtgagtaacacgtgagcaacctgcctttaagaggggaataacagtgagaaatcattgctaataccgcataacgcataaccttcgcatgaaggatatgccaaaggagtaatccgcttaaagatgggctcgcggctgattagttagttggtggggcaacggcctaccaagacagtgatcagtagccgagctgagaggctcaacggccacattgggactgagatacggcccagactcctacgggaggcagcagtcgggaatattgcacaatggaggaaactctgatgcagtgacgccgcgtacaggaagaaggtcctctggattgtaaactgttgtcgaagggaaagataatgacagtacccttggaggaagctccggcaaacta

SEQ ID NO: 3858 - DNA, 490 bp, Unknown
  Ascusbbf_728530, encodes 16S rRNA
agagtttgatcctggctcagattgaacgctggcggcatgctttacacatgcaagtcgaacggcagcatagggagcttgctccctgatggcgagtggcgaacgggtgagtacaacatcggaacgtgtcctttaatgggggataaccagctgaaaggctggctaataccgcatgagacctgagggtgaaagcgggggaacgagcgatcgtccccgtgttgaaggagcggccgatgaccgattagctagttggcgggataagggcccaccaaggcgacgatcggtagctggtctgagaggacgaccagccacattgggactgagacacggcccaaactcctacgggaggcagcagtggggaattttggacaatgggggcaaccctgatccagccatgccgcgtgcaggaagaaggtcttcggattgtaaactgcttttattcgggacaaaagcttgctgaggacaatttggcaagtatgatggtaccgaagga

SEQ ID NO: 3859 - DNA, 490 bp, Unknown
  Ascusbbf_1753052, encodes 16S rRNA
agagtttgatcatggctcaggacgaacgctggcggcgtgcttaacacatgcaagtcgaacgatgaagctggtgcttgcactggtggattagtggcgaacgggtgagtaatacgtgagtaacctgcccttgtctttgggataagcctgggaaactgggtctaatactggatattctgcgctggccgcatggttggtgttggaaagggttatggactggatggggatgggctcacggcctatcagtttgttggtggggtgatggcctaccaagactgcgacgggtagccggcctgagagggtggtcggccacattgggactgagatacggcccagactcctacgggaggcagcagtggggaatattgcacaatggacgcaagtctgatgcagtgacgccgcgtgggggatgacggctttcgggttgtaaactccttttaacactgaagaagcttttgtgacggtaggtgttgaataagcgccggctaactac

SEQ ID NO: 3860 - DNA, 490 bp, Unknown
  Ascusbbf_1741082, encodes 16S rRNA
agagtttgatcatggctcaggacgaacgctggcggcgtgcctaacacatgcaagtcgagcggagggaagggcttcggccctgaacttagcggcggacgggtgagtaacgcgtgagcaacctgtcccagacagggggataccagatggaaacatctgctaataccgcataagaccacggggtcgcatggctccggggtaaaaggaggaatccggtttggggtgggctcgcgtccgattagctggttggtgaggtaacggcccaccaaggcgacgatcggtagccgacctgagagggtgatcggccacattggaactgagacacggtccaaactcctacgggaggcagcagtggggaatattgggcaatgggcgaaagcctgacccagcaacgccgcgtgagggaagaaggttttcggattgtaaacctctgtcctaagtgacgaaggaagtgacggtagcttaggaggaagccccggctaactacgtgcca

SEQ ID NO: 3861 - DNA, 490 bp, Unknown
  Ascusbbf_1786751, encodes 16S rRNA
agagtttgatcctggctcaggatgaacgctggcggcgtgcctaacacatgcaagtcgaacgaagctctttgaacagaggattcgtccaaagtgatgagatgactgagtggcggacgggtgagtaacgcgtgggcaacctaccccatacagggggatagcagacggaaacgactgataataccgcataagcgcacaggaaggcatcttctggtgtgaaaagcttcgacggtatgggatggacccgcgtctgattagctagttggtgaggtaaaggcccaccaaggcgacgatcagtagccggactgagaggtcggacggccacattgggactgagagacggcccaaactcctacgggaggcagcagtgggggatattgcacaatggggggaaccctgatgcagcgacgccgcgtgagtgaagaagtatttcggtatgtaaagctcaatcaaccgggaagaaaggccccgcaaggggagatgacggtaccgg

SEQ ID NO: 3862 - DNA, 490 bp, Unknown
  Ascusbbf_1796050, encodes 16S rRNA
agagtttgatcatggctcaggataaacgctagcggcaggcctaacacatgcaagtcgagcggcagcgcggtgtagcaatacattggcggcgagcggcggacgggtgagtaacgcgtatgcaaccttcccaccacacggggatagccgaccgaaaggacgattaacccccgatggcatccttctgaggcatcttggaaagattaaatattcataggtggtggatgggcatgcgtggcattagttagttggcggggcaacggcccaccaagacgatgatgcctatgggttctaaaaggaagatcccacacatcggtactgagacacggaccgaactcctacgggaggcagcagtgaggaatattggacaatgggggcaaccctgatccagccaaaccgcgtgagggaaggaggtcgttaagatcgtaaacctcttttatatgggaataatcgcccccacgaggtgggggtttgaatgtaccatttgaataag

SEQ ID NO: 3863 - DNA, 470 bp, Unknown
  Ascusbbf_1797178, encodes 16S rRNA
agagtttgatcatggctcagaacgaacgctggcggcaggcttaacacatgcaagtcgaacgcactcttcggagtgagtggcagacgggtgagtaacgcgtgggaacctacctttcggatcggaataacttggggaaactcaagctaagaccggatacgcccttcgggggaatgatttatcgccgagagatgggcccgcgttggattagcttgttggtgaggtaatggctcaccaaggcgacgatccatagttggtctaagaggatgatcagccacactgggactgagacacggcccagactcctacgggaggcagcagtggggaatattggacaatgggggcaaccctgatccagccatgccgcgtgagtgatgaaggccttagggttgtaaagctctttcgccggagaagataatgacggtatccggtaaagaagccccggctaacttcgtgccagcagccgcggtaat

SEQ ID NO: 3864 - DNA, 490 bp, Unknown
  Ascusbbf_1808769, encodes 16S rRNA
agagtttgatcatggctcaggatggacgctagcggcaggcttaacacatgcaagtcgaggggtaacagggagtggcaacactctgctgacgaccggcgcacgggtgcgtaacgcgtatgcaacctacccttaacaggggtataacggagagaaatttccactaatcccccatattgtcacggattcgcatgtttctgtgacgaaaggttattctggttaaggacgggcatgcgtgacattaggtagttggcggggcaacggcccaccaagccgacgatgtctaggggagctgagaggcttatcccccacactggtactgagacacggaccagactcctacgggaggcagcagtgaggaatattggtcaatgggaggaatcctgaaccagccatgccgcgtgggggaagaaggtcctatgggttgtaaaccccttttacgccggagtaataaggagctggcgagctccgatgagagtacggcgggaataag

SEQ ID NO: 3865 - DNA, 482 bp, Unknown
  Ascusbbf_1834093, encodes 16S rRNA
agagtttgatcctggctcagagcgaacgctggcggcaggcttaacacatgcaagtcgaaggtgaagtcgggcttcggcccggcggaaactggcggacgggtgagtaacgcgtagggatgtgcctaagggtacggaataaccgttggaaacgacggctaataccgtatacgccccccgggggaaagctccggcgcccttagatcaacctgcgtccgattagcttgttggtgaggtaatggctcaccaaggctccgatcggtagctggtctgagaggatgatcagccacactgggactgagacacggcccagactcctacgggaggcagcagtggggaatattggacaatgggggcaaccctgatccagccatgccgcgtgagtgaagaaggccctagggttgtaaagctctttcagcggggaagatgatgacggtacccgcagaagaagccccggctaactccgtgccagcagccgcggtaat

SEQ ID NO: 3866 - DNA, 490 bp, Unknown
  Ascusbbf_1167738, encodes 16S rRNA
agagtttgatcctggctcaggatgaacgctggcggcgtgcttaacacatgcaagtcgaacggacttatggcgctgaggcgacttcggtcaaatcttgccataagttagtggcggacgggtgagtgacgcgtgggtaacctgccatatacagggggataacagttagaaatgactgctaataccgcataggcgcacagtgaggcatctcatggtgtgaaaagctccggcggtatatgatggacccgcgtctgattagccagttggcggtgtaacggaccaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtacttcggtacgtaaagctctatcagcagggaagaaaatgacggtacctgactaagaagccccgg

SEQ ID NO: 3867 - DNA, 490 bp, Unknown
  Ascusbbf_1717365, encodes 16S rRNA
agagtttgatcctggctcaggatgaacgctagcgggaggcctaacacatgcaagccgagcggtagattatcttcggatgattgagagcggcgtacgggtgcggaacacgtgtgtaacctgcccttatcaaggggatagcccggagaaattcggattaataccctataacatattttaaggcatcttaagatattaaaaactacggtggataaggatgggcacgcgcaagattagctagttggtgaggtaacggctcaccaaggcgacgatctttagggggcctgagagggtgatcccccacactgggactgagacacggcccagactcctacgggaggcagcagtgaggaatattggacaatgggtggaagcctgatccagccaacccgcgtgaaggaagacggttctatggattgtaaacttcttttctatggggataaacctaccctcgtgagggtggctgaaggtaacataggaataagcaccggct

SEQ ID NO: 3868 - DNA, 490 bp, Unknown
  Ascusbbf_713545, encodes 16S rRNA
agagtttgatcctggctcaggactaacgctggcggcatgcctcacacatgcaagtcgagcggtaagcagtagcaatactgcctagagcggcggacgggtgagtaatatatgaacaatctgccctatactacgggataacatacagaaatggatgctaataccgtatatgaccacaccaaggcatcttggaggggtgaaagaaattcggtataggatgagttcatatcccattagctagttggcaggataacagcctaccaaggcaacgatgggtagccgacctgagagggtgtacggccacactggaattgagaaacggtccagactcctacgggaggcagcagtggggaatattgggcaatggaggaaactcttacccagcgatgccgcgtgaaggaagaaggttttcggattgtaaacttctgttataggtgacgaagaatgacggtagcctataaggaagccccggcaaactatgtgccagcagccg

SEQ ID NO: 3869 - DNA, 473 bp, Unknown
  Ascusbbf_1432019, encodes 16S rRNA
agagtttgatcatggctcagaacgaacgctggcggcatgcctaacacatgcaagtcgaacgatggcttcggccatagtggcgcacgggtgagtaacgcgtggggatctgcccagcagtggggaataacctcgggaaactgaggctaataccgcatacgccccttcggggggaaagatttatcgctgttggatgaacccgcgtcggattagctagttggtggggtaagagcccaccaaggcgacgatccgtagctggtctgagaggatgatcagccacactgggactgagacacggcccagactcctacgggaggcagcagtggggaatattggacaatgggcgcaagcctgatccagcaatgccgcgtgaatgatgaaggccctagggttgtaaagttctttcgacggggacgatgatgacggtacccgtagaagaagcccccggctaacttcgtgccagcagccgcggtaat

SEQ ID NO: 3870 - DNA, 490 bp, Unknown
  Ascusbbf_1824550, encodes 16S rRNA
agagtttgatcatggctcaggacgaacgctggcggcgtgcctaacacatgcaagtcgaacggagttacttcgacagaaaccttcgggtggaagatgatttaacttagtggcggacgggcgagtaacgcgtgaataacctgcccataagagggggataacacagagaaatttgtgctaataccgcatattgagatttaaccgcatgattttatcttgaaagattttatcgcttatggatggattcgcgtaagattagctagttggtgaggtaacggctcaccaaggcgacgatctttagccgaactgagaggttgatcggccgcattgggactgagacacggcccagactcctacgggaggcagcagtgggggatattgcgcaatgggggcaaccctgacgcagcaacgccgcgtgcgggaagaaggtcttcggattgtaaaccgttgtcgcaagggaagaagacagtgacggtaccttgtgagaaagcca

SEQ ID NO: 3871 - DNA, 490 bp, Unknown
  Ascusbbf_1159793, encodes 16S rRNA
agagtttgatcatggctcaggatgaacgctggcggcgtgcataacacattcaagtcgaacggacaccttcgggtgttagtggcggacgggtgagtaacgcgtgaggaacctgccgcggattggggaataacgaccggaaacagtcgctaataccgcataacgcagagatgtcgcatggcaattctgccaaagatttatcgatccgcgatggactcgcgtccaattaggcagttggcggggcaacggcccaccaaaccgacgattggtagccgaactgagaggttgaacggccacattggaactgagatacggtccagactcctacgggaggcagcagtggggaatattgggcaatgggcgaaagcctgacccagcgacgccgcgtgagggaagaaggtcttcggattgtaaacctctttcagcagggaagaaacaaatgacggtacctgcagacaagtcacggctaactacgtgccagcagccgcggtaa

SEQ ID NO: 3872 - DNA, 490 bp, Unknown
  Ascusbbf_726021, encodes 16S rRNA
agagtttgatcctggctcaggatgaacgctggcggcgtgcctaacacatgcaagtcgagcgggaattcaccgaccaaagcttcggcagcgggaagtgaaggagagcggcggacgggtgagtaacgcgtaggtaacctaccttatgcacagggatagccccgggaaactggaattaatacctgataacgcggaggagtcacatggctccatcgccaaagatttatcggcataagatggacctgcgtctgattagctggttggtgaggtaacggcccaccaaggcgacgatcagtagccgacctgagagggtaatcggccacattggaactgagacacggtccaaactcctacgggaggcagcagtggggaatattacacaatgggcgcaagcctgatgtagcaacgccgcgtgagcgaagaaggtcttcggatcgtaaagctctgtcctttgggacgaaggaagtgacggtaccaaaggaggaagccccgg

SEQ ID NO: 3873 - DNA, 490 bp, Unknown
  Ascusbbf_1299969, encodes 16S rRNA
agagtttgatcctggctcagattgaacgctggcggcatgctttacacatgaaagtcggacggcagcgggggtgcttgcacctgccggcgagtggcgaacgggtgagtaatgcatcggaacgtgcccatgtggtgggggataactactcgaaagagtggctaataccgcatacgccctgagggggaaagcgggggattcttcgggacctcgcgccattggagcggccgatgtcggattagctagtaggtggggtaaaggctcacctaggcgacgatccgtagctgctgagaggatgatcagccacactgggactgagacacggcccagactcctacgggaggcagcagtggggaattttggacaatgggggcaaccctgatccagccatgccgcgtgagtgaagaaggccttcgggttgtaaagctctttcagtcgggaagaaacggtgttctctaacatagggcactaatgacggtaccgacagaagaag

SEQ ID NO: 3874 - DNA, 490 bp, Unknown
  Ascusbbf_372892, encodes 16S rRNA
agagtttgatcatggctcaggacgaacgctggcggcgtgcctaatgcatgcaagtcgagcgacgcatactggaggggtaacccactggtatgacggagcggcgaacgggtgagtaacacgtgagcaacctgccccgaagaccgggatagcccagggaaacctggattaataccggataccctcggaggtctgcatagaccaccgaggaaaagcttttgtgcttcgggatgggctcgcggcctatcagcttgttggtgaggtaacggctcaccaaggcatcgacgggtagctggtctgagaggacgatcagccacactgggactgagacacggcccagactcctacgggaggcagcagcagggaatcttgcgcaatgggcgaaagcctgacgcagcaacgccgcgtgggggatgacggccttcgggttgtaaacccctttcagaagggaagaaattgacggtaccttcagaagaagccccggccaactacg

SEQ ID NO: 3875 - DNA, 480 bp, Unknown
  Ascusbbf_759003, encodes 16S rRNA
agagtttgatcatggctcagaacgaacgctggcggcatgcctaacacatgcaagtcgaacgggatcctggtttcggccaggtgagagtggcggacgggtgagtaacacgtgggaacctgccttttggttcgggataaccgcgggaaactgcggctaataccggatgctcccgtgaggggaaagatttatcgccagaagaggggcccgcgtccgattaggtagttggtggggtaatggcctaccaagccgacgatcggtagctggtctgagaggatgatcagccacactgggactgagatacggcccagactcctacgggaggcagcagtggggaatattggacaatgggggcaaccctgatccagcaatgccgcgtgagtgatgaaggccttagggttgtaaagctcttttgccagggaagatgatgactgtacctggagaataagccccggctaacttcgtgccagcagccgcggtaat

SEQ ID NO: 3876 - DNA, 490 bp, Unknown
  Ascusbbf_725559, encodes 16S rRNA
agagtttgatcctggctcaggatgaacgctagcggcaggcctaacacatgcaagtcgaggggcagcgcggggtagcaataccctggcggcgaccggcgcacgggtgcgtaacgcgtatgcaacccacccatgggtgggggataacccggagaaatccggactaataccccgtaacacattcttccgcatggagggatgttgaaagattcatcgtccatggacgggcatgcgtggcattaggtagttggcggggcaacggcccaccaagccatcgatgcctaggggagctgagaggctaatcccccacactggtactgagacacggaccagactcctacgggaggcagcagtgaggaatattggtcaatggagggaactctgaaccagccatgccgcgtgagggaagaaggccctatgggttgtaaacctcttttgcctgggggcaataaggtccttgcgagggtcgatgagagtaccaggcgaataagca

SEQ ID NO: 3877 - DNA, 490 bp, Unknown
  Ascusbbf_823271, encodes 16S rRNA
agagtttgatcctggctcaggacgaacgctggcggcgtgcttaatacatgcaagtcgaacgaggtccaaccaatcgcaagattggggacgacctagtggcgaacgggtgcgtaacacgtgaggaacctgccccgatctctggaataacaagtggaaacacttgctaataccggatgccgtcggaccgccgcatggcggaccgccgaaagattcatcggatcgggagggtctcgcggcctatcagcttgttggcgaggtaacggctcaccaaggcttcgacgggtagctggtctgagaggatgatcagccacactgggactgagacacggcccagactcctacgggaggcagcagtagggaatcttgcacaatgggcgaaagcctgatgcagcaacgccgcgtgcgggaagaaggccctagggttgtaaaccgctttcagcagggaagaaaatgacggtacctgtagaagaaggtgcggccaactacgtgc

SEQ ID NO: 3878 - DNA, 470 bp, Unknown
  Ascusbbf_1479837, encodes 16S rRNA
agagtttgatcatggctcagagcgaacgctggcggcatgcctaacgcatgcaagtcgcacgccctgcaaggggagtggcggacgggtgcgtaacgcgtagggatctgtcctgaggtgggggataaccctgggaaactagggctaataccgcatgatacctgagggtcaaaggcgcaagtcgccttgggaggaacctgcgtccgattagcttgttggtggggtaatggcctaccaaggctgcgatcggtagctggtctgagaggatgatcagccacactgggactgagacacggcccagactcctacgggaggcagcagtggggaatattggacaatgggcgcaagcctgatccagcaatgccgcgtgggtgaagaaggtcttcggattgtaaagccctttcggcggggacgatgatgacggtacccgcagaagaagccccggctaacttcgtgccagcagccgcggtaat

SEQ ID NO: 3879 - DNA, 490 bp, Unknown
  Ascusbbf_1160314, encodes 16S rRNA
agagtttgatcatggctcaggattaacgctggcggcgtgcctaatgcatgcaagtcgaacgtggtcccttcggggattaacgtggcggacgggtgaggaacacgtggggaacctgcccatcggtagggggtagcccgcggaaacgcggggtaattccgtatacgctggcctgggggcagcccgggtcaggaaagggtctttcgagactcgccgatggaggggcctgcgtccgattagcttgttggtggggtaacggcctaccaaggcggtgatcggtagctggtctgagaggacggccagccacagggggactgagacacggcccccactcctacgggaggcagcagcaaggagttttccgcaatgggcgaaagcctgacggagcaacgccgcgtgggggatgacacctttcggggcgtaaaccccttttcttggggacgaagcagtgacggtacccgaggaagaaggcccggctaactacgtgccagca

SEQ ID NO: 3880 - DNA, 490 bp, Unknown
  Ascusbbf_585131, encodes 16S rRNA
agagtttgatcctggctcagaatgaacgttggcggcgtggattaggcatgcaagtcgagcgagaaccccgcaaggggggacagcagcaaacggggtagtaatgtgtcggaacgtgccctctggacggggatagcggcgggaaactgccggtaatacccgatgaactcgagagagcaaaggtgtgattccgccggaggagcggccgacatggtattagctagttggtgaggtaacggctcaccaaggctttgatgcctaggggatgtgagagcatgatccccaccattgggactgagacactgcccagacacctacgggtggctgcagtcgagaatcttcgtcaatgggcgaaagcctgaacgagcgacgccgcgtgcgggatgaaggcccttgggttgtaaaccgctgtcgagggggatgaaggcttgaaggtactccttcaagtttgacagagccctggaggaagcacgggctaagttcgtgccagcag

SEQ ID NO: 3881 - DNA, 490 bp, Unknown
  Ascusbbf_1824777, encodes 16S rRNA
agagtttgatcctggctcaggatgaacgctagcggcaggcttaacacatgcaagtcgaggggcagcggttgtagcaatacaagccggcgaccggcgcaagggtgcgtaacgcgtgagcaatctgcccgtatcagggggataagcgatgggaacgtcgtctaataccgcataacactgtttgtggcatcacagatagttgaaagcttcggtggatacggatgagctcgcgagacattagttagtcggcggggtaacggcccaccaagaccgcgatgtctaggggaactgagaggttggtcccccacactggaactgagacacggtccagactcctacgggaggcagcagtgaggaatattggacaatggtcggaagactgatccagccatgccgcgtgaaggataaggtcctatggattgtaaacttcttttgagagggagcaataaggtagtcgagactaccgatgagagtacctttcgaataagcatcg

SEQ ID NO: 3882 - DNA, 490 bp, Unknown
  Ascusbbf_1804182, encodes 16S rRNA
agagtttgatcatggctcaggacgaacgctggcggcgtgcttaacacatgcaagtcgaacgaagcttgaagatagatttcttcggaatgacatctgatatgactgagtggcggacgggtgagtaacgcgtgagcaacctgcccttcggagggggatagcgtttggaaacgaacggtaataccgcataatgttaacggaaggcatcttctgttaaccaaaactccggtgccgaaggatgggctcgcgttggattagatagttggtggggtaacggcctaccaagtcgacgatccatagccggactgagaggttgaacggccacattgggactgagacacggcccagactcctacgggaggcagcagtggggaagattgcacaatgggggaaaccctgatgcagcaacgccgcgtgaaggaagacggttttcggattgtaaacttctgttcttagggaagaagaaagtgacggtacctaaggagcaagccac

SEQ ID NO: 3883 - DNA, 490 bp, Unknown
  Ascusbbf_503332, encodes 16S rRNA
agagtttgatcctggctcaggacgaacgctggcggtgtgcttaacacatgcaagtcgagcggggtccatccggtggcaacaccggtgaagacctagcggcgaacgggtgagtaacacgtgaggaacctgccccgaagtcgggaacaacccggggaaacccgggctaatgcccgataccccccactgatcgcatggtcggtggaggaaagatttatcgcttcgggagggcctcgcggcctatcagcttgttggtggggtaatggcctaccaaggcagcgacgggtagctggtctgagaggacgatcagccacactgggactgagacacggcccagactcctacgggaggcagcagtggggaatcttgcgcaatgggcgaaagcctgacgcagcaacaccgcgtgcgggatgaaggccttcgggttgtaaaccgctttcagcagggacgaaattgacggtacctgcagaagaagccccggccaactacgtgc

SEQ ID NO: 3884 - DNA, 490 bp, Unknown
  Ascusbbf_317960, encodes 16S rRNA
agagtttgatcctggctcaggatgaacgctggcggcgtgcttaatacatgcaagtcgaacgctgatatagtcttcggactattgatgagtggcgaacgggtgagtaatacgtaggtaatctaccctgctgagcgggataacagttggaaacgactgctaataccgcataggtaatcagatggcatcaactgattattaaagtcgcgtttgcggcactgcaggatgagcttacggtgcattagttagttggtgaggtaacggcccaccaagaccgtgatgcatagccggcctgagagggtgaacggccacattgggactgagacacggcccagactcctacgggaggcagcagtaaggaattttcggcaatggacgaaagtctgaccgagcaacgccgcgtgagtgatgaaggtcttcggatcgtaaagctctgttgtaaaggaagaacaagcagattaggaaatgaatctgttctgacggtactttacta

SEQ ID NO: 3885 - DNA, 490 bp, Unknown
  Ascusbbf_516633, encodes 16S rRNA
agagtttgatcatggctcaggatgaacgctggcggcgtgcttaacacatgcaagtcgaacgaattttttactgaaggaagcttcggcagacggaggtaagaagtgagtggcggacgggtgagtaacgcgtgggtaacctgcctcacattgggggataccagtcggaaacgactgctaaaaccgcataagaccacagcaccgcatggtgcggcggccaaaactccggtgatgtgagatggacccgcgtctgattagccagttggcggggtaacggcccaccaaagcgacgatcagtagccgacctgagagggtgatcggccacattgggactgagacacggcccaaactcctacgggaggcagcagtggggaatattgcacaatgggggaaaccctgatgcagcgacgccgcgtgagcgatgaagtatttcggtacgtaaagctctatcagcaggaacgataatgacggtacctgactaagaagcaccggc

SEQ ID NO: 3886 - DNA, 490 bp, Unknown
  Ascusbbf_1710900, encodes 16S rRNA
agagtttgatcatggctcaggatgaacgctagcggcaggcttaacacatgcaagtcgaggggcagcgcggagtagcaatactctggcggcgaccggcggaagggtgcgtaacgcgtgagcaacctgcccgtaaccgggacataaccgatggaaacgtcgcctaatttcccataacaactggattggcatcacttcagtttgaaagcttcggtggttacggatgggctcgcgagacattagctggttggtagggtaacggcctaccaaggcgacgatgtctaggggttctgagaggaaggtcccccacattggaactgagacacggtccagactcctacgggaggcagcagtgaggaatattggacaatggccggaaggctgatccagccatgccgcgtgcgggaggacggccctatgggttgtaaaccgcttttgcgagggagcaataagagtcacgtgtggctcgatgagagtacctcgcgaataagca

SEQ ID NO: 3887 - DNA, 490 bp, Unknown
  Ascusbbf_1259506, encodes 16S rRNA
agagtttgatcctggctcagaatgaacgttggcggcgtggattaggcatgcaagtcgcgcgagaagtcccttcggggacggacagcggcgaaagggagaggaatacgtagaaatctaccctcgggtctgggatagcgtcgggaaactggcggtaataccggataacgtcttcggaccaaaggtgtgactccacctgaggatgagtctacgtcctattagctagttggcggggtaatggcccaccaaggcaacgatgggtagcgggtgtgagagcatgacccgcctcactgggactgagacactgcccagacacctacgggtggctgcagtcgagaatctttgtcaatggacgaaagtctgaacaagcgacgccgcgtgcgggatgaaggccttcgggttgtaaaccgctgtcgtaggggaacaaatgtattggggtactcccctttacttgagtgatcctaggaggaaggacgggctaagttcgtgccag

SEQ ID NO: 3888 - DNA, 490 bp, Unknown
  Ascusbbf_1611772, encodes 16S rRNA
agagtttgatcatggctcaggatgaacgctggcggcgtgcctaacacatgcaagtcgaacgttagagtcatggaactagcaatagggaaatggctcaaaagtggcgaacgggtgagtaacacgtaggtaacctgccccgcagggggggataacgactggaaacggtcgctaataccgcatagtactgttttggggggaccctgaacagttaaaactttggtgctgcgcgaggggcctgcgtccgattagttagttggtgaggtaatggctcaccaaggcgatgatcggtagctggtctgagaggatgatcagtcacacgggaactgagacacggtcccgactcctacggggggcagcagtgaggaatattgcacaatggacgaaagtctgatgcagcaacgccgcgtggaggatgacggcccttgggttgtaaactccttttttcagggaagagagaggacggtacctgaagaataagtcacggctaact

SEQ ID NO: 3889 - DNA, 490 bp, Unknown
  Ascusbbf_1127068, encodes 16S rRNA
agagtttgatcatggctcaggacgaacgctggcggcgtgcctaacacatgcaagtcgaacgaatgtactagcaatagtacattagtggcggacgggtgagtaatacatgagtaacctgccttatacagggggataacacctagaaatgggtgctaataccgcataataacctaatatggcatcataataggaggaaaggagaaatccggtaaaagatggactcatgttcgattagctagttggtggggtaaaggcctaccaaggcaacgatcgatagccgaactgagaggttgatcggccacattggaactgagaaacggtccagactcctacgggaggcagcagtggggaatattgcacaatggggggaaccctgatgcagcaacgccgcgtgagtgaggaagtatttcggtatgtaaagctctatcagcagggaagagattgacggtacctgcataagaagccccggctaactacgtgccagcagccg

SEQ ID NO: 3890 - DNA, 490 bp, Unknown
  Ascusbbf_1838655, encodes 16S rRNA
agagtttgatcctggctcaggatgaacgctggcggcgtgcttaacacatgcaagtcgagcgagaaatgagagattgaatcttcggatgaaagatctcatggacagcggcggacgggtgagtaacgcgtgggcaacctgcccttaactgagggatagccgagggaaacttcgtgtaatacctcataacgcattttgaccgcatgatcgaaatgccaaagatttatcggttaaggatgggcccgcgttcgattagcttgttggtgaggtagcggctcaccaaggcgacgatcggtagccggcctgagagggtgaacggccacattggaactgagacacggtccagactcctacgggaggcagcagtggggaatattgcacaatgggcgaaagcctgatgcagcaacgccgcgtgaaggaagaaggtcttcggatcgtaaacttctgtccttagggaagaataatgacggtacctttggaggaagccccggct

SEQ ID NO: 3891 - DNA, 490 bp, Unknown
  Ascusbbf_1374868, encodes 16S rRNA
agagtttgatcctggctcaggatgaacgctggcggcgtgcctaacacatgcaagtcgagcgtgatcggggagagtgcttgcactcatcccgtgaaagcggcggacgggtgagtaacgcgtaggtaacctgccttcggctcagggatagctccgggaaactgggattaatacctgataaagcgatgaggcctcctggtcttaccgccaaagatctatcggccgaagatggacctgcgtctgattagctagttggtgaggtaacggcccaccaaggcgacgatcagtagccgacctgagagggtaatcggccacattggaactgagacacggtccaaactcctacgggaggcagcagtggggaatattgcacaatgggcgcaagcctgatgcagcaacgccgcgtgagtgaagaaggtcttcggatcgtaaagctctgtccttggggacgaagaagtgacggtacccgaggaggaagccccggctaactacg

SEQ ID NO: 3892 - DNA, 470 bp, Unknown
  Ascusbbf_1031148, encodes 16S rRNA
agagtttgatcctggctcagattgaacgctggcggcaggcctaacacatgcaagtcgaacgctgtagcaatacagagtggcagacgggtgagtaacgcgtgggaaccttcccaatggtgcggaatagcccagggaaacttggggtaataccgcataagcccttagggggaaagatttatcgccattggatgggcccgcgtcggattagctagttggtgaggtaatggctcaccaaggcaacgatccgcagctggtttgagagaatgaccagccacactgggactgagacacggcccagactcctacgggaggcagcagtggggaatcttggacaatgggcgaaagcctgatccagccatgccgcgtgagtgacgaaggccttagggttgtaaagctcttttgccggggaagataatgactgtacccggagaataagtcccggctaacttcgtgccagcagccgcggtaat

SEQ ID NO: 3893 - DNA, 482 bp, Unknown
  Ascusbbf_306496, encodes 16S rRNA
agagtttgatcatggctcaggactaacgctggcggaatgcctcatacatgcaagtcgaacggcccttcggggcagtggcggacgggtgagtaacacgtaggtaacgtgccctttactgggggataacagagggaaacttctgctaataccgcataagacagtggttgaaatactgctgtttaaagatttatcggtaaaggatcggcctgcgtcggattagctagttggtagggtaaaggcctaccaaggcaacgatccgtaattggtctgagaggatgaccagtcacagtgggactgagacacggcccacactcctacgggaggcagcagtagggaatattgcgcaatgggcgaaagcctgacgcagcaattccgcgtggaggatgaaggttcttggatcgtaaactcctttcagtggtgacgattatgacggtagccacagaagaagcaccggctaactacgtgccagcagccgcggtaat

SEQ ID NO: 3894 - DNA, 490 bp, Unknown
  Ascusbbf_394818, encodes 16S rRNA
agagtttgatcatggctcaggacgaacgctggcggcgtgcttaacacatgcaagtcgaacggggatacgacagatgagagcttcggcaggattcagttgtattcgagtggcggacgggtgagtaacgcgtgagcaatctatcccggacagggggataacacttggaaacaggtgctaataccgcataggaccacgctaccgcatggtagaggggtgaaaggagagatccggtctgggttgagctcgcgtccgattagccagttggcggggtaacggcccaccaaagcgacgatcggtagccggactgagaggttgaacggccacattggaactgagagacggtccaaactcctacgggaggcagcagtgggaatattgggcaatgggcgaaagcctgacccagcaacgccgcgtgagtgaagaaggccttcgggttgtaaagctctgttatgagggacgaaggagtgacggtacctcataaggaagcccc

SEQ ID NO: 3895 - DNA, 490 bp, Unknown
  Ascusbbf_1770851, encodes 16S rRNA
agagtttgatcatggctcaggacgaacgctggcggcgtgcttcatacatgcaagtcgaacgacaggcatcctttcgggggtgtcatggagtggcgaacgggtgagtaacacgtgagtaatctgccttcagctttgggataacccccggaaacggggactaataccggatatgaccattgctcgcatgggtggtggtggaaagtttttcggctgaagatgggctcgcggcctatcagcttgttggtggggtaatggcctaccaaggcggtgacgggtagccggcctgagagggcgaccggccacactgggactgagacacggcccagactcctacgggaggcagcagtagggaatattgcgcaatgggcgaaagcctgacgcagcgacgccgcgtgagggatgacggccttcgggttgtaaacctctttcagcagggacgaagcgcaagtgacggtacctgcagaagaagctccggctaactacgtgccag

SEQ ID NO: 3896 - DNA, 490 bp, Unknown
  Ascusbbf_955055, encodes 16S rRNA
agagtttgatcctggctcagaacgaacgctggcggcaggcttaacacatgcaagttgagcgggaattggagatagcttgctatcaaagaggagagcagcgcactggtgagtaacacgtgggaacgtaccttttggtgggggacaacagatggaaacgtctgctaataccgcataagccctgagggggaaaggagagatttgccgaaagatcggcccgcggaagattaggtagtaggtggggcaacggcctacctagccgacgatctatagctggtctgagaggacgatcagccacattggaactgagacacggtccagactcctacgggaggcagcagtgaggaatattggtcaatgggcgcgagcctgaaccagccaagtagcgtgcaggacgactgccctatgggttgtaaactgcttttatcagggaataaagtgaggcacgcgtgcctttttgtatgtacctgatgaataaggaccggctaattcc

SEQ ID NO: 3897 - DNA, 490 bp, Unknown
  Ascusbbf_1859030, encodes 16S rRNA
agagtttgatcatggctcaggacgaacgctggcggcatgcctaacacatgcaagtcgaacggagtttacggagcttgctctgtaaacttagtggcggacgggtgagtaacgcgtgagcaacctgcctttcagtggggaataatgttctgaaaaggacactaataccgcataacgtactgaggtcgcatggccatggtaccaaaggatttattcgctgagagatgggctcgcgtccgattagctagttggtggggtaacggcctaccaaggcgacgatcggtagccggactgagaggttgaacagccacattgggactgagacacggcccagactcctacgggaggcagcagtgggggatattgcgcaatgggggaaaccctgacgcagcaatgccgcgtgaaggattgaaggtcttcggattgtaaacttcttttgtcagggacgataatgacggtacctgacgaataagctccggctaactacgtgcca

SEQ ID NO: 3898 - DNA, 490 bp, Unknown
  Ascusbbf_1114481, encodes 16S rRNA
agagtttgatcctggctcaggacgaacgctggcggcgtgcttaacacatgcaagtcgagcgaagctcttctcttcggagaagatgacttagcggcgaacgggtgagtaacacgtgggcaacctgcccttagctctgggataagcgatggaaacgtcgtctaataccggatacgacacgggacggcatcatcaccgtgtggaaagaatttcggctaaggatgggcccgcggcctatcagcttgttggtggggtaatggcctaccaaggcttcgacgggtaaccggcctgagagggcgaccggtcacactgggactgagacacggcccagactcctacgggaggcagcagtgggaatattgcacaatgggcgaaagcctgatgcagcgacgccgcgtgagggatgacggccttcgggttgtaaacctctttcagcagggacgaagcgaaagtgacggtacctgcagaagaagcgccggccaactacgtgcca

SEQ ID NO: 3899 - DNA, 160 bp, Unknown
  Ascusbbf_385660, encodes 16S rRNA
agagtttgatcctggctcagcagccgcggtaatgccagcagccgcggtaatagagtttgatcctggctcagagtttgatcctggctcagagtttgatcctggctcagagtttgatcctggctcagagtttgatcatggctcagccagcagccgcggtaat

SEQ ID NO: 3900 - DNA, 490 bp, Unknown
  Ascusbbf_1052157, encodes 16S rRNA
agagtttgatcatggctcaggatgaacgctggcggcgtgcctaatacatgcaagtcgaacggggtcgatgagagcttgctccttgaagccaagtggcgaacggatgagtaacacgtaggtaacctgcctttcagtttgggatacccagaggaaactttggctgataccggataactaatttagaggcatctctagattctaaaaggggctccaaaacctcgctgattgatggacctgcggcgcattagctagttggtgagataacagcccaccaaggcgaggatgcgtagccgacctgagagggtgaacggccatactggaactgagacacggtccagactcctacgggaggcagcagtagggagttttcggcaatgggcgaaagcctgaccgagcaacgccgcgtgagtgatgaaggtcttcggattgtaaaactctgttgtaggggaagaacggtacggtgaggaaatgctccgtatttgacggtacc

SEQ ID NO: 3901 - DNA, 490 bp, Unknown
  Ascusbbf_1046234, encodes 16S rRNA
agagtttgatcctggctcaggacgaacgctggcggcgcgcctaacacatgcaagtcgaacggaacttttgagtgacttcggtttctcttgagtttagtggcggacgggtgagtaaagcatgagtaactttcccttgagtggggaataacttttggaaacagaagataataccgcatacttcaaaggatcgcatgatcttttggcaaagattttcgcttttggataggctcatgtctgattagcttgttggtgaggtaatggctcaccaaggcttcgttcagtagccgtaccgagaggttctacggccacattgggactgagacacggcccagactcctacgggaggcagcaatgaggaatattgcgcaatggaggaaactctgacgcagcgacgccgtgtgaaggatgaaggtcttcggattgtaaacttctgtcctcagggaagaaatcaatgacggtacctggggaggaagccccggctaactacgtg

SEQ ID NO: 3902 - DNA, 490 bp, Unknown
  Ascusbbf_1324912, encodes 16S rRNA
agagtttgatcctggctcaggatgaacgctggcggcgtgcctaacacatgcaagtcgaacggaaagaattcttcggaattctttcagtggcggacgggtgagtaacgcgtgggtaacctgccccatacaggggaacaacagctggaaacggctgctaataccgcataagcgcacagtactgcatggtacagtgtgaaaagatgctatcggtatgggatggacccgcgtctgattagctagttggcggggtaacggcccaccaaggcgacgctcagtagccgccctgggagggtgaccggccgaattgtgactgagccacggcccaaactcctacagggggcagcagtgggggatattgcacaatgggcgaaagcctgatgcagcgacgccgcgtgagtgaggaagtatttcggtatgtacagctctatcagcagggaagaaaatgacggtacctgactaagaagccccggctaactacgtgccagcagcc

SEQ ID NO: 3903 - DNA, 490 bp, Unknown
  Ascusbbf_998003, encodes 16S rRNA
agagtttgatcatggctcgggacgaacgctggcggcgtgcctaacacatgcaagtcgagcgaagtatttaaagaagatctcttcggagtgaaactttaaatatcttagcggcggacgggtgagtaacgcgtgagaaacctgcctttcacaaagggatagcctcgggaaactgggattaataccttatgatgtttcatcttagcattaagaagaaaccaaagcgtaaagcggtgaaagatggtctcgcgtcccattagctagttggtgagataaaagcccaccaaggcgacgatgggtagccggcctgagagggtgaacggccacactggaactgagacacggtccagactcctacgggaggcagcagtggggaatattgcacaatggaggaaactctgatgcagcgacgccgcgtgagcgatgaaggctttcgagtcgtaaagctctgtcctaggggacgataatgacggtaccctaggaggaagccccg

SEQ ID NO: 3904 - DNA, 490 bp, Unknown
  Ascusbbf_876882, encodes 16S rRNA
agagtttgatcctggctcagattgaacgctggcggcatgcttaacacatgcaagtcgaacggcagcagcatctagcttgctagatggctggcgagtggcggacgggtgagtaatatctaggaatctaccccagagagggggataagtcggggaaactcggtctaataccgcatacactctacggagcaaagcaggggaccttcgggccttgcgctttgggatgagcctagatcggattagctagttggtggggtaatggcctaccaaggcaacgatccgtagctggtctgagaggacgaccagccacactgggactgagacacggcccagactcctacgggaggcagcagtggggaatattggacaatgggcgcaagcctgatccagcaatgccgcgtgtgtgaagaaggccttcgggttgtaaagcacttttagtaaggaagaaaggctcaagattaatacccttgagagttgacgttacttacagaaa

SEQ ID NO: 3905 - DNA, 489 bp, Unknown
  Ascusbbf_672333, encodes 16S rRNA
agagtttgatcctggctcaaattgaacgctggcggcaggcctaatacatgcaagtcgaacgaagtagcaatacttagtggcgcaagggtgaggaacacgtgagtgacctgcccgcaagtttggaacagctcctggaaacgggaattaataccggatgtgatcatattgctgcatggtgatatgattaaagcagtaatgcgcttgcggatgggctcgcgtcccattagctagttggtgaggtaacggcccaccaaggccatgatgggtagctggtctgagaggacgaccagccacactgggactgagaactgcccagactcctacgggaggctgcagtcgagaattttgggcaatggacgagagtctgacccagcaatgccgcgtgcgggatgaaggtcttcggattgtaaaccgctgtttggagggacgaaaattgacggtacttccagagaaagccacggctaactacgtgccagcagccgcggtaat

SEQ ID NO: 3906 - DNA, 490 bp, Unknown
  Ascusbbf_1874000, encodes 16S rRNA
agagtttgatcctggctcaggacgaacgctggcggcgtgcttaacacatgcaagtcgaacgatgaagctggagcttgctctggtggattagtggcgaacgggtgagtaatacgtgagcaacgtgccccttcctctggaataacttcgagaaatcggagctaatactggatatgtggcgtgaccgcatggtctgcgtctggaaagatttatcggggagggatcggctcacggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagtggcgtgttttcatgtcgtgacggtacctgcagaaaaagcaccgg

SEQ ID NO: 3907 - DNA, 490 bp, Unknown
  Ascusbbf_1820219, encodes 16S rRNA
agagtttgatcatggctcaggacgaacgctggcggcgtgcctaatacatgcaagtcgaacgcttggagttccttcgggagcttcaggagtggcggacgggtgagtaacacgtaggcaacctgcctgtaagacagggataactagtggaaacactagctaataccagataattaatcctctcgcatgagaagattatgaaaggcggtttcggctgccacttacggatgggcctgcggcgcattagctagtaggtaaggtaacggcttacctaggcgacgatgcgtagccgacctgagagggggatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacaggagtgagagtaactgctcactttgtgacggtacctgag

SEQ ID NO: 3908 - DNA, 490 bp, Unknown
  Ascusbbf_1840634, encodes 16S rRNA
agagtttgatcatggctcaggatgaacgctagcggcaggcttaacacatgcaagtcgaggggcagcgcgatggtagcaataccgttggcggcgaccggcgcaagggtgcgtaacgcgtgagcaacatgcccgtatcagggggaaaagcgatggaaacgtcgtctaataccgcataataatttgtcaggcatctgatggatttgaaagttttgacggatacggattggctcgcgagacattagctagacggcggggtaacggcccaccgtggcgacgatgtctaggggttctgagaggaaggtcccccacactggaactgagacacggtccagactcctacgggaggcagcagtgaggaatattggacaatggtcggaagactgatccagccatgccgcgtgaaggaagacggtcctatggattgtaaacttcttttgtacgagagcaataaggtgtacgtgtacactgatgagagtatcgtacgaataag

SEQ ID NO: 3909 - DNA, 490 bp, Unknown
  Ascusbbf_1124416, encodes 16S rRNA
agagtttgatcctggctcagaatgaacgttggcggcgtggattaggcatgcaagtcgagcgagaagctcccttcggggagtggagagcggcggaagggacagtaacacgtagattacgtatcctcgggtccgggataactgtgcgaaagcacttgtaataccggataacatcttcggatcaaaggtgtgattccgcctaaggagcggtctgcgtcctattagtttgttggtggggtaatggcctaccaaggctttgatgggtagcgggtgtgagagcatgacccgcgtcactgggactgagacactgcccagacacctacgggtggctgcagtcgagaatcttcggcaatgggcgaaagcctgaccgagcgacgccgcgtgcgggatgaaggccttcgggttgtaaaccgctgtcagtggggaggaaggctgcgtgaagaacgcagtttgacctatcttcagaggaaggacgggctaagttcgtgccagc

SEQ ID NO: 3910 - DNA, 490 bp, Unknown
  Ascusbbf_1770437, encodes 16S rRNA
agagtttgatcatggctcagattgaacgctggcggcatgcctaacacatgcaagtcgaacggcaacacggtctagcttgctagactggtggcgagtggcgaacgggtgagtaacgcgtaggaatatgccttaatgagggggacaacttggggaaactcaagctaataccgcataatctctgaggagagaagctggggaccgcaaggcctggcgctttaagattagcctgcgtccgattagctagttggtagggtaaaggcctaccaaggcgacgatcggtagctggtctgagaggatggccagccacactgggactgagacacggcccagactcctacgggaggcagcagtggggaatattggacaatggggggaaccctgatccagcaatgccgcgtgtgtgaagaaggcctgagggttgtaaagcactttcagtggggaggagggcaagcgggttaagagctggcttgttggacgttacccacagaag

SEQ ID NO: 3911 - DNA, 490 bp, Unknown
  Ascusbbf_1016220, encodes 16S rRNA
agagtttgatcctggcttaggataaacgctggcggcgtgcataacacattcaagtcgaacgaagctccggaacttgcttgcaagggaaggaagacttagtggcggacgggtgggtaacgcgtgagcaatctgccttggggtgcgggataacgtttggaaacggacgctaataccgcatgacgcatggatatcgcatggtgaccatgccaaagatttattgccctgagatgagctcgcgtccgattagatagttggtgaggtaacggctcaccaagtcagcgatcggtagccggactgagaggttgaacggccacattggaactgagatacggtccagactcctacgggaggcagcagtggggaatattgggcaatgggcgaaagcctgacccagcgacgccgcgtgagggaagaaggtcttcggattgtaaacctctttcagcagggaagaaggaagtgacggtacctgcagaagaagccacggctaact

SEQ ID NO: 3912 - DNA, 490 bp, Unknown
  Ascusbbf_1896578, encodes 16S rRNA
agagtttgatcctggctcaggacgaacgctggcggcgtgcttaacacatgcaagtcgaacgaggttatttaccggaagtcttcggatggaaagtggataaccgagtggcggacgggtgagtaacgcgtgagcaacctgtcttctacagggggataacactccgaaaggagcgctaataccgcataagaccacggtttcgcatgggactgaggtcaaaggaggaatccggtagaaggtgggctcgcgtcccattagatagttggtgaggtaacggctcaccaagtcgatgatgggtagccgacctgagagggtgatcggccacattggaactgagatacggtccagactcctacgggaggcagcagtggggaatattgggcaatgggcgaaagcctgacccagcaacgccgcgtgagggaagaaggttttcggattgtaaacctctgtccttggtgaagatcatgacggtagccgaggaggaagctccggc

SEQ ID NO: 3913 - DNA, 490 bp, Unknown
  Ascusbbf_734217, encodes 16S rRNA
agagtttgatcatggctcagaatgaacgttggcagcgtggattaggcatgcaagtcgagcgacaagtttcccttcggggagatggaggagcggctaacggggtagtaaggcatcggaacgtacccttcagtcgggaatagccacgggaaactgtgagtaatgcccgatgatatcttcggatcaaaggtccgccgctgagggagcggccgatgtgagactaggtagttggcggggtaacggcccaccaagccagagatctctagggggtgtgagagcatgacccccaccactgggactgagatactgcccagacacctacgggtggctgcagtcgagaatcttcggcaatgggcgcaagcctgaccgagcgacgctgcgtgcgggatgaaggcccttgggttgtaaaccgctgtcagaggggatgaaagcgcaagcttgacagagcctcagaggaagcgcgggctaagttcgtgccagcagccgcggtaat

SEQ ID NO: 3914 - DNA, 490 bp, Unknown
  Ascusbbf_1821498, encodes 16S rRNA
agagtttgatcatggctcaggacgaacgctggcggcgtgcctaacacatgcaagtcgagcgagaatctttgaagtagcttgctacggagaagaggacagcggcggacgggtgagtaacgcgtaggtaagctgccccttgcagaaggatagcctcgggaaactgggattaatacttcataaagcgttttcatcgcatggtgagaacgccaaagatctatcggcaagggatgcacctgcgtctgattagatagttggtagggtaacggcctaccaagtcaacgatcagtagccgacctgagagggtaatcggccacattggaactgagacacggtccaaactcctacgggaggcagcagtggggaatattgcacaatgggcgaaagcctgatgcagcaacgccgcgtgagtgaagaaggtcttcggattgtaaaactctgttcttgggaaagaaaaaatgacggtacccaaggagaaagccccggctaacta

SEQ ID NO: 3915 - DNA, 490 bp, Unknown
  Ascusbbf_1812975, encodes 16S rRNA
agagtttgatcatggctcaggatgaacgctagcggcaggcttaacacatgcaagtcgaggggcatcgcgggggtagcaatacacctggcggcgaccggcggaagggtgcgtaacgcgtgagcaacatgcccgtcacagggggataaaagatggaaacgtctcctaataccccataacatcgtttgaggcatctcagatggttgaaagttacggcggtgacggattggctcgcgtgacattagctagttggagtggtaacggcacaccaaggcgacgatgtctaggggttctgagaggaaggtcccccacactggaactgagacacggtccagactcctacgggaggcagcagtgaggaatattggtcaatgggcggaagcctgaaccagccatgccgcgtgaaggaataaggtcctatggatcgtaaacttcttttgtgcgggagcaataagggctacgtgtagtccgatgagagtaccgtacgaataag

SEQ ID NO: 3916 - DNA, 470 bp, Unknown
  Ascusbbf_501442, encodes 16S rRNA
agagtttgatcatggctcagaacgaacgctggcggcaggcctaaaacatgcaagtcgaacgatgtagcaatacatagtggcgcacgggtgagtaacacgtgggaacataccctttggtgcggaacaacgtctggaaacggacgctaataccgcataatatctacggatcaaagatttatcgccaagggattggcccgcgctagattaggtagttggtgaggtaatggctcaccaagcctacgatctatagctggtttgagaggatgatcagccacactgggactgagacacggcccagactcctacgggaggcagcagttaggaatattggacaatgggcgaaagcctgatccagccatgccgcgtgtgtgatgaaggccttagggttgtaaagcactttcgtccgcgaagataatgacagtaccggaagaagaagctccggctaaattcgtgccagcagccgcggtaat

SEQ ID NO: 3917 - DNA, 490 bp, Unknown
  Ascusbbf_1880223, encodes 16S rRNA
agagtttgatcctggctcagaacgaacgccggcggcgcgtcttaagcatgcaagtcgggcgggattcaggtgcttgcacctgatgagagcggcggactggcgaggaacgcgtgggcgacgtgccccccgcaccgggacagccggcagaaatgccgggtgatacgggatgcggtccggtactgtggtggtgccggaggaaagctgccacggcagcggcgggggagcggcccgcgtcccatcagctagtaggcggggcaagggcccacctaggcgacgacgggtacccggactgagaggtcggacgggcgcattgggactgagatacggcccagactcctacgggaggcagcagctaagaatattccgcaatgggcgaaagcctgacggagcgacgccgcgtggacgatggaggccggaaggttgtaaagtcctctggcgcctgaggaaaaaccgccgcagggaatggcggcgggatgactgtagggcgaga

SEQ ID NO: 3918 - DNA, 490 bp, Unknown
  Ascusbbf_1818358, encodes 16S rRNA
agagtttgatcctggctcaggatgaacgctagctacaggcttaacacatgcaagtcgaggggcagcatgaaccaagcttgcttggtttgatggcgaccggcgcacgggtgagtaacgcgtatccaaccttccccctggtagggcatagcccggcgaaagtcggattaataccctatgttctccttcgagagcatttgacgaggagcaaagatttatcgccatgggatggggatgcgtccgattaggttgacggcggggtgacggcccaccgtgcccgcgatcggtaggggttctgagaggaaggtcccccacattggaactgagacacggtccaaactcctacgggaggcagcagtgaggaatattggtcaatgggcgtaagcctgaaccagccaagtagcgtgcgggacgacggccctatgggttgtaaaccgcttttgcaggggaataaagtgtgggacgtgtcccattttgcatgtaccctgagaat

SEQ ID NO: 3919 - DNA, 490 bp, Unknown
  Ascusbbf_1769666, encodes 16S rRNA
agagtttgatcctggctcaggacgaacgctggcggcgtgcctaatacatgcaagttgagcgctgaagattggtacttgtaccgattggatgagcagcgaacgggtgagtaacgcgtggggaatctgcctttgagcgggggacaacatttggaaacgaatgctaataccgcataatagctttaaacataagttttaagtttgaaagatgcaattgcatcactcaaagatgatcccgcgttgtattagctagttggtgaggtaaaggctcaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacgacgaggagagtggaaagctcctcgtgtgacggtatct

SEQ ID NO: 3920 - DNA, 490 bp, Unknown
  Ascusbbf_1803148, encodes 16S rRNA
agagtttgatcatggctcaggacgaacgctggcggcgtgcctaacacatgcaagtcgagcgaagtttttaaagtggatcccttcggggtgaaacattaactgtcttagcggcggacgggtgagtaacgcgtgagtaacctgcctttcacaaagggatagcctcgggaaactgagattaataccttacgatactcttttccagcattggagaaaagttaaagcgtaaagcggtgaaagatggtctcgcgtcccattagttagttggtgaggtaacggctcaccaagactgcgatgggtagccggcctgagagggtgaacggccacactggaactgagacacggtccagactcctacgggaggcagcagtggggaatattgcacaatggaggaaactctgatgcagcgacgccgcgtgaacgatgaaggctttcgggtcgtaaagttctgtcctaggggacgataatgacggtaccctaggaggaagccccg

SEQ ID NO: 3921 - DNA, 490 bp, Unknown
  Ascusbbf_1880175, encodes 16S rRNA
agagtttgatcatggctcaggatgaacgctagctacaggcttaacacatgcaagtcgaggggcagcggggtctgtgcttgcacagaccgctggcgaccggcgcacgggtgagtaacacgtatccaacctgccatgaactccgggatagccctctgaaaggaggattaataccggatgtgacctgtgggggacatcccccgtcggttaaagattcatcggttcatgatggggatgcgtctgattagcttgttggcggggtaacggcccaccaaggcaccgatcagtaggggttctgagaggaaggtcccccacataggaactgagacacggtcctaactcctacgggaggcagcagtgaggaatattggtcaatgggcgtaagcctgaaccagccaagtagcgtgagggacgacggccctacgggttgtaaacctcttttatgcgggaataacgggagtcacgtgtgactttgtgcatgtaccgcatgaat

SEQ ID NO: 3922 - DNA, 490 bp, Unknown
  Ascusbbf_261903, encodes 16S rRNA
agagtttgatcctggctcaggatgaacgctggcggcgtgcctaatgcatgcaagtcgagcgacgcatgccggaggggtaacccactggtatgacggagcggcgaacgggtgagtaacacgtgagcaacctgccccacagaccgggatagcccagggaaacctggattaataccggatatcctcgaacaacctcatggctgatcgaggaaatgcctttgtgctgtgggatgggctcgcggcttatcagctagttggtggggtaacggcctaccaaggcatcgacgagtagctggtctgagaggacgagcagccacactggaactgagacacggtccagactcctacgggaggcagcagcagggaatcttgcgcaatgggcgaaagcctgacgcagcaacgccgcgtgggggatgaaggccttcgggttgtaaacccctttcaggagggaagaaattgacggtacctccaaaagaaggaccggccaactacg

SEQ ID NO: 3923 - DNA, 490 bp, Unknown
  Ascusbbf_1487417, encodes 16S rRNA
agagtttgatcatggctcaggacgaacgctggcggcgtgcctaacacatgcaagtcgaacggacgaggagagcttgctctccgagttagtggcggacgggtgagtaacgcgtgagcaacctgcctttcagtgggggacaacggttggaaacgaccgctaataccgcataatacagcgaaggggcatcccattgctgtcaaagatttattgctgaaagatgggctcgcgtctgattagatagttggtggggtaacggcctaccaagtcgacgatcagtagccggactgagaggttgaacggccacattgggactgagatacggcccagactcctacgggaggcagcagtggggaatattgggcaatgggggaaaccctgacccagcaacgccgcgtgaaggaagaaggccttcgggttgtaaacttcttttaccagggacgaaggacgtgacggtacctggagaaaaagccacggctaactacgtaccagc

SEQ ID NO: 3924 - DNA, 490 bp, Unknown
  Ascusbbf_1812282, encodes 16S rRNA
agagtttgatcctggctcaggacgaacgctggcggcgtgcctaacacatgcaagtcgaacgaagctccaacactcgagttttcggacaagagtggcggaagacttagtggcggactggtgagtaacgcgtgagcaacctgccttccggtgggggacaacagttggaaacgactgctaataccgcataacatatatttaaggcatcttagatatatcaaagctttaagtgccggaagatgggctcgcgtctgattagatagttggtgaggtaacggctcaccaagtcgacgatcagtagccggactgagaggttgaacggccacattgggactgagatacggcccagactcctacgggaggcagcagtggggaatattgggcaatgggggaaaccctgacccagcaacgccgcgtgaaggaagaaggctttcgggttgtaaacttcttttatgagggacgataatgacggtacctcatgaataagccacgg

SEQ ID NO: 3925 - DNA, 490 bp, Unknown
  Ascusbbf_850799, encodes 16S rRNA
agagtttgatcctggctcagattgaacgctggcggcatgcctaacacatgcaagtcgaacggcagcatgacatggtttaccatgttgatggcaagtggcgaacgggtgagtaatgcgcaggaatacgccttaaagagggggacaacctggggaaactcaggctaataccgcataatatcttcggattaaagctggggaccgtaaggcctggcgctttaagagtagcctgcgtccgattagcttgttggtgaggtaaaggcttaccaaggcgacgatcggtagctggtctgagaggatgatcagccacactgggactgagacacggcccagactcctacgggaggcagcagtggggaatattggacaatgggggaaaccctgatccagcaatgccgcgtgtgtgaagaaggcctgagggttgtaaagcactttcagtggggaggaggcttcgaaggttaagagctattgaagtggacgttacccacagaag

SEQ ID NO: 3926 - DNA, 490 bp, Unknown
  Ascusbbf_1167070, encodes 16S rRNA
agagtttgatcctggctcaggatgaacgctggcggcgtgcataacacattcaagtcgaacgaagcatagggaacggagccttcgggcgaagagaactatgacttagtggcggacgggtgagtaacgcgtgagcaaccttcctgcctgtgagggataacacagggaaacttgtgctaataccgcatgacgcatgattgccgcatgacagacatgccaaagatatattgcaggcagatgggctcgcgtctgattagatagttggcagggtaacggcctaccaagtcgacgatcagtagccggactgagaggttgaacggccacattggaactgagagacggtccagactcctacgggaggcagcagtggggaatattgggcaatgggcgaaagcctgacccagcgacgccgcgtgagggaagaaggtcttcggattgtaaacctctttcagcaaggaagaagaaagtgacggtacttgcagaagaagccacg

SEQ ID NO: 3927 - DNA, 490 bp, Unknown
  Ascusbbf_1570754, encodes 16S rRNA
agagtttgatcatggctcaggatgaacgctggcggcgtgcttaacacatgcaagtcgaacgatgaagctgcctgcttgcaggtggtggattagtggcgaacgggtgagtatcacgtgagtaacctgcccttgactctgggataagcccgggaaactgggtctaataccggatatgacctctcatcgcatggtggggggtggaaagtttttaacggtcttggatgggctcgcggcctatcagcttgacggtggggtagtggcctaccgtggctttgacgggtagccggcctgagagggtgaccggccacactgggactgagacacggcccagactcctacgggaggcagcagtggggaatattgcacaatgggcgcaagcctgatgcagcgacgccgcgtgcgggatgacggccttcgggttgtaaaccgctttcagcagggaagaagggcctcttttggaggtttgacggtacttgcagaagaagcgccg

SEQ ID NO: 3928 - DNA, 472 bp, Unknown
  Ascusbbf_742533, encodes 16S rRNA
agagtttgatcctggctcagaacgaacgctggcggcaggcctaacacatgcaagtcgaacggttgtagcaatacagccgtggcgcacgggtgagtaacgcgtgggaacgtgcccttgggtatggaataacagcgggaaactgctgacaataccatatgatgtcttcggaccaaagatttatcgcccagggatcggcccgcgtcagattagctagttggtggggtaatggcctaccaaggctccgatctgtagctgttctgagaggaagaccagccacactgaaactgagacacggttcagactcctacgggaggcagcagtggggaatattggacaatgggggaaaccctgatccagccatgccgcgtgagtgatgaaggccttagggttgtaaagctcttttaccagggaagatgatgacggtacctggagaataagcaccggctaacttcgtgccagcagccgcggtaat

SEQ ID NO: 3929 - DNA, 490 bp, Unknown
  Ascusbbf_1043060, encodes 16S rRNA
agagtttgatcctggctcaggacgaacgctggcggcgtgcctaacacatgcaagtcgaacggaactctttggaacaaggcttcggccgagggaatttgagtttagtggcggacgggtgagtaacgcgtgagcaacctgcccttcggagggggacaacagttggaaacgactgctaataccgcatgacatacattggttgcatgatcgatgtatcaaagattttatcgccgagggatgggctcgcgtctgattagctagttggtagggtaacggcttaccaaggcgacgatcagtagccggactgagaggttgaacggccacattgggactgagatacggcccagactcctacgggaggcagcagtggggaatattgggcaatgggggcaaccctgacccagcaacgccgcgtgaaggaagaaggctttcgggttgtaaacttcttttatcagggacgataacgacggtacctgatgaataagccacggct

SEQ ID NO: 3930 - DNA, 490 bp, Unknown
  Ascusbbf_1883069, encodes 16S rRNA
agagtttgatcatggctcaggatgaacgctggcggcgtgcctaacacatgcaagtcgaacgaagcatattggaatgagacttcggtcaaaggaaggtatgacttagtggcggacgggtgagtaacgcgtgagcaacctgcctcagagtgggggacaacagctggaaacggctgctaataccgcatgacattacttgaaggcatcttcgggtaatcaaagctctatgtgctctgagatgggctcgcgtctgattagctagatggtgaggtaacggctcaccatggcgacgatcagtagccggactgagaggttgaacggccacattgggactgagatacggcccagactcctacgggaggcagcagtggggaatattggtcaatgggggaaaccctgaaccagcaacgccgcgtgaaggaagaaggctttcgggttgtaaacttcttttatctgagacgatagtgacggtatcagatgaataagctacggc

SEQ ID NO: 3931 - DNA, 490 bp, Unknown
  Ascusbbf_1109244, encodes 16S rRNA
agagtttgatcatggctcgggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttagagattcgcatgtttctctaacgaaagcttcggtggttacggatgggcatgcgtgacattagctagttggtaaggtaacggcttaccaaggcgacgatgtctaggggagctgagaggcttatcccccacactggtactgagacacggcccagactcctacgggagacagcagttaggaatattcgtcaatgggggaaaccctgaacgagcaatgccgcgtgaaggatgacggtcctatggattgtaaacttcagttgttagggaagaacgactagtataggaaatgatactagagtgacggtacctttcaa

SEQ ID NO: 3932 - DNA, 490 bp, Unknown
  Ascusbbf_1000424, encodes 16S rRNA
agagtttgatcatggctcaggacgaacgctggcggcgtgcttaacacatgcaagtcgaacgagggatacggaagagcttgctcggaagtatcccgagtggcggacgggtgagtaacgcgtgaacaatctgtctcggacagggggataacgcaccgaaaggcgtgctaataccgcataagaccacgagggggcatccccatgaggtcaaaggagcgatccggtccgaggtgagttcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgcaagcctgacccagcaacgccgcgtgagggaagaaggttttcggattgtaaacctctgtcctacatgaagaggagaagacggtagtgtaggaggaagccccggctaacta

SEQ ID NO: 3933 - DNA, 490 bp, Unknown
  Ascusbbf_1797758, encodes 16S rRNA
agagtttgatcctggctcaggacgaacgctggcggcgtgcttaacacatgcaagtcgaacggggtcataaggaagcttgcttttttgtgacttagtggcggacgggtgagtaacgcgtgaggaacctgtcttcatcagggggataacgttccgaaagggatgctaataccgcataagaccacatgatcgcatgatcgaggggtcaaaggaggaatccggatgaaggtggcctcgcgtcccattaggcagttggcggggtaacagcccaccaaaccgacgatgggtagccgacctgagagggtgatcggccacattggaactgagagacggtccaaactcctacgggaggcagcagtggggaatattgggcaatgggcgaaagcctgacccagcaacgccgcgtgagggaagaaggttttcggattgtaaacctctgtccttcaagacgaggagaagacggtattgaaggaggaagccccggctaactacg

SEQ ID NO: 3934 - DNA, 490 bp, Unknown
  Ascusbbf_1043134, encodes 16S rRNA
agagtttgatcctggctcaggataaacgctggcggcgcacataagacatgcaagtcgaacggaagtcgttgtaatgatatcgacatggacggagaacttgttcaaagaaagtgaaaattgacttacaacaatggctttagtggcggactggtgagtaacacgtaagcaacctgcctatcagaggggaacaacagttagaaatgactgctaataccgcatatgcctaagtatcacatgatacaatagggaaaggagcaatccgctgatagatgggcttgcgtctgattagatagttggtggggtagcggcctaccaagtcgacgagcagtagccggaccgagaggttgaacggccatattgggactgagacacggcccaaactcctacgggaggcagcagtggggaatattgcacaatgggcgaaagcctgatgcagcgacgccgcgtgagcgaagaagtatttcggtatgtaaagctctatcagcaggga

SEQ ID NO: 3935 - DNA, 490 bp, Unknown
  Ascusbbf_727258, encodes 16S rRNA
agagtttgatcatggctcaggatgaacgctggcggcgcgcctaacacatgcaagtcgaacggtgaagtcccttcgggggcggatcagtggcggacgggtgagtaacgcgtgagtaacctgcccttacgagcggaataacgtccggaaacagacgctaataccgcatgacacgtgcttccggcatcggaggcacgtcaaagatttatcgcgtaaggatggactcgcgtcccattagatagttggcggggcaacggcccaccaagtcagcgatgggtagccggactgagaggttgaacggccacattggaactgagagacggtccagactcctacgggaggcagcagtggggaatattgggcaatgggcgaaagcctgacccagcgacgccgcgtgagcgaagaaggtcttcggattgtaaagctctgttgacagggacgaaaaaatgacggtacctgtcgaggaagccacggctaactacgtgccagcagc

SEQ ID NO: 3936 - DNA, 490 bp, Unknown
  Ascusbbf_310914, encodes 16S rRNA
agagtttgatcctggctcaggataaacgctagcggcaggcctaacacatgcaagtcgagcggcagcggggtgtagcaatacattgccggcgagcggcggacgggtgagtaacgcgtatgcaacctgcccaccactcggagatagccgaccgaaaggacgattaaactccgatggcatcatagagcggcatcgctttatgattaaatatttataggtggtggatgggcatgcgtggcattagttagttggcggggcaacggcccaccaagacagtgatgcctatgggttctaaaaggaagatcccacacatcggtactgagacacggaccgaactcctacgggaggcagcagtgaggaatattggacaatgggggcaaccctgatccagccaaaccgcgtgggggaaggaggtcgttaagatcgtaaaccccttttatatgggagcaatccatcctatgtataggatgttgagagtaccatttgaataagc

SEQ ID NO: 3937 - DNA, 490 bp, Unknown
  Ascusbbf_1736022, encodes 16S rRNA
agagtttgatcctggctcaggatgaacgctggcggcgtgcctaacacatgcaagtcgaacggaacttcttacgagcaagacttcggtcaagcaagttttaagtttagtggcggacgggtgagtaacgcgtgagcaacctgcctttcagagggggataacgtttggaaacgaacgctaataccgcataacgtagcagtaccgcatgatacagctaccaaagattttatcgctgagagatgggctcgcgtccgattaggtagttggtgaggtaacggcccaccaagccgacgatcggtagccggactgagaggttgaacggccacattgggactgagacacggcccagactcctacgggaggcagcagtggggaatattgcacaatgggcgcaagcctgatgcagcaacgccgcgtgagggaagacggttttcggattgtaaacctctgtctttggtgacgaagaagtgacggtagccaaggaggaagccac

SEQ ID NO: 3938 - DNA, 490 bp, Unknown
  Ascusbbf_1834369, encodes 16S rRNA
agagtttgatcatggctcaggatgaacgctggcggcgtgcctaacacatgcaagtcgagcgggaagccataaagcagagattcgtcgaagcgatatggtggatagcggcggacgggtgagtaacgcgtaggtaacctacccttatctgcgggatagcctagggaaacctggattaataccgcataatatgacggattcacatgaatttgtcgtcaaagatttatcggataaggatggacctgcgtctgattaggtagttggtgaggtaacggctcaccaagcctacgatcagtagccgacctgagagggtaatcggccacattggaactgagacacggtccaaactcctacgggaggcagcagtggggaatattgcacaatgggggaaaccctgatgcagcaacgccgcgtgaacgatgaaggtcttcggattgtaaagttctgtccttagggaagaagaaagtgacggtacctgaggaggaagccccgg

SEQ ID NO: 3939 - DNA, 490 bp, Unknown
  Ascusbbf_1456746, encodes 16S rRNA
agagtttgatcatggctcaggataaacgctagcggcaggcctaacacatgcaagtcgagcggcagcgcggagtggcaacactttggcggcgagcggcggacgggtgagtaacgcgtatgcaacctgcccaccacacggggatagccgaccgaaaggacgattaacccccgatggcatcatggtcccgcatgggatcatgattaaatattcataggtggtggatgggcatgcgtggcattagttagttggcggggcaacggcccaccaagacgatgatgcctatgggttctaaaaggaagatcccacacatcggtactgagacacggaccgaactcctacgggaggcagcagtgaggaatattggacaatgggggcaaccctgatccagccaaaccgcgtgagggaaggaggtcgttaagatcgtaaacctcttttatatgggaataatcgcccccacgtgctgggggtttgaatgtaccatttgaataag

SEQ ID NO: 3940 - DNA, 490 bp, Unknown
  Ascusbbf_737306, encodes 16S rRNA
agagtttgatcctggctcaggatgaacgctggcggcgtgcataacacattcaagtcgaacggtgaagcgccttcgggtgcggatcagtggcggacgggtgagtaacgcgtgagcaacctgccgtataatgggggataacacagggaaacttgtgctaataccgcatgacacacggagatcgcatggtatctgtgtcaaagatttattgctgtacgatgggctcgcgtatgattagacagttggcagggtaacggcctaccaaatcaacgatcattagccgaactgagaggttgaacggccacattggaactgagaaacggtccagactcctacgggaggcagcagtggggaatattgggcaatgggcgaaagcctgacccagcgacgccgcgtgagggaagaaggtcttcggattgtaaacctctttcagcagggaagaatcgatgacggtacctgactaagaagccccggctaactacgtgccagcagc

SEQ ID NO: 3941 - DNA, 487 bp, Unknown
  Ascusbbf_1553433, encodes 16S rRNA
agagtttgatcctggctcagaacgaacgctggcgacatgttttaggcatgcaagtcgaacggaatttatttttagtggcgaaagggtgagtaacacgtgagtaatctgcccctgagttcggaataacagttagaaatgactgctaataccggatgtggctataggaacgcatgtttttatggctaaagatttatcattcagagatgagctcgcgccccattagctagttggtgaggtaacggcccaccaaggcaacgatgggtagctggtctgagaggatggtcagccacactgggactgagacactgcccagactcctacgggaggctgcagtcgagaatcttgggcaatgcacgaaagtgtgacccagcaatgtcgcgtgcgggatgaatgttttaggatagtaaaccgctgtcactcgggacgaatcattgacggtactgagagaggaagccacggctaactacgtgccagcagccgcggtaat

SEQ ID NO: 3942 - DNA, 490 bp, Unknown
  Ascusbbf_717349, encodes 16S rRNA
agagtttgatcatggctcaggatgaacgctggcggcgtgcttaacacatgcaagtcgaacggagttgccttttcagatttcttcggattgacgagttggtatacttagtggcggacgggtgagtaacgcgtgagcaacctgccttttagtggggaataacggctggaaacggtcgctaataccgcataatatgtatttatcgcatgttagatacattaaagatttatcgctagaagatgggctcgcgtccgattagctagttggtgagataacagctcaccaaggcgacgatcggtagccggactgagaggttgaacggccacattgggactgagacacggcccagactcctacgggaggcagcagtggggaatattgcacaatgggcgcaagcctgatgcagcaacgccgcgtgaaggaagacggtcttcggattgtaaacttttgtccttagcaacgaaacaaatgacggtagctttggaggaagcca

SEQ ID NO: 3943 - DNA, 490 bp, Unknown
  Ascusbbf_1469993, encodes 16S rRNA
agagtttgatcatggctcaggacgaacgctggcggcgtgcctaatacatgcaagtcgagcgggcccttcggggccagcggcggacgggtgagtaacacgtaggcaacctgcccgaaagaccgggataactggcggaaacgtcagctaataccggataggaggaagcaaggcatcttgctttctggaaaggcggagcttttctgtcactttcggatgggcctgcggcgcattagctagtaggcggggtaacggcccacctaggcgacgatgcgtagccgacctgagaaggtgatcggccacactgggactgagacacggcccagactcctacgggaggcagcagtagggaatcttccgcaatgggcgaaagcctgacggagcatcgccgcgtgagtgaagaaggtcttcggatcgtaaagctctgttgccggagaagaacggcctggagagtgactgctccaggagtgacggtatccgagaagaaagcccc

SEQ ID NO: 3944 - DNA, 490 bp, Unknown
  Ascusbbf_436848, encodes 16S rRNA
agagtttgatcatggctcaggataaacgctggcggcgtgcctaatgcatgcaagtcgcacgggagcccttcggggtcgaccgtggcggacgggtgaggaacgcgtggctaacctgcccaaccgagggggataaccccgggaaaccggggctaataccgcatacgctcagtggaggggacttcattgaggaaagggagcaatcccgcggatggagggggctgcggccgattagctagttggtggggtaagagcctaccaaggcggtgatcggtagctggtctgagaggacgatcagccacacggggactgagacacggccccgactcctacgggaggcagcagcaaggaattttccacaatgggcgcaagcctgatggagcaacgtcgcgtgggggatgacgcgtttcggcgtgtaaaccccttttcgagaggacgaaggcaatgacggtactctcggaataaggaccggctaactacgtgccagcagccg

SEQ ID NO: 3945 - DNA, 488 bp, Unknown
  Ascusbbf_1805340, encodes 16S rRNA
agagtttgatcatggctcaggactaacgctggcggcgtgcctaacacatgcaagtcgaacgaagcagcaatgcttagtggcagacgggtgagtaacgcgtagataatgtgccctcttgcgggggataccgtttcgaaaggaacgttaataccgcataaagtccttaggaggcatctccctaggaccaaacttccggggcgggaggagcaatctgcgtactatcagctagttggtgaggtaatggctcaccaaggctacgacggttaactggtctgagaggatgatcagtcacactggaactgagacacggtccagactcctacgggaggcagcagtgaggaatattgcgcaatgggcgaaagcctgacgcagcgacgccgcgtggaggatgacggatttcggtctgtaaactcctgtcagtagggaagagaatggacggtacctactgaggaagcttcggctaactacgtgccagcagccgcggtaat

SEQ ID NO: 3946 - DNA, 490 bp, Unknown
  Ascusbbf_1401288, encodes 16S rRNA
agagtttgatcatggctcaggatgaacgctggcggcgtgcttaacacatgcaagtcgaacgaagcataagagttgctcgcaacacttatgacttagtggcagacgggtgagtaacgcgtgggtaacctaccctgtacagggggttaacagttagaaatgactgctaataccgcataagcacacactgtcacatgacagagggtgaaaagatttatcggtacaggatgggcccgcgtctgattagctagttggtgaggtaaaggcttaccaaggcgacgatcagtagccggcttgagagagtgaacggccacattggaactgagacacggtccaaactcctacgggaggcagcagtggggaatattgcacaatgggggaaaccctgatgcagcgacgccgcgtgaaggatgaagtatttcggtatgtaaacttctatcagcagggaagataatgacggtacctgactaagaagccccggctaactacgtgc

SEQ ID NO: 3947 - DNA, 490 bp, Unknown
  Ascusbbf_967195, encodes 16S rRNA
agagtttgatcatggctcaggatgaacgctggcggcgtgcctaacacatgcaagtcgagcgagaagctcacgagttgatacttcggttgaaacatgtgagtggaaagcggcggacgggtgagtaacgcgtaggcaacctgcccttagcagagggatagcctcgggaaaccgggattaaaacctcataatacggagagaagacatcttcatttcgtcaaagatttatcggctaaggatgggcctgcgtctgattagttagttggtggggtaacggcctaccaaggcaacgatcagtagccgacctgagagggtgataggccacattggaactgagacacggtccaaactcctacgggaggcagcagtggggaatattgcacaatgggggaaaccctgatgcagcaacgccgcgtgaaggatgaaggcccttgggtcgtaaacttctgttctaagggaagataatgacggtaccttaggagcaagtcccggc

SEQ ID NO: 3948 - DNA, 490 bp, Unknown
  Ascusbbf_1463735, encodes 16S rRNA
agagttgatcatggctcaggatgaacgctggcggcgtgcttaacacatgcaagtcgaacggaactcagaggaagagagacttcggtcaaacggagactgagtttagtggcggacgggtgagtaacgcgtgagcaacctgcctttcagagggggataacgtttggaaacgaacgctaataccgcataatacagagagttcgcatggacactctgtcaaagatttaatcgctgaaagatgggctcgcgtccgattaggcagttggtgaggtaacggctcaccaaaccgacgatcggtagccggactgagaggttgaacggccacattgggactgagacacggcccagactcctacgggaggcagcagtggggaatattgcacaatggggggaaccctgatgcagcaacgccgcgtgaaggaagacggttttcggattgtaaacttctgttcttagtgacgaagaagtgacggtagctaaggagcaagccacg

SEQ ID NO: 3949 - DNA, 490 bp, Unknown
  Ascusbbf_1600727, encodes 16S rRNA
agagtttgatcctggctcaggatgaacgctggcggcgtgcttaacacatgcaagtcgaacgaagatatatcagcagaggccttcgggcggaagcagatatattcttagtggcggacgggtgagtaacgcgtggagaacctgccgtatgcagggggacaacacctggaaacgggtgctaataccgcataagcgcacatgatagcattatcaagtgtgaaaagctttagcggcatacgatggctccgcgtctgattagccagttggcggggtaacggcccaccaaagcgacgatcagtagccggcctgagagggtgaacggccacattgggactgagacacggcccagactcctacgggaggcagcagtgggggatattgcacaatgggggaaaccctgatgcagcgacgccgcgtgagtgaagaagtatttcggtatgtaaagctctatcagcagggaagaagatgacggtacctgcacaagaagtcccgg

SEQ ID NO: 3950 - DNA, 490 bp, Unknown
  Ascusbbf_1867349, encodes 16S rRNA
agagtttgatcatggctcaggacgaacgctggcggcgtgcttaacacatgcaagtcgaacgagggtatgggaagagcttgctcagaacatacccgagtggcggacgggtgagtaacgcgtgaggaacctgtcttacacagggggataacgccccgaaaggggtgctaataccgcataagaccacagcaccgcatggtggaggggtcaaaggagcaatccggtgtaaggtggcctcgcgtcccattaggcagttggcgaggtaacggctcaccaaaccgacgatgggtagccgacctgagagggtgatcggccacattggaactgagagacggtccaaactcctacgggaggcagcagtggggaatattgggcaatgggcgcaagcctgacccagcaacgccgcgtgagggaagaaggttttcggattgtaaacctctgtcctcaatgaaaaggagaagatggtaattgaggaggaagccccggctaacta

SEQ ID NO: 3951 - DNA, 490 bp, Unknown
  Ascusbbf_762914, encodes 16S rRNA
agagtttgatcatggctcaggacgaacgctggcggcatgcctaacacatgcaagtcgaacggagtaagagagaagcttgcttagctcttacttagtggcggacgggtgagtaacgcgtgagtaacctgcctttcagagggggataacgttctgaaaagaacgctaataccgcatgatatattggggtcgcatggccttgatatcaaaggagcaatccgctgaaagatggactcgcgtccgattagccagttggcggggtaaaggcccaccaaagcgacgatcggtagccgggttgagagactgaacggccacattgggactgagacacggcccagactcctacgggaggcagcagtgggggatattgcacaatggaggaaactctgatgcagcaatgccgcgtgagggaagacggtcttcggattgtaaacctctgtccttggtgaagataatgacggtagccaaggaggaagctccggctaactccgtg

SEQ ID NO: 3952 - DNA, 490 bp, Unknown
  Ascusbbf_1542721, encodes 16S rRNA
agagtttgatcctggctcaggatgaacgctggcggcgtgcttaacacatgcaagtcgaacgattaaagcaccttcgggtgtgtatagagtggcgaacgggtgagtaacacgtgggtaacctaccttttacactgggatagctcagggaaacttgaattaataccagatactccttttctgacgcatgtcagattcgggaaagcttttgcggtaaaagatggacccgcggcccattagttagttggtgaggtaatggctcaccaagacagcgatgggtagccgagctgagaggctgatcggccacattgggactgagacacggcccaaactcctacgggaggcagcagtggggaattttgcgcaatgggcgaaagcctgacgcagcaacgccgcgtggatgatgaaggccttcgggttgtaaagtcctttcaatagtgatgaaaatgacagtagctatagaagaagccccggctaaatacgtgccagcagc

SEQ ID NO: 3953 - DNA, 490 bp, Unknown
  Ascusbbf_1232461, encodes 16S rRNA
agagtttgatcatggctcaggacgaacgctggcggcgtgcctaacacatgcaagtcgaacgggaatctttgaaatgaagcttcggcagattttcaaagaggatagtggcggacgggtgagtaacgcgtgagtaacccgccgagaagagggggacaacacatcgaaaggtgtgctaataccgcatattgaatatttatcgcatgatagatatttgaaagatttatcgcttcttgatggactcgcgtctgattagatagttggtggggtaacggcccaccaagtcgacgatcagtagccggactgagaggttgaacggccacattgggactgagacacggcccagactcctacgggaggcagcagtggggaatattgcgcaatgggggcaaccctgacgcagcaacgccgcgtgaaggaagaaggtcttcggattgtaaacttttgtctttggtgaagataatgacggtagccaaggaggaagccacggcta

SEQ ID NO: 3954 - DNA, 490 bp, Unknown
  Ascusbbf_1357923, encodes 16S rRNA
agagtttgatcctggctcaggacgaacgctggcggcgtgcctaatacatgcaagtcgagcggagcttagccttcctttggaaggctctggcttagcggcggacgggtgagtaacacgtaggcaacctgcccgtaagaccgggataacttgcggaaacgtgagctaataccggatagataggaagagcgcatgctcttcttaggaaagacggagcaatctgtcacttacggatgggcctgcggcgcattagctagttggtggggtaaaggcctaccaaggcgacgatgcgtagccgacctgagagggtgaccggccacactgggactgagacacggcccagactcctacgggaggcagcagtagggaatcttcggcaatggacggaagtctgaccgagcaacgccgcgtgagtgaagaaggttttcggatcgtaaaactctgttgccagagaagaaagctaaggagagtcactgctctttggttgacggta

SEQ ID NO: 3955 - DNA, 312 bp, Unknown
  Ascusbbf_1482722, encodes 16S rRNA
agagtttgatcatggctcaggatgaacgctggcggcgtgcctaacacatgcaagtcgaacgaagcatacggaccggagattcgtcgaaggaccgcatgacttagtggcggacgggtgagtaatgtatgagcaacctgcctttcagaggaggcagcagtggggaatattgggcaatgggcgaaagtctgacccagcaacgccgcgtgaaggaagaaggtcttcggattgtaaacttcttttatgagggacgaaggacgtgacggtacctcatgaataagccacggctaactacgtgccagcagccgcggtaat

SEQ ID NO: 3956 - DNA, 485 bp, Unknown
  Ascusbbf_1363276, encodes 16S rRNA
agagtttgatcctggctcagaatgaacgctggcggcaggcctaacacatgcaagtcgaacgggatcttcggatctagtggcggacgggtgagtaacgcgtgggaatatgccctttggtacggaatagcctcgggaaactgagagtaataccgtatgtgtcctttgattgtggtgatcgaaggagaaagatttatcgccaaaggattagcccgcgttggattagatagttggtggggtaatggcctaccaagtctacgatccatagctggtttgagaggatgatcagccacactgggactgagacacggcccagactcctacgggaggcagcagtggggaatcttagacaatgggggaaaccctgatctagccatgccgcgtgatcgatgaaggccttagggttgtaaagatctttcagttgggaagataatgacggtaccaacagaagaagccccggctaactccgtgccagcagccgcggtaat

SEQ ID NO: 3957 - DNA, 490 bp, Unknown
  Ascusbbf_1668055, encodes 16S rRNA
agagtttgatcatggctcaggatgaacgctggcggcgtgcctaacacatgcaagtcgagcgggaatctctaaagcagcttgctgcggaagagaggatagcggcggacgggtgagtaacgcgtaggtaagctgccccttgcagaaggatagcctcgggaaactgggattaatacttcataacacggctggtccgcatgaaccggccgtcaaagatttatcggcaagggatgcacctgcgtctgattagatagttggtagggtaacggcctaccaagtcaacgatcagtagccgacctgagagggtaatcggccacattggaactgagacacggtccaaactcctacgggaggcagcagtggggaatattgcacaatgggggaaaccctgatgcagcaacgccgcgtgagtgaagaaggtcttcggattgtaaagctctgttcttgggaaagaaagaatgacggtacccaaggagaaagccccggctaacta

SEQ ID NO: 3958 - DNA, 490 bp, Unknown
  Ascusbbf_390307, encodes 16S rRNA
agagtttgatcatggctcaggatgaacgctggcggcgcgcataacacatgcaagtcgaacggagccacattgaaacctagtgatgtgtgacttagtggcggacgggtgagtaacgcgtgggtaacctacctggtattgggggacaacagttagaaatgactgctaataccgcatacgtcatccggaaggcatcttccggatgggaaaggatttatccgatatcagatggacccgcgtctgattagctggttggcggggtaacggcccaccaaggcgacgatcagtagccgaactgagaggttgaccggccacattgggactgagacacggcccaaactcctacgggaggcagcagtggggaatattgcacaatggggggaaccctgatgcagcgacgccgcgtgagtgatgaagtatttcggtatgtaaagctctatcgatggggaagaaaatgacggtacccaagtaagaagccccggctaactacgtg

SEQ ID NO: 3959 - DNA, 483 bp, Unknown
  Ascusbbf_906641, encodes 16S rRNA
agagtttgatcctggctcagaacgaacgctggcggcaggcttaacacatgcaagtcgaacgctccgcaaggagagtggcagacgggtgagtaacgcgtgggaacgtaccctttactacggaacagctccgggaaactggaattaataccgtatgtgcccccctttggtggacattgggggggaaagatttatcggtaaaggatcggcccgcgttggattagctagttggtggggtaaaggccaaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggtgaagataatgacggtaaccggagaagaagccccggctaacttcgtgccagcagccgcggtaat

SEQ ID NO: 3960 - DNA, 490 bp, Unknown
  Ascusbbf_1862300, encodes 16S rRNA
agagtttgatcatggctcaggatgaacgctggcggcgtgcctaacacattcaagtccaacggagaagggagcttcggctcccggatcagtggcggacgggtgagtaacgcgtgagcaacctgccttcgtgtggggaataacacagggaaacttgtgctaataccgcataatgcaaagacgcagcattgagtttttgccgaagatttatcgcacgaagatgggctcgcgtctgattagatagttggtgaggtaacggctcaccaagtcgacgatcagtagccggactgagaggttgaacggccacattggaactgagagacggtccagactcctacgggaggcagcagtggggaatattgggcaatgggcgaaagcctgacccagcgacgccgcgtgaaggaagaaggccttcgggttgtaaacttcagtcaacagggaagaagaaagtgacggtacctgtggaggaagccacggctaactacgtgccagc

SEQ ID NO: 3961 - DNA, 490 bp, Unknown
  Ascusbbf_871589, encodes 16S rRNA
agagtttgatcatggctcaggatgaacgctggcggcatgcctaacacatgcaagtcgaacggagtgcttgtagaagccttttcggaagtggaaataagttacttagtggcggacgggtgagtaacgcgtgggcaacctgccctgtacagggggatacctaccggaaacggtagctaataccccataagcgcacgatatcgcatgataaagtgtgaaaagccataacggtacaggatgggcccgcgtccgattagccagttggcggggtaacggcccaccaaagcgacgatcggtagccggcttgagagagtgaacggccacattgggactgagacacggcccagactcctacgggaggcagcagtggggaatattgcacaatgggggaaaccctgatgcagcaatgccgcgtgaaggaagaagtatttcggtatgtaaacttctatcagcagggaagaaaatgacggtacctgactaagaagccccggct

SEQ ID NO: 3962 - DNA, 488 bp, Unknown
  Ascusbbf_729786, encodes 16S rRNA
agagtttgatcctggctcagaacgaacgctggcggcatggattaggcatgcaagtcgaacggtgtagcaatacacagtggcggaagggtgaggaacacgtgaataatctgccctcaagttgggaataactttccgaaaggaaagctaataccgaatgtggttgttttatcgcatgataggacaactaaagatttatcgcttgaggatgagttcgcgtcccattagctagttggcggggtaacggcccaccaaggcagagatgggtagctggtctgagaggatgatcagccacactgggactgagacactgcccagactcctacgggaggctgcagtcgagaatcttttgcaatgcgcgaaagcgtgacaaagcaatgccgcgtgccggatgaaggtcttcggattgtaaacggctgtcactcgggacgaaaaatgacggtaccgagggaggaagccacggctaactacgtgccagcagccgcggtaat

SEQ ID NO: 3963 - DNA, 490 bp, Unknown
  Ascusbbf_1295997, encodes 16S rRNA
agagtttgatcctggctcaggatgaacgctagcggcaggcttaacacatgcaagtcgaggggcagcgcggagtagcaatactctggcggcgaccggcggaagggtgcgtaacgcgtgagcaacctgcccgtaaccgggacataaccgatggaaacgtcgcctaatttcccataataacggaagtggcatcacttcagtttgaaagcttcggtggttacggatgggctcgcgtgacattagctggttggtagggtaacggcctaccaaggcgacgatgtctaggggttctgagaggaaggtcccccacactggaactgagacacggtccagactcctacgggaggcagcagtgaggaatattggtcaatgggcggaagcctgaaccagccatgccgcgtgcaggaataaggccctatgggtcgtaaactgcttttgtgcgggagcaataagttgcacgtgtgcaatgatgagagtaccatgagaataagca

SEQ ID NO: 3964 - DNA, 490 bp, Unknown
  Ascusbbf_662842, encodes 16S rRNA
agagtttgatcatggctcaggatgaacgctggcggcgtgcctaatacatgcaagtcgagcgagaagtttctgattgacgcttcggttgatttcagaaatggaaagcggcggacgggtgagtaacgcgtaggcaacctgccccagacagagggatagcctcgggaaaccgggattaagacctcataatgcatcgagatcacatgttcacgatgccaaagatttatcggtctgggatgggcctgcgtctgattagttagttggtgaggtaacggcccaccaagacagcgatcagtagccgacctgagagggtgatcggccacattggaactgagacacggtccagactcctacgggaggcagcagtagggaatattgcacaatgggggaaaccctgatgcagcaacgccgcgtgaaggatgaaggcccttgggtcgtaaacctctgtccttggggaagaagaaagtgacggtacccttggaggaagccccgg

SEQ ID NO: 3965 - DNA, 179 bp, Unknown
  Ascusbbf_579330, encodes 16S rRNA
agagtttgatcatggctcagagagtttgatcatggccagcagccgcggtaataccagcagccgcggtaatgccagcagccgcggtaatgccagcagccgcggtaatgccagcagccgcggtaatgccagcagccgcggtaatagagtttgatcctggctcagccagcagccgcggtaat

SEQ ID NO: 3966 - DNA, 474 bp, Unknown
  Ascusbbf_541640, encodes 16S rRNA
agagtttgatcatggctcagagcgaacgctggcggcatgcttaacacatgcaagtcgcgcgggtggtttcggccatcagcggcggacgggtgagtaacgcgtaggaatgtatcctgaggtgggggacaaccctgggaaactggggctaataccgcatgggagctgaggctcaaagccgtgaggcgccttgggagcagcctgcgtccgattaggtagttggtggggtaaaggcctaccaagcctgcgatcggtagctggtctgagaggacgatcagccacactgggactgagacacggcccagactcctacgggaggcagcagtggggaatattggacaatgggcgcaagcctgatccagcaatgccgcgtgggtgaagaaggtcttcggattgtaaagccctttcggcggggacgatgatgacggtacccgcagaagaagccccggctaacttcgtgccagcagccgcggtaat

SEQ ID NO: 3967 - DNA, 490 bp, Unknown
  Ascusbbf_1554007, encodes 16S rRNA
agagtttgatcatggctcaggacgaacgctggcggcgtgcttaacacatgcaagtcgaacggagttaaggagcttgcttcttaacttagtggcgaacgggtgagtaacgcgtgaggaacctgcctctcagtgggggacaacagttggaaacgactgctaataccgcatgacactatagtaccgcatggtacattagtcaaagatttattgctgagagatggcctcgcgtctgattagctagttggtggggtaacggcccaccaaggcgacgatcagtagccggactgagaggttgaccggccacattgggactgagatacggcccagactcctacgggaggcagcagtggggaatattgggcaatgggcgaaagcctgacccagcaacgccgcgtgaaggaagaaggccttcgggttgtaaacttcttttaccagggacgaacacaatgacggtacctggagaaaaagcaacggctaactacgtgccagc

SEQ ID NO: 3968 - DNA, 490 bp, Unknown
  Ascusbbf_959660, encodes 16S rRNA
agagtttgatcctggctcaggacgaacgctggcggcacgcctaatgcatgcaagtcgaacgacgcaccctggaggagtaatcccccggggtgacggagtggcgaacgggtgcgtaacacgtgagcaacctgccccgaagatcggaatagcccaaggaaacttggattaataccgaataccctcatccttccgcatggtcggatgaggaaaggcctttgcgcttcgggatgggctcgcggcctatcagcttgttggtgaggtaacggctcaccaaggcaacgacgggtagctggtctgagaggacgatcagccacactgggactgagacacggcccagactcctacgggaggcagcagcagggaatcttgcgcaatggacgaaagtctgacgcagcgatgccgcgtggaggatgacggccctcgggttgtaaactcctttcaggagggacgaaattgacggtacctccagaagaagccccggctaactacg

SEQ ID NO: 3969 - DNA, 490 bp, Unknown
  Ascusbbf_656800, encodes 16S rRNA
agagtttgatcctggctcagattgaacgctggcggcaggcctaatacatgcaagtcgaacggtaacatggaagtagcaatacttttgatgacgagtggcggacgggtgagtaaaatttgggaatctacctatcagagggggatagcaactggaaacggttgataagaccgcgtacgctctgaggaggaaagtaatgggatcgaaagaccattagctgatagatgagcccaaacgggattagctagtaggcggggtaatagcccacctaggcgacgatctctagctggttttagcggatgatcagccacattggaactgagacacggtccaaactcctacgggaggcagcagtagggaatattgcacaatggagggaactctgatgcagccatgccgcgtgtgtgaagaaggccttcgggttgtaaagctctgttgttgaagaagaacgtgcgtgagagtaactgttcacgcagtgacggtattcaaccag

SEQ ID NO: 3970 - DNA, 490 bp, Unknown
  Ascusbbf_829426, encodes 16S rRNA
agagtttgatcatggctcaggacgaacgctggcggcatgcctaatacatgcaagtcgagcgaacatactttggagcttgctccaaagtattgttagcggcggatgggtgagtaacacgtgggcaacctgccctgtagatggggataactccgggaaaccggggctaataccgaataattagtttgtccgcatggacgaactctaaaagacggctcacgctgtcactgcaggatgggcccgcggcgcattagctagttggtggggtaatggcctaccaaggcgacgatgcgtagccgacctgagagggtgatcggccacactgggactgagacacggcccagactcctacgggaggcagcagtagggaatcttccacaatggacggaagtctgatggagcaatgccgcgtgaacgaagaaggttttcggatcgtaaagttctgttgtgagggaagaacaagtacgagagtaactgctcgtaccttgacggt

SEQ ID NO: 3971 - DNA, 470 bp, Unknown
  Ascusbbf_1063212, encodes 16S rRNA
agagtttgatcatggctcagagtgaacgctggcggcatgcttaacacatgcaagtcgcacggatgcttcggcattagtggcggacgggtgagtaacgcgtaggaacgtatccacgggtgggggataacgctgggaaactggcgctaataccgcatgatgcctgagggccaaagctttagcgcctgtggagcggcctgcgtacgattagcttgttggtggggtaatggcctaccaaggctacgatcgttagctggtctgagaggacgatcagccacactgggactgagacacggcccagactcctacgggaggcagcagtggggaatattggacaatgggcgcaagcctgatccagcaatgccgcgtgtgtgaagaaggtcttcggattgtaaagcactttcgacagggacgatgatgacggtacctgtagaagaagccccggctaacttcgtaccagcagccgcggtaat

SEQ ID NO: 3972 - DNA, 490 bp, Unknown
  Ascusbbf_1819413, encodes 16S rRNA
agagtttgatcatggctcaggatgaacgctggcggcgtgcttaacacatgcaggtcgaacgaagctcctgaagctttctttcgggaacgcggaaggatgacttagtggcggacgggtgagtaacgcgtgggtaacctgcccctgggagggggacaacagctggaaacggctgctaataccgcatgatccgggagtgccgcatggctcttccgggaaagcgaaacgcccagggatgggcccgcgtctgattagccggttggcggggtaacggcccaccaaagcgatgatcagtagccggactgagaggttggacggccacattgggactgagacacggcccaaactcctacgggaggcagcagtggggaatattgcacaatggagggaactctgatgcagcgacgccgcgtgagtgaagaagtgtttcggcatgtaaagctctatcagcagggaagaagatgacggtacctgactaagaagccccggctaa

SEQ ID NO: 3973 - DNA, 490 bp, Unknown
  Ascusbbf_1625810, encodes 16S rRNA
agagtttgatcctggctcaggatgaacgctagcggcaggcctaacacatgcaagtcgaggggcagcggggacttcggtccgccggcgaccggcgcacgggtgagcaacgcgtatagaacctaccctgtacagggggatagcccagagaaatttggatcaataccccgtggtacgtgggcccggcatcgggcccccgttaaaggactccggtacaggatggctatgcgtcccattagttagttggcagggtaacggcctaccaagacgtcgatgggtaggggccctgagagggggatcccccacactggtactgagacacggaccagactcctacgggaggcagcagtgaggaatattggacaatgggcgatggcctgatccagccatgccgcgtgcaggaagaatgtcctatggactgtaaactgcttttgtacgggaagaaccgggggcacgcgtgcccccctgacggtaccgtaagaataaggatcgg

SEQ ID NO: 3974 - DNA, 490 bp, Unknown
  Ascusbbf_1456386, encodes 16S rRNA
agagtttgatcatggtcaggacgaacgctggcggcgtgcctaacacatgcaagtcgagcggagtaaaaggaaagcttgcttttcttttgcttagcggcggacgggtgagtaacgcgtgggcaatctacctttcacagggggataacacagggaaacttgtgctaataccgcataacaccttatcatggcatcatgagaaggtcaaaggagaaatccggtgaatgatgagcccgcgtccgattagctagttggtgaggtaatggctcaccaaggcaacgatcggtagccgaactgagaggttgatcggccacattgggactgagacacggcccagactcctacgggaggcagcagtggggaatattgcgcaatgggggaaaccctgacgcagcaacgccgcgtgaaggaagaaggccttcgggttgtaaacttctttgatcagggaagaataaatgacggtacctgaagaacaagccacggctaactacgt

SEQ ID NO: 3975 - DNA, 490 bp, Unknown
  Ascusbbf_1881803, encodes 16S rRNA
agagtttgatcatggctcaggataaacgctggcggcgcacataagacatgcaagtcgaacggaagtcgtcagagaacagattgaagatttatctgattgaagttctttgacaatggctttagtggcggactggtgagtaacgcgtgagcaacctgcctaacagaggggaataacagtgagaaatcattgctaataccgcatatgctcacagtagcacatgctacagtgaggaaaggagaaatccgctgatagatgggctcacgtctgattagctagttggtggggtaaaagcctaccaaggcgacgatcagtagccggactgagaggttggacagccacattgggactgagatacggcccagactcctacgggaggcagcagtcgggaatattgcgcaatggaggaaactctgacgcagtgacgccgcgtataggaagaaggttttcggattgtaaactattgtcattagggaagataaaagactgtacc

SEQ ID NO: 3976 - DNA, 489 bp, Unknown
  Ascusbbf_771699, encodes 16S rRNA
agagtttgatcctggctcagaatgaacgctggcggcatggattaggcatgcaagtcgaacggggcccttcggggcccagtggcgaaagggtgagtaacacgtgaggaacctgcccggaaggccggaataagcgctggaaacggcgtgtaatgccggatgaggcggcgccggggcatcccggctccgcgaaagattcatcccttccggatggcctcgcggcccattagcttgttggcggggtgaaggcccaccaaggctttgacgggtaggtggtctgagaggatggtcacccacactgggactgagacactgcccagactccttcgggaggctgcagtcgagaatcttccgcaatgggcgcaagcctgacggagcgatgccgcgtgagggacgaaggccttcgggttgtaaacctctgtcacccgggacgagacagacggtaccgggagaggaagccacggctaactacgtgccagcagccgcggtaat

SEQ ID NO: 3977 - DNA, 490 bp, Unknown
  Ascusbbf_1258852, encodes 16S rRNA
agagtttgatcatggctcaggatgaacgctagcgataggcttaacacatgcaagtcgaggggcagcagggctttcgggccgctggcgaccggcgcacgggtgcgtaacgcgtatgcaacttgccctgtaatggaggataacccgctgaaaggcggactaatactgcgtatgctcacagagaggcatctctcggtgaggaaagaaattcgatacaggataggcatgcgtcccattagctagttggtgaggtaacggctcaccaaggcgacgatgggtaggggaactgagaggtttatcccccacactggtactgagacacggaccagactcctacgggaggcagcagtgaggaatattggtcaatgggcgagagcctgaaccagccaagtcgcgtgaaggatgactgtcttatggattgtaaacttcttttgtatgggaataacatcacccacgtgtgggtgtctgcatgtaccatacgaataagcatcgg

SEQ ID NO: 3978 - DNA, 490 bp, Unknown
  Ascusbbf_1743036, encodes 16S rRNA
agagtttgatcctggctcaggacgaacgctggcggcgtgcctaacacatgcaagtcgaacggattttaaaagagcttgctcttttaaaattagtggcggacgggtgagtaacgcgtgagtaacctgccttgaagagggggataacaccaagaaattggtgctaataccgcataaaatacataattcgcatgaaagatgtatcaaaggagcaatccgctttgagatggactcgcgtccgattagctagttggtgaggtaaaagcccaccaaggcaacgatcggtagccgggttgagagactgaacggccacattgggactgagacacggcccagactcctacgggaggcagcagtgggggatattgcacaatgggcgaaagcctgatgcagcaacgccgcgtgagggaagaaggtcttcggattgtaaacctctgtccaaagggaagaaaaaatgacggtacctttggaggaagctccggctaactacgtg

SEQ ID NO: 3979 - DNA, 490 bp, Unknown
  Ascusbbf_1054388, encodes 16S rRNA
agagtttgatcatggctcaggatgaacgctggcggcatgcctaagacatgcaagtcgtacgaggtggccctttgaactctgtacttgtatagagcgatttggatttccacctagtggcgaaagggtgagtaacacgtgagtaatctacctcagagactggaataactattggaaacgatagctaatgccggatgatatgtacaatgatacgttgttgtatagtaaaaggagcctttaaagcttcactttgagatgagcttgcgacgtattagctagttggtgaggtaatggcttaccaaggcgacgatgcgtagccgacctgagagggtgatcggccacactgggactgagacacggcccagactcctacgggagacagcagttagggatattcgtcaatggaggaaactctgaacgagcaatgccgcgtgagtgatgacagttctatggattgtaaaactctgttgttagggacgaacgacctgtatag

SEQ ID NO: 3980 - DNA, 490 bp, Unknown
  Ascusbbf_1701811, encodes 16S rRNA
agagtttgatcatggctcaggatgaacgctggcggcgtgcctaacacatgcaagtcgagcggtatatagtggaatgaaacttcggtcgagtgaagctatagagagcggcggacgggtgagtaacgcgtaggcaacctgccccatacagagggatagcctcgggaaaccgggattaaaacctcataacgcagagagttcacatggactatctgccaaagattcatcggtatgggatgggcctgcgtctgattagctagttggtgaggtaacggctcaccaaggcgacgatcagtagccgacctgagagggtaatcggccacattggaactgagacacggtccaaactcctacgggaggcagcagtggggaatattgcacaatgggcgaaagcctgatgcagcaacgccgcgtgagcgatgaaggcctttgggtcgtaaagctctgtccttggggaagaaacaaatgacggtacccttggaggaagccccgg

SEQ ID NO: 3981 - DNA, 490 bp, Unknown
  Ascusbbf_489930, encodes 16S rRNA
agagtttgatcctggctcaggacgaacgctggcggcgtgcctaacacatgcaagtcgaacggagctcagatgcagaactcttcggagggacgcatcgaaagcttagtggcggacgggtgagtaacgcgtgagtaacctgcccttcagagggggacaacagttggaaacgactgctaataccgcatgacgtatgagagagacatctctttcataccaaaggagcaatccgctgaaggatgggctcgcgttggattagatagttggtggggtaacggcctaccaagtctacgatccatagccggactgagaggttgatcggccacattgggactgagacacggcccagactcctacgggaggcagcagtgggggatattgcacaatggaggaaactctgatgcagcaacgccgcgtgagggaagaaggtcttcggattgtaaacctttgtctttggtgacgaaacaaatgacggtagccaaggaggaagctc

SEQ ID NO: 3982 - DNA, 361 bp, Unknown
  Ascusbbf_1486639, encodes 16S rRNA
agagtttgatcatggctcaggatcaacgctggcggcgtgcctaatgcatgcaagtcgaacggggcttccttcgggaggttcacgtggcggacgggtgaggaacacgtgggcgacctaccctggggcgggggatacccgcgagaaatcgtggataattccgcatacgctcgctctgcggttggcagggtgaggaaaggtgcatttcggtgcgccacccttggcggggcctgcggccgattagctagttgggggggtaacggcctcccaaggcgatgatcggtagctggtctgagaggacggccagccacacggggactgagacacggccccgactcctacgggagccagcagccgcggtaat

SEQ ID NO: 3983 - DNA, 490 bp, Unknown
  Ascusbbf_1084311, encodes 16S rRNA
agagtttgatcatggctcaggacgaacgctggcggcgtgcttaacacatgcaagtcgaacgaggacattccgggagcttgctccaggggtgttcgagtggcggacgggtgagtaacgcgtgaggaacctgtcttacacagggggataacgcaccgaaaggtgtgctaatagcgcataagaccacactttcgcatgggagaggggtcaaaggagcgatccggtgtaaggtggactcgcgtcccgttaggcagttggcggggtaacggcccaccaaaccgacgatgggtagccgacctgagagggtgatcggccacattggaactgagacacggtccaaactcctacgggaggcagcagtggggaatattgggcaatgggcgcaagcctgacccagcaacgccgcgtgagggaagaaggttttcggattgtaaacctctgtcctcgatgaaaagttgaagatggtaattgaggaggaagccccggctaacta

SEQ ID NO: 3984 - DNA, 490 bp, Unknown
  Ascusbbf_1115289, encodes 16S rRNA
agagtttgatcctggctcaggatgaacgctggcggcgtgcctaacacatgcaagtcgagcggagatgtcacaccggatgaagattcgtcggaatccaccgtgacattcttagcggcggatgggtgagtaacacgtggacaacctgcccttgactgggggatagcagctggaaacggctgataataccgcatagatcatcggatcgcatgaactgatgaggaaagatttatcggtcagggatgggtccgcgtcggattaactagttggtgaggtaacggcccaccaaggtgatgatccgtagccggcctgagagggcgaccggccacattgggactgagacacggcccagactcctacgggaggcagcagtgggggatattgcacaatgggggaaaccctgatgcagcgacgccgcgtgaaggaagaagtactccggtatgtaaacttctatcagcagggaagaagatgacggtacctgactaagaagccc

SEQ ID NO: 3985 - DNA, 490 bp, Unknown
  Ascusbbf_1675614, encodes 16S rRNA
agagtttgatcatggctcaggatgaacgctagcggcaggcctaacacatgcaagtcgggcggtaacaggagcagcaatgcttgctgacgagcggcagacgggtgagtaacgcgtatgcaaccttcccttcgcacggggacagccttccgaaaggaggattgatacccgatagtccggacgagaggcatctcttgtccgttaaagattcatcggcggaggatgggcatgcgtggcattagctagacggcggggcgacggcccaccgtggcgatgatgcctaggggttctaaaaggaaggtcccccacatcggtactgagacacggaccgaactcctacgggaggcagcagtgaggaatattggacaatgggggcaaccctgatccagccaaaccgcgtgaaggacgaaggccctagtggtcgtaaacttcttttgctctgggataacgagcggcacgcgtgccgccttgaaggtacagagcgaataagcac

SEQ ID NO: 3986 - DNA, 490 bp, Unknown
  Ascusbbf_1811917, encodes 16S rRNA
agagtttgatcatggctcaggatgaacgctagcgacaggcctaacacatgcaagtcgaggggcagcattgaggtagcttgctacttcagatggcgaccggcgcacgggtgagtaacgcatatgcaacctggcttcggctacgggatagccttgcgaaagtaagattaataccgtatgcgatatgagatgacatcgtcttatattgaaagatttatcggcagaagatgggcatgcgtctgattagttagttggcggggtaacggcccaccaagacatcgatcagtaggggttctgagaggaaggtcccccacattggaactgagacacggtccaaactcctacgggaggcagcagtgaggaatattggtcaatggacggaagtctgaaccagccaagtcgcgtgaaggaagacggttctatggattgtaaacttcttttgcccgagggtaaagtgagctacgtgtagcttattgcaagtatcgggtgaata

SEQ ID NO: 3987 - DNA, 490 bp, Unknown
  Ascusbbf_1372968, encodes 16S rRNA
agagtttgatcctggctcaggatgaacgctagctacaggcttaacacatgcaagtcgagcggaacaccttcgggtgtttagcggctgacgggtgagtaacacgtatccaacctttcccttactcgggtatagcctcgggaaactgagagtaatccccgatgtggtgcacggaaagcattttttgcgcacgaaagattcttcggtaaggggtgtggatgcgttccattaggtagtaggcggggtaacgcctcacctagccgatgatggataggggttctgagaggaaggtcccccacattggaaacgagaaacggaccaaactcctacgggaggcagaagtgaggaatattggtcaatgggcgagagcctgaaccagcaaagtagcgtgcaggaggacggccctatggggtgtaaactgcttttgtgcgggaataacggtcgccacgtgtggtgatgtgcatgtaccgtacgaataaggatcggctaactc

SEQ ID NO: 3988 - DNA, 490 bp, Unknown
  Ascusbbf_1004598, encodes 16S rRNA
agagtttgatcatggctcaggatgaacgctggcggcgtgcttaacacatgcaagtcgaacggagttgttttacggaagtcttcggatggaagtaaaataacttagtggcggacgggtgagtaacgcgtgggtaacctgccttgtacagggggataacaaccggaaacggttgctaataccgcataagcgcacagtgtcgcatgacacggtgtgaaaagatttatcggtacaagatggacccgcgtctgattagctagttggtgaggtaatggctcaccaaggcatcgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggacgaataaaatgacggtacctgactaagaagccccgg

SEQ ID NO: 3989 - DNA, 490 bp, Unknown
  Ascusbbf_470789, encodes 16S rRNA
agagtttgatcatggctcaggatgaacgctggcggcgtgcttcatacatgcaagtcgaacgagaagagatagcttgctatcttggaaagtggcggacgggtgagtaatacatagggaatctgcccttagccgggggacaacagttggaaacgactgctaataccgcatatgagtatagttgaaatattatacttgaaaactccggtggctagggatgagcctgtgcctgattagttagttggcggggtaaaggcccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgtgcgatgaagcccttaggggtgtaaagcactgtcagtagggacgaaagatgacggtacctacagaggaagcaccggctaactccgtgccagcagccg

SEQ ID NO: 3990 - DNA, 490 bp, Unknown
  Ascusbbf_1082181, encodes 16S rRNA
agagtttgatcctggctcaggacaaacgctggcggcgtgcctaacacatgcaagtcgaacgaagcactggcgaaagagacttcggtcaattgaacctttgacttagtggcggacgggtgagtaatgcatgagcaatctgccctggagtgggggacaacagttggaaacgactgctaataccgcatgatgtcatcggagggcatcctctgatgaccaaagatttatcgctctgggatgagctcatgtctgattagttcgttggcggggtaacggcccaccaagactacgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttaccagggacgaagaaagtgacggtacctggagaataagccacg

SEQ ID NO: 3991 - DNA, 490 bp, Unknown
  Ascusbbf_710066, encodes 16S rRNA
agagtttgatcctggctcaggatgaacgctggcggcgtgcctaatacatgcaagtcgaacgctaattttcggattagagtggcgaacgggtgagtaacacgtaggtaacctgcccataagacaaggataactactggaaacggtagctaatactggatagtatatagaatcgcatgattttatatttaaaggtgctgcaaggcactacttatggatggacctgcggcgcattagctagttggtgaggtaacggcccaccaaggcgacgatgcgtagccggactgagaggttgaacggccacattgggactgagacacggcccagactcctacgggaggcagcagtagggaatattgcacaatgggggaaaccctgatgcagcgacgccgcgtgaaggaagaggtatctcggtatgtaaacttctatcagcagggaagaaaatgacggtacctgactaagaagccccggctaactacgtgccagcagccgc

SEQ ID NO: 3992 - DNA, 488 bp, Unknown
  Ascusbbf_1044227, encodes 16S rRNA
agagtttgatcatggctcagaacgaacgctggcggcaggcttaacacatgcaagtcgagcgccccgcaaggggagcggcagacgggtgagtaacacgtgggaatctacccatccctgcggaacaactccgggaaactggagctaataccgcatacgccctacgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgcgggaagacggccctatgggttgtaaaccgcttttgttggggagcaataaggtccacgagtggatcgatgagagtacccagcgaataagcatcggctaactccatgccagcagccgcggtaat

SEQ ID NO: 3993 - DNA, 490 bp, Unknown
  Ascusbbf_1122634, encodes 16S rRNA
agagtttgatcatggctcaggatgaacgctggcggcgtgcctaacacatgcaagtcgaacggtgaaggcgccttcgggcgcgaatgaagtggcgaacgggtgagtaacacgtgaccaacctgccccgcgcaccgggacagccccccgaaagggggattaataccggatgcgccgcggcccccgcatgggggccgcgggaaagcccaggcggcgcgggatggggtcgcggcccatcaggtagtaggtcgggtagcggccgacctagccgacgacgggtagccgggttgagagaccgaccggccacattgggactgagatacggcccagactcctacgggaggcagcagtggggaatattgcgcaatgggggcaaccctgacgcagcaacgccgcgtgcgggacgaaggcactcgtgtcgtaaaccgctttcagcagggaagacatcgacggtacctgcagaagaagccccggctaactacgtgccagcagc

SEQ ID NO: 3994 - DNA, 466 bp, Unknown
  Ascusbbf_1791731, encodes 16S rRNA
agagtttgatcctggctcaggatgaacgctggcggcgtgcttaacacatgcaagtcgaacggttaaaccggcttcggccggacatagagtggcgaacgggtgagtaacacgtgaccaacctgccccgcgcaccgggacagcctcgcgaaagcgggattaataccggatactccggcggcgcgggatggggtcgcggcccatcaggtagtaggtcgggcaatggccgacctagccgacgacgggtagccgggttgagagaccgaccggccacattgggactgagatacggcccagactcctacgggaggcagcagtggggaatattgcgcaatgggggcaaccctgacgcagcaacgccgcgtgcgggatgaaggccttcgggttgtaaaccgctttcagcagggaggatagtgacagtacctgcacaagaagccccggctaactacgtgccagcagccgcggtaat

SEQ ID NO: 3995 - DNA, 482 bp, Unknown
  Ascusbbf_751658, encodes 16S rRNA
agagtttgatcctggctcagaacgaacgctggcggcgtgcctaacacatgcaagtcgaacgagggctcccttcggggatgtccctagtggcgcacgggtgagtaacgcgtgggaatctgtccaagtgtggggaacaactactggaaactgtagctaataccgcatacgccctacgggggaaaggcttcggccgcacatggatgagcccgcgtcagattagcttgttggtggggtaacggcctaccaaggctacgatctgtaactggtctgagaggacgatcagtcacactggaactgagacacggtccagactcctacgggaggcagcagtggggaattttgcacaatgggggaaaccctgatgcagcgacgccgcgtgggtgatgaaggccttagggttgtaaagccctttcagcagggaagatgatgacggtacctgcagaagaagccccggctaactccgtgccagcagccgcggtaat

SEQ ID NO: 3996 - DNA, 395 bp, Unknown
  Ascusbbf_1818871, encodes 16S rRNA
agagtttgatcatggctcaggatgaacgctagcgacaggcctaacacatgcaagtcgaggggcagcgcgggagaagcttgcttttcctggcggcgaccggcgcacgggtgcgtaacaggtgtgcaatctgtccatagtcgggggatagcccagcgaaagctgaattaacactccatgtgaatcgaagccgcatgactttgatttgaaacgcaaggactatgggtgaggaatattggtcaatgggcgagagcctgaaccagccaagtcgcgtgaaggatgaaggttctatggattgtaaacttcttttgtccgagggtaaaaaaggccacgtgtgacttcttgcaagtatcggacgaataagcatcggctaactccgtgccagcagccgcggtaat

SEQ ID NO: 3997 - DNA, 490 bp, Unknown
  Ascusbbf_775479, encodes 16S rRNA
agatttgatcctggctcaggatgagcgctggcggcgtgcataacacattcaagtcgaacggacgacagggggcttgctccctgaagtcagtggcggacgggtgagtaacgcgtgagcaacctgccttggtctgcgggataacattgggaaaccggtgctaataccgcataacgcatcgagatcacatggtcatgatgccaaagaagcgattcggaacaagatgggctcgcgtctgattagcttgttggtgaggtaacggcccaccaaggcgacgatcagtagccggactgagaggttgaacggccacattggaactgagatacggtccagactcctacgggaggcagcagtggggaatattgggcaacgggcgaaagcctgacccagcgacgccgcgtggaggaagaaggtcttcggattgtaaactcctgtcagcagggaagaagaaagtgacggtacctgcagaggaagccacggctaactacgtgcc

SEQ ID NO: 3998 - DNA, 177 bp, Unknown
  Ascusbbf_1033194, encodes 16S rRNA
agagtttgatcatggctcagagtttgatcaggctcagagtttgatcaggctcagagtttgatcaggctcagagtttgatcatggctcagagtttgatcatggctcagagtttgatcatggctcagagtttgatcaggctcagagtttgatcatggctcagccagcagccgcggtaat

SEQ ID NO: 3999 - DNA, 490 bp, Unknown
  Ascusbbf_1077909, encodes 16S rRNA
agagtttgatcatggctcaggacgaacgctggcggcgtgcttaacacatgcaagtcgaacgaggcaattcccttcgggggattaccgagtggcggacgggtgagtaacgcgtgagcaatctgtcccagacagggggataacaactggaaacagttgctaataccgcataagaccacgaagtcgcatggctttgaggtaaaaggagcgatccggtctggggtgagttcgcgtctgattagatagttggcgaggtaacggctcaccaagtcgacgatcagtagccgacctgagagggtgaccggccacattgggactgagacacggcccagactcctacgggaggcagcagtggggaatattgggcaatgggggaaaccctgacccagcaacgccgcgtgagggaagaaggttttcggattgtaaacctctgtccttggggacgaaataaatgacggtacccgaggaggaagccccggctaactacgtgcca

SEQ ID NO: 4000 - DNA, 490 bp, Unknown
  Ascusbbf_1742846, encodes 16S rRNA
agagtttgatcctggctcaggacaaacgctggcggcgcacataagacatgcaagtcgaggggcatcatggagtttgcttgcaaactccgatggtgaccggcgcacgggtgagtaacgcgtatccaaccttccccttagtagggcatagcccggcgaaagtcggattaataccctatgttgtcgtttgaagacatctgaagacgattaaagattgatcgctaagggatggggatgcgtctgattaggttgttggcggggtaacggcccaccaagccatctatcagtaggggttttgagaggaaggtcccccacattggtactgagacacggaccaaactcctacgggaggcagcagtgaggaatattggtcaatgggcgagagcctgaaccagccgagtagcgtgcaggatgactgccctatgggttgtaaactgcttttatcaggggataaagtgacgtacgtgtacgtttttgtaggtacctgatgaat

SEQ ID NO: 4001 - DNA, 340 bp, Unknown
  Ascusbbf_1891001, encodes 16S rRNA
agagtttgatcctggctcaggacgaacgctggcggcgtgcctaatacatgcaagtcgagcgaacagataaggagcttgctcctttgacgttagcggcgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaat

SEQ ID NO: 4002 - DNA, 490 bp, Unknown
  Ascusbbf_1869633, encodes 16S rRNA
agagtttgatcctggctcaggatgaacgctggcggcgtgcataacacattcaagtcgaacgaagcactggcgaggaagtcttcggatggaattgcttttgacttagtggcggacgggtgagtaacgcgtgagcaaccttcctggcagtgagggataacacagggaaacttgtgctaataccgcatgacgcacgattgtcgcatggcagacgtgccaaagattaattgctgccagatgggctcgcgcctgattagatagttggcagggtaacggcctaccaagtcgacgatcagtagccggactgagaggttgaacggccacattggaactgagagacggtccaaactcctacaggaggcagcagtggggaatattgcacaatgggggaaaccctgatgcagcgacgccgcgtgagtgaagaagtatttcggtatgtaaagctctatcagcagggaagaagatgacggtacctgcacaagaagccccggct

SEQ ID NO: 4003 - DNA, 490 bp, Unknown
  Ascusbbf_1820853, encodes 16S rRNA
agagtttgatcctggctcagaacgaacgctggcggcaggcttaacacatgcaagttgaacgggaatgttctggtagcttgctactgggacatgagagtagcgcactggtgagtaacacgtgggaacataccttttggtgggggatagcaattggaaacgattgataataccgcataagccctaagggggaaagattaattgccgaaagattggcccgcggaagattagattgttggtggggtaacggcctaccaagtcgacgatcagtagccggactgagaggttgaacggccacattgggactgagatacggcccagactcctacgggaggcagcagtcgggaatattgcgcaatggaggaaactctgacgcagtgacgccgcgtgcaggaagaaggttttcggattgtaaactgctttagacagggaagaactaagacagtacctgtagaataagctccggctaactacgtgccagcagccgcggtaa

SEQ ID NO: 4004 - DNA, 490 bp, Unknown
  Ascusbbf_776010, encodes 16S rRNA
agagtttgatcctggctcaggatgaacgctagctacaggcttaacacatgcaagtcgcggggcatcatgaagggagcttgctctctttgatggcgaccggcgcacgggtgagtaacgcgtatccaacctgccccctagtagggaacagcccgtagaaatgcggattaatgccctatgttctccgaagacggcatcagattcggagcaaaggcctttggttgctaggggatggggatgcgtctgattaggcagcaggcggggtaacggcccacctggccgtcgatcagtaggggttctgagaggaaggtcccccacactggtactgagacacggaccagactcctacgggaggcagcagtgaggaatattggtcaatggccgagaggctgaaccagccaagtagcgtgcaggatgacggccctacgggttgtaaactgcttttatcagggaataaagtgagggacgtgtccctttttgtatgtacctgatg

SEQ ID NO: 4005 - DNA, 172 bp, Unknown
  Ascusbbf_1804525, encodes 16S rRNA
agagtttgatcctggctcaggacgaacgctggcggcgtgcctaatacatgcaagtcgagcgagcggaaccaacagatttacttcggtaatgacgttgggaaagctcaaggaagataatgacggtacttgaggaggaagccccggctaactacgtgccagcagccgcggtaat

SEQ ID NO: 4006 - DNA, 490 bp, Unknown
  Ascusbbf_1836553, encodes 16S rRNA
agagtttgatcatggctcaggacgaacgctggcggcgtgcttaacacatgcaagtcgaacgaagcgtagaaatacgcttagtggcggacgggtgagtaacgcgtgagcaacctgcccttgtcaggggaataacacagagaaatttgtgctaataccgcataacgtacttaagcggcatcgcataggtatcaaagctgaggcggacaaggatgggctcgcgtcccattaggtagttggtgaggtaacggcccaccaagccgacgatgggtagccgacctgagagggtgatcggccacattggaactgagaacggtccagactcctacgggaggcagcagtggggaatattgggcaatggagggaactctgacccagcaacgccgcgtgaatgaagaaggtcttcggattgtaaagttctgtgatgggggacgaagaaagtgacggtaccccaatagcaagctacggctaactacgtgccagcagccgcggt

SEQ ID NO: 4007 - DNA, 490 bp, Unknown
  Ascusbbf_1469390, encodes 16S rRNA
agagtttgatcatggctcaggatgaacgctggcggcgtgcttaacacatgcaagtcgaacggagtgctcatgaaggagttttcggacaacagattgagttacttagtggcggacgggtgagtaacgcgtgaggaacctgccttggagtggggaataacagatagaaatatctgctaataccgcatgatgcagttgggtcgcatggctctgactgccaaagatttatcgctctgagatggcctcgcgtctgattagatagttggcggggtaacggcccaccaagtcgacgatcagtagccggactgagaggttggccggcaacattgggactgagacacggcccagactcctacgggaggcagcagtggggaatattgggcaatgggcgcaagcctgacccagcaacgccgcgtgaaggaagaaggccctcgggttgtaaacttcttttatccaggacgaaggaagtgacggtactggatgaataagccac

SEQ ID NO: 4008 - DNA, 490 bp, Unknown
  Ascusbbf_371478, encodes 16S rRNA
agagtttgatcctggctcaggacgaacgctggcggcgcgcttaacacatgcaagtcgaacggggcaccttcgggtgtctagtggcgaacgggtgcgtaacacgtgagcaacctgcctggagttgggggataacctcgggaaaccggggctaataccgcatgagctcctggtctcggatgggatcaggaggaaagcagctttcgggctgtgacttcagaggggctcgcggcgtatcagctagttggtgaggtgaaggctcaccaaggcgacgacgcgtagggggtctgagaggatggccccccacattgggactgagatacggcccagactcctacgggaggcagcagtggggaatcttgcgcaatggccgaaaggctgacgcagcgacgccgcgtgcgggaggaagcccttcggggtgtaaaccgctgtcagaggggacgaaagccagagggaggcaatgccctttggaaggacggtaccctcagaggaa

SEQ ID NO: 4009 - DNA, 490 bp, Unknown
  Ascusbbf_361803, encodes 16S rRNA
agagtttgatcctggctcagattgaacgctggcggcatgctttacacatgcaagtcgaacggcagcacgggtgcttgcacctggtggcgagtggcgaacgggtgagtaatacatcggaacgtgtcccgtagagggggatagctcggcgaaagccggattaataccgcatgagatctacggatgaaagctggggaccttcgggcctagcgctatgggggcggccgatgtcagattaggtagttggtggggtaaaggcctaccaagccgacgatctgtagctggtctgagaggatgatcagccacactggaactgagacacggtccagactcctacgggaggcagcagtggggaattttggacaatgggcgcaagcctgatccagccatgccgcgtgcaggaagaaggccttcgggttgtaaactgcttttgtcaggaacgaaaagccctgtgtgaataatgcggggtgctgacggtacctgaagaataagc

SEQ ID NO: 4010 - DNA, 490 bp, Unknown
  Ascusbbf_246516, encodes 16S rRNA
agagtttgatcatggctcagattgaacgctggcggcgtgcttaacacatgcaagtcgtacgtgaaagcgccttcgggcgcgagtaaagtggcgcacgggtgagtaacgcgtggatgatctgcctggtagtggggaataacggctggaaacggccgctaataccgcatgagcttcatatttggctttatgaaggaaagagggcctctgcatatgctcttgctaccggatgagtccgcgtcccattagctagttggcggggtaatggcccaccaaggcgacgatgggtagctgttctgagaggatgatcagccacattggaactggaacacggtccaaactcctacgggaggcagcagtggggaatattgcgcaatgggcgaaagcctgacgcagcgacgccgcgtgagggatgaaggtcttcggatcgtaaacctctgtcagaagggaagaagttatgacgtgctaatcaacgtcatattgacggtacctt

SEQ ID NO: 4011 - DNA, 490 bp, Unknown
  Ascusbbf_386128, encodes 16S rRNA
agagtttgatcctggctcagaatcaacgctggcggcgtgcctcagacatgcaagtcgaacgattaaagctctcttcggagagtgcataaagtggcgcacgggtgagtaacacgtaagtaatctaccttcgagtggggaataacatcgggaaatcggtgctaataccgcataatgcagcggcatcgtaagatgacagttgttaaaggagcaattcgcttgaagaggagcttgcggcagattagctagttggtaaggtaatggcttaccaaggctacgatctgtatccggtcttagaggacggtcggacacactgacactgaataacgggtcagactcctacgggaggcagcagtcgggaattttgggcaatgggcgaaagcctgacccagcaacgccgcgtgaaggatgaagtatttcggtatgtaaacttcgaaagaataggaagaataaatgacggtactatttataaggtccggctaactacgtgcca

SEQ ID NO: 4012 - DNA, 490 bp, Unknown
  Ascusbbf_120245, encodes 16S rRNA
agagtttgatcatggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatgaatgactcatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaaattcacactgtgacggtagct

SEQ ID NO: 4013 - DNA, 490 bp, Unknown
  Ascusbbf_104605, encodes 16S rRNA
agagtttgatcatggctcaggatgaacgctagcgggaggcctaacacatgcaagccgagcggtagagattcttcggaatcttgagagcggcgcacgggtgcggaacacgtgtgcaacctgcctttatctgggggatagcctttcgaaagggagattaataccccataatataatgagtggcatcacttattattgaaaactccggtggatagagatgggcacgcgcaagattagatagttggtgaggtaacggctcaccaagtcaatgatctttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtacagggataaacctatttacgtgtaaatagctgaaggtactgtacgaataagcaccggct

SEQ ID NO: 4014 - DNA, 490 bp, Unknown
  Ascusbbf_1740226, encodes 16S rRNA
agagtttgatcatggctcaggacgaacgctggcggcatgcctaacacatgcaagtcgaacggagatgagaagcttgcttttcatcttagtggcggacgggtgagtaacgcgtgagcaacctgcctctcagtggggaataatgtactgaaaaggacactaataccgcataatgtattgaagccgcatgactttgataccaaagatttattgctgagagatgggctcgcgtccgattagccagttggtggggtaacggcctaccaaagcgacgatcggtagccgaactgagaggttggacggccacattgggactgagacacggcccagactcctacgggaggcagcagtgggggatattgcgcaatgggggaaaccctgacgcagcaatgccgcgtggaggatgaaggtcttcggattggaaactccttttgtcagggacgaaaaatgacggtacctgacgaataagctccggctaactacgtgccagcag

SEQ ID NO: 4015 - DNA, 490 bp, Unknown
  Ascusbbf_159120, encodes 16S rRNA
agagtttgatcatggctcaggacgaacgctggcggcgtgcctaacacatgcaagtcgaacggacgatacgtcttcggacgtaaagttagtggcggacgggtgagtaacgcgtgagcaacctgcctttaagagggggataacataccgaaaggtatgctaataccgcatagagtatttgggaggcatcttctgaatataaaagatttattgcttaaagatgggctcgcgtctgattagatagttggtgaggtaacggctcaccaagtcaacgatcagtagccggactgagaggtcgaacggccacattggaactgagaaacggtccagactcctacgggaggcagcagtggggaatattgcgcaatggagggaactctgacgcagcaacgccgcgtgaaggaagaaggtcttcggattgtaaacttctttgatgggggacgaaaagaatgacggtaccccaaaaacaagtcacggctaactacgtgccagc

SEQ ID NO: 4016 - DNA, 490 bp, Unknown
  Ascusbbf_201470, encodes 16S rRNA
agagtttgatcatggctcagattgaacgctggcggcatgctttacacatgcaagtcgaacggcagcacgggagcttgctcctggtggcgagtggcggacgggtgagtaatacatcggaacatgccctgtagtgggggataacttggcgaaagttgagctaataccgcatacgacctgagggtgaaagctggggatcgcaagacctggcgttatgggattggccgatggctaattagctagttggtgaggtaaaggcttaccaaggcgacgattagtagctggtctgagaggatgatcagccacactgggactgagacacggcccagactcctacgggaggcagcagtggggaattttggacaatgggcggaagcctgatccagctatgccgcgtgagtgaagaaggccttcgggttgtaaagctctttcggtcgggaagaagtctgttgggtgaatagcctaacggattgacggtaccgacataagaagc

SEQ ID NO: 4017 - DNA, 480 bp, Unknown
  Ascusbbf_609854, encodes 16S rRNA
agagtttgatcctggctcagaacgaacgctggcggcatgcctaacacatgcaagtcgaacgatggtttcgtcttcggatggggccatagtggcgcacgggtgggtaacacgtgggaacctgcctttcggttcggaataacgtctggaaacggacgctaacaccggatacgcccttttggggaaagtttacgccgagagaggggcccgcgccggattaggtagttggtggggtaacggcctaccaagccgacgatccgtagctggtctgagaggatgatcagccacactgggactgagacacggcccagactcctacgggaggcagcagtggggaatattggacaatgggcgcaagcctgatccagcaacgccgcgtgagtgatgaaggccttagggttgtaaagctctttcgcacgcgacgatgatgacggtagcgtgagaagaagccccggctaacttcgtgccagcagccgcggtaat

SEQ ID NO: 4018 - DNA, 490 bp, Unknown
  Ascusbbf_337805, encodes 16S rRNA
agagtttgatcatggctcagattgaacgctggcggcaggcctaacacatgcaagtcgagcggtaacaggggagcttgctcccgctgacgagcggcggacgggtgagtaacgcgtaggaatctacctggtagtgggggatagcccggggaaactcggattaataccgcatacgccttaagggggaaagtgggggaacttcggtcctcacgctatcagaagagcctgcgtaggattagctagttggtagggtaaaggcctaccaaggcgacgatccttaactggtctgagaggatgatcagtcacaccggaactgagacacggtccggactcctacgggaggcagcagtggggaatattggacaatgggggcaaccctgatccagccatgccgcgtgtgtgaagaaggccttcgggttgtaaagcactttaagcagggaggaaggccttgaggttaatacccttgaggattgacgttacctgcagaataagc

SEQ ID NO: 4019 - DNA, 490 bp, Unknown
  Ascusbbf_702858, encodes 16S rRNA
agagtttgatcctggctcaggatgaacgctagcggcaggcttaacacatgcaagtcgaggggcagcatggtcttcggaccgatggcgaccggcgcacgggtgagtaacgcgtatgcaacctaccttttacagggggatagcccggggaaacccggattaatatcccattgcaccattatctggcatcatttgatggttaaagctgaggcggtaaaagatgggcatgcgtcctattagttagttggtaaggtaacggcttaccaagacagcgataggtaggggtcctgagagggagatcccccacactggtactgagacacggaccagactcctacgggaggcagcagtgaggaatattggacaatgggcgagggcctgatccagccatgccgcgtgcaggaagactgccctatgggttgtaaactgcttttatacgggaagaaacccaccttcgtgaaggtggctgacggtaccgtaagaataaggatcg

SEQ ID NO: 4020 - DNA, 490 bp, Unknown
  Ascusbbf_1615686, encodes 16S rRNA
agagtttgatcctggctcaggacgaacgctggcggcgtgcttaacacatgcaagtggagcgacgaaccagagcttgctctggggcagagccgcgaacgggtgagtaacacgtgggtcacctacctcgatgaccgggacaacccgaggaaactcgggctaatactggatgtgcacttaggtggaaaggtagcctcggcttccgcatcgagatgggcccgcggcgcattagcttgttggtggggtaacggcctaccaaggcgacgatgcgtagctggtctgagaggacgatcagccacactgggactgagacacggcccagactcctacgggaggcagcagtggggaatcttgcgcaatgcgcgaaagcgtgacgcagcaacgccgcgtgggggaagaaggccttcgggttgtaaacctctttcagttgggacgaagcttctgcggtgaatagccgtatggagtgacggtaccttcacaagaagccccggct

SEQ ID NO: 4021 - DNA, 490 bp, Unknown
  Ascusbbf_1891287, encodes 16S rRNA
agagtttgatcatggctcaggatgaacgctggcggcgtgcctaacacatgcaagtcgaacgggactattcagagatgttttcggactgatctttttagtttagtggcggacgggtgagtaacgcgtggacaacctgcctttcacagggggatagcagctggaaacggctggtaataccgcatacgctcagtgcaccgcatggtgtgctgaggaaagatttatcggtgaaagatggatccgcgtctgattagccagttggcggggtaacggcccaccaaagcgacgatcagtagccggcctgagagggcggacggccacattgggactgagacacggcccagactcctacgggaggcagcagtgggggatattgcacaatgggcgcaagcctgatgcagcgacgccgcgtgagtgaagaagtatttcggtatgtaaagctctatcagcagggaagaaaatgacggtacctgcacaagaagccccggctaac

SEQ ID NO: 4022 - DNA, 490 bp, Unknown
  Ascusbbf_236507, encodes 16S rRNA
agagtttgatcatggctcagattgaacgctggcggcaggcctaacacatgcaagtcgagcgcgaaagcccttcggggtgagtaaagcggcggacgggtgagtatcgcgtgggaatctaccgagtagtgggggataacgtccggaaacgggcgctaataccgcatacgccctacgggggaaagggggggatcttcggacctctcgctatttgatgagcctgcgtcggattagctagttggtggggtaagggcctaccaaggcgacgatccgtagctggtctgagaggatgatcagccacactgggactgagacacggcccagactcctacgggaggcagcagtggggaatattgcacaatgggcgaaagcctgatgcagccatgccgcgtgtgtgaagaaggctttcgggttgtaaagcactttcagcgaggaggaaggcttgtcggttaataaccggcaggattgacgttactcgcagaagaagcaccgg

SEQ ID NO: 4023 - DNA, 376 bp, Unknown
  Ascusbbf_1738973, encodes 16S rRNA
agagtttgatcatggctcaggacgaacgctggcggcgtgcctaacacatgcaagtcgaacggagttacttgtttagatcccttcggggtgacgaacttttaacttagtggcggacgggtgagtaacgcgtgagtaacctgcctctgagaggggaataacgttctgaaaagatcgctaataccgcataacatatcgaagtcgcatggctttgatatcaaagattttatcgctcggagatggactcgcgtccgattagctagttggtgaggtaacggcccaccaagtcgacgatcggtagccgacctgagagggtgatcggccacattgggactgagacacggcccaaactcctacgggagccagcagccgcggtaat

SEQ ID NO: 4024 - DNA, 480 bp, Unknown
  Ascusbbf_1092707, encodes 16S rRNA
agagtttgatcctggctcagaacgaacgctggcggcaggcttaacacatgcaagtcgaacgtgaagtcaccttcgggtgatggaaagtggcagacgggtgagtaacgcgtgggaacctacctaatggtacggaataactcagggaaacttgggctaataccgtatgtgcccgaaaggggaaagatttatcgccattagatgggcccgcgtcggattagctagttggtagggtaacggcttaccaaggcgacgatccgtagctggtctgagaggatgaccagccacactgggactgagacacggcccagactcctacgggaggcagcagtggggaatattggacaatgggcgcaagcctgatccagccatgccgcgtgagtgatgaaggccctagggttgtaaagctctttcggcggggacgataatgacggtaccgggaaaggaagccacggctaaccacgtgccagcagccgcggtaat

SEQ ID NO: 4025 - DNA, 490 bp, Unknown
  Ascusbbf_1504860, encodes 16S rRNA
agagtttgatcctggctcaggacgaacgctggcggcgtgcttaatacatgcaagtcgagcggggtttatgggtagcttgctaccgataaaccaagcgacggacgggtgagtaacgcgtgggcaacctgccctctagcctgggataacagcgcgaaagtgctgctaacaccggatatgctcacagggagacatctcccggtgagaaaagtttacactagaggatgggcccgcgtcccattagctagttggtgaggtaacggcccaccaaggcgacgatgggtagccgacctgagagggtgatcggccacactgggactgagacacggcccagactcctacgggaggcagcagtagggaattttccgcaatgggcgaaagcctgacggagcaacgccgcgtgagggatgaaggttttcggatcgtaaacctctgtcttcagggacgataatgacggtacctgaggaggaagccacggctaactacgtgccag

SEQ ID NO: 4026 - DNA, 490 bp, Unknown
  Ascusbbf_1583456, encodes 16S rRNA
agagtttgatcctggctcagagcgaacgctggcggcatgcttaacacatgcaagtcgcacgaaggtttcggccttagtggcggacgggtgagtaacgcgtaggtatctatccatgggtgggggataacactgggaaactggtgctaataccgcatgacacctgagggtcaaaggcgcaagtcgcctgtggaggagcctgcgtttgattagctagttggtggggtaaaggcctaccaaggcgatgatcaatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttaagcgaggaggaggctactttagttaatacctagggatagtggacgttactcgcagaataagcaccggctaactctgtgccagcagcc

SEQ ID NO: 4027 - DNA, 490 bp, Unknown
  Ascusbbf_1827514, encodes 16S rRNA
agagtttgatcctggctcaggatgaacgctagctacaggcttaacacatgcaagtcgaggggcagcatgtcagtggcttgccactgatgatggcgaccggcgcacgggtgagtaacgcgtatccaaccttccccccagtagggaatagcccggcgaaagtcggattaatgccctatgttttcccttgagagcatttgactgggaacaaagatttatcgctgggggatggggatgcgtctgattagatggtaggcggggtgacggcccacctagtcgacgatcagtaggggttctgagaggaaggtcccccacattggaactgagacacggtccaaactcctacgggaggcagcagtgaggaatattggtcaatggccgggaggctgaaccagccaagtagcgtgcgggacgacggccctatgggttgtaaaccgcttttgccggggaataaagtgtcccacgcgtggggctttgcatgtacccggagaat

SEQ ID NO: 4028 - DNA, 490 bp, Unknown
  Ascusbbf_727368, encodes 16S rRNA
agagtttgatcctggctcaggataaacgctggcggcgtgcctaacacatgcaagtcgaacggacttagctttgtagcaatacgaggcgaaagttagtggcggacgggtgagtaatgcgtgagcaacctgcccttcggagggggacaacagttggaaacgactgctaataccgcataatgtacggagaggacatcctcaccgtaccaaagatttatcgccgaaggatgggctcacgtctgattagttagttggcggggtaacggcccaccaagaccgcgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttaagagggacgaaggacgtgacggtacctcttgaataagccacggctaactacg

SEQ ID NO: 4029 - DNA, 490 bp, Unknown
  Ascusbbf_423495, encodes 16S rRNA
agagtttgatcctggctcaggattaacgctggcggcgtgcctaatgcatgcaagtcgaacgtggtctcttcggagattaacgtggcggacgggtgaggaacacgtggggaacctgcccattggtggggggtagccctcggaaacgaggggtaattccgcatacgctggcctggggatagcccgggtcaggaaagggtcttcggactcgccgatggaggggcctgcgtccgattagcttgttggtggggtaacggcctaccaaggcgatgatcggtagctggtctgagaggacggccagccacaggggaactgagacacggtccccactcctacgggaggcagcagcaaggagttttccgcaatgggcgaaagcctgacggagcaacgccgcgtgggggatgacgcccttcggggtgtaaaccccttttcttggggacgaagcagtgacggtacccgaggaagaaggcccggctaactacgtgccagcagc

SEQ ID NO: 4030 - DNA, 470 bp, Unknown
  Ascusbbf_211147, encodes 16S rRNA
agagtttgatcatggctcagaacgaacgctggcggcaggcttaacacatgcaagtcgaacgatggcttcggccagagtggcgcacgggtgagtaacgcgtgggaacctacccttcggtacggaacaacccagggaaacttgggctaataccgtatacggcctcagggcgaaagatttatcgccgagggatgggcccgcgtccgattaggtagttggtggggtaacggcctaccaagcctgcgatcggtacctggtctgagaggatgatcaggcacactgggactgagacacggcccagactcctacgggaggcagcagtggggaatattggacaatgggcgaaagcctgatccagccatgccgcgtgagtgatgaaggccttcgggttgtaaagctctttcacccacgacgatgatgacggtagtgggagaagaagccccggctaacttcgtgccagcagccgcggtaat

SEQ ID NO: 4031 - DNA, 490 bp, Unknown
  Ascusbbf_1772320, encodes 16S rRNA
agagtttgatcatggctcagattgaacgctggcggcaggcctaacacatgcaagtcgagcggtaaggccctttggggtacacgagtggcgaacgggtgagtaacacgtgagtaacctgccctggactctgggataagcattcgaaagggtgtctaatactggatatgactcatggccgcatggttgtgggtgtaaaggttttctggtctgggatgggctcgcggcctatcagcttgttggtggggtgatggcctaccaaggcgtcgacgggtagccggcctgagagggcgaccggccacactgggactgagatacggcccagactcctacgggaggcagcagtggggaatattgcgcaatgggcggaagcctgacgcagcaacgccgcgtgcgggatgacggccttcgggttgtaaaccgctctcatccatgacgaagggttttcttgacggtagtggaagaagaagcaccggccaactacgtgccagca

SEQ ID NO: 4032 - DNA, 490 bp, Unknown
  Ascusbbf_558036, encodes 16S rRNA
agagtttgatcatggctcaggatgaacgctggcggcgtgcctaatacatgcaagtgaaacgggtatcttcggataccagtcgcgaacgggtgagtaatacataggcaacctgcctttatgagggggataaccgagggaaactttggctaataccgcatgaagactctaaggcatcttagagggataaaagttgggaaacaacgcatgaagatgggcttatggcgcattagctagttggtgagatagcagcccaccaaggtaatgatgcgtagccgacctgagagggtgaacggccacattgggactgagacacggcccaaactcctacgggaggcagcagtagggaattttcggcaatggggggaaccctgaccgagcaacgccgcgtgaaggaagaaggttttcggattgtaaacttctgttataagggaagaacggattggatagggaatgatctgatagtgacggtaccttattagaaagccacggc

SEQ ID NO: 4033 - DNA, 490 bp, Unknown
  Ascusbbf_535900, encodes 16S rRNA
agagtttgatcatggctcaggacgaacgctggcggcgtgcctaatacatgcaagtcgagcgagcggaaccaacagatttacttcggtaatgacgttgggaaagcgagcggcggatgggtgagtaacacgtggggaacctgcccctaagtctgggataccatttggaaacaggtgctaataccggataataaagcagatcgcatgatcagcttttgaaaggcggcgtaagctgtcgctaagggatggccccgcggtgcattagctagttggtaaggtaacggcttaccaaggcgacgatgcatagccgagttgagagactgatcggccacattgggactgagacacggcccaaactcctacgggaggcagcagtagggaatcttccacgatggacgcaagtctgatggagcaacgccgcgtgagtgaagaaggttttcggatcgtaaagctctgtccttaggaacgaagaagtgacggtacctgaggagga

SEQ ID NO: 4034 - DNA, 490 bp, Unknown
  Ascusbbf_928766, encodes 16S rRNA
agagtttgatcctggctcaggatgaacgctagcggcaggcctaacacatgcaagtcgagcgggattcggtggcttgccaccgatgagagcggcgcacgggtgcgtaacgcgtatacaacctaccttttgctacgggatagcccagagaaatttggattaacaccgtatggtataaggatccggcatcgggatcttattaaaggctacggcaaaagatgggtatgcgtcctattagctagatggtgcggtaacggcgcaccatggcaacgataggtaggggccctgagagggggatcccccacactggtactgagacacggaccagactcctacgggaggcagcagtgaggaatattggacaatgggcgaaagcctgatccagccatgccgcgtgcaggaagacggccctatgggttgtaaactgcttttatacgggaagaaacaccccctcgtgagggggcttgacggtaccgtaggaataaggatcggc

SEQ ID NO: 4035 - DNA, 490 bp, Unknown
  Ascusbbf_1752732, encodes 16S rRNA
agagtttgatcctggctcaggatgaacgctagcggcaggcctaatacatgcaagtcggacgggatccgggagtagctcgctacttccggtgagagtggcgcacgggtgcgtaacgcgtgagcaacctgcccatatcagggggatagcccggagaaatccggattaacaccgcatgacacgccgggacggcatcgttccggcgtcaaatattcataggatatggatgggctcgcgtgacattagctagttggtggggtaacggcccaccaaggcgacgatgtctaggggctctgagaggagaatcccccacactggtactgagacacggaccagactcctacgggaggcagcagtaaggaatattggtcaatgggggcaaccctgaaccagccatgccgcgtgcaggacgactgccctatgggttgtaaactgcttttgccggggaataaaccccactacgtgtagtgggctgaacgtacccggagaataa

SEQ ID NO: 4036 - DNA, 170 bp, Unknown
  Ascusbbf_173009, encodes 16S rRNA
agagtttgatcctggctcagcatcagagtatccttttctccttctttgtcggtcatgatgacttgttggcccttcaccacataggtgcctttctctgatgatggggctacggccagtgccgctttcatagctttgcgtttcaaccagccgatgccagcagccgcggtaat

SEQ ID NO: 4037 - DNA, 490 bp, Unknown
  Ascusbbf_1441682, encodes 16S rRNA
agagtttgatcctggctcaggacgaacgctggcggcgtgcctaacacatgcaagtcgaacgaggtccaagagagcttgctctctgaagacctagtggcgaacgggtgagtaacacgtgagaaacctgcctcgaagtggggaataacccggggaaactcgggctaataccgcatatcctcacatgaccgcatggtcgagtgaggaaagaatttcgctttgagagggtctcgcggcctatcagcttgttggcggggtaacggcccaccaaggcaacgacgggtagctggattgagagatcgatcagccacactgggactgagacacggcccagactcctacgggaggcagcagtggggaatcttgcgcaatgggcgaaagcctgacgcagcaacgccgcgtgcgggatgacggccttcgtggttgtaaaccgctttcagcagggacgaaaatgacggtacctgcagaagaagccccggctaactacgtgcca

SEQ ID NO: 4038 - DNA, 490 bp, Unknown
  Ascusbbf_1811207, encodes 16S rRNA
agagtttgatcctggctcaggatgaacgctggcggcgtgcttaacacatgcaagtcgaacgaagccctcccctccgggggaggagactgagtggcggacgggtgagtaacgcgtgggtaacctgccctgtacagggggataacagccagaaatggctgctaataccgcatgagcgcacgaggaggcatctccttgtgtgaaaaactccggtggtacaggatgggcccgcgtctgattagccagttggcagggtaacggcctaccaaagcgacgatcagtagccggtctgagaggatgaacggccacattggaactgagacacggtccaaactcctacgggaggcagcagtggggaatattgcacaatgggggaaaccctgatgcagcaacgccgcgtgagtgaagaagtatctcgatatgtaaagctctatcagcagggaagatgttgacggtacctgactaagaagctccggctaaatacgtgccagca

SEQ ID NO: 4039 - DNA, 468 bp, Unknown
  Ascusbbf_1597956, encodes 16S rRNA
agagtttgatcatggctcagaacgaacgctggcggcaggcttaacacatgcaagtcgaacgcccacttcggtgggagtggcagacgggtgagtaacgcgtgggaacatgcccttcggtacggaataactcagggaaacttgtgctaataccgtatacgccccttgggggaaagatttatcgccgaaggattggcccgcgtctgattagctagttggtggggtaatggctcaccaaggcgacgatcagtagctggtctgagaggatgatcagccacactgggactgagacacggcccagactcctacgggaggcagcagtggggaatattggacaatgggcgaaagcctgatccagccatgccgcgagtgatgaaggccctagggttgtaaagctctttcgcctgggaagataatgacggtaccaggataagaagccccggctaacttcgtgccagcagccgcggtaat

SEQ ID NO: 4040 - DNA, 490 bp, Unknown
  Ascusbbf_1856394, encodes 16S rRNA
agagtttgatcctggctcaggatgaacgctggcggcacgcttaacacatgcaagtcgagcggagctttttcattgcgaagggagtagcttgctacgaacggagcaccgagggagcttagcggcggacgggtgagtaacacgtgggtaacctaccctatacagggggataacgtatagaaatgtacgctaaaaccgcataagcctacaggaccgcatggtgcggtaggaaaatcgttagaggtataggatgggcccgcgactgattagctggttggtgaggtaaaggctcaccaaggcaacgatcagtagccggtctgagaggatgaacggccacattgggactgagacacggcccagactcctacgggaggcagcagtggggaatattgcacaatgggggaaaccctgatgcagcgatgccgcgtgaaggacgaaggttttcggattgtaaacttctatcagcaaggaagaaaatgacagtacttgacta

SEQ ID NO: 4041 - DNA, 490 bp, Unknown
  Ascusbbf_1693907, encodes 16S rRNA
agagtttgatcctggctcaggatgaacgctagcggcaggcctaacacatgcaagtcgaggggtagaagcagcttgctgctttgagaccggcgcacgggtgcgtaacgcgtatgcaacctaccttatactgagggatagcccagagaaatttggattaatacctcatggtattattgaatggcatcatttgatgattaaagattacggtataagatgggcatgcgtcccattagttagttggtaaggtaacggcttaccaagacgatgatgggtaggggtcctgagagggagatcccccacactggtactgagacacggaccagactcctacgggaggcagcagtgaggaatattggtcaatggaggcaactctgaaccagccatgccgcgtgcaggaataaggtcctatggattgtaaactgcttttgtataggaagaaaccatcccttgcgagggatcttgacggtactatacgaataaggatcggcta

SEQ ID NO: 4042 - DNA, 490 bp, Unknown
  Ascusbbf_1390599, encodes 16S rRNA
agagtttgatcatgctcaggacgaacgctggcggcgtgcttaacacatgcaagtcgaacgaggtaccaggagagcttgctcgagagggaccgagtggcggacgggtgagtaacgcgtgagcaacctgtctcacacagggggataacgcatcgaaagatgtgctaataccgcgtaggaccacggaggggcatccctttgaggtgaaaggaggaatccggtgtgaggtgggctcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgaaagcctgacccagcaacgccgcgtgaaggaagaaggttttcggatcgtaaacttctgtccttgttgaagaggaagagacggtaggcaaggaggaagccccggctaactacgt

SEQ ID NO: 4043 - DNA, 346 bp, Unknown
  Ascusbbf_564823, encodes 16S rRNA
agagtttgatcctggctcagaacgaacgctggcggcaggcttaacacatgcaagttgaacgggatttgatggtagcttgctatcattaatgagagtagcgcactggtgagtaacacgtgggaacgtacattgtagtgggggacaacagctggaaacggttgctaataccgcataatccctgagggggaaagatttatcgctataatatcggcccgcggaagattaggtagttggtggggtaaaggcctaccaagcctacgatctatagctggtctgagaggacgatcagccacattggaactgagacacggtccagactcctacgggagccagcagccgcggtaat

SEQ ID NO: 4044 - DNA, 490 bp, Unknown
  Ascusbbf_596970, encodes 16S rRNA
agagtttgatcatggctcaggacgaacgctggcggcgtgcttaacacatgcaagtcgaacgctgaagccccagcttgctggggtggatgagtggcgaacgggtgagtaacacgtgagcaacctgcccttcactcttggataagcgctggaaacggtgtctaatactggatatgcatcatggtcgcatggcctgtggtgggaaagatttatcggtgaaggatgggctcgcggcctatcagcttgatggtggggtaatggctcaccatggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagcgaaagtgacggtacctgcagaaaaagcaccggctaactacgtgc

SEQ ID NO: 4045 - DNA, 490 bp, Unknown
  Ascusbbf_1598179, encodes 16S rRNA
agagtttgatcatggctcaggacgaacgctggcggcgtgcttaacacatgcaagtcgagcggtaaggcccttcggggtacacgagcggcgaacgggtgagtaacacgtgagcaatctgcccatcacttcgggataactccgggaaaccggagctaataccgaatatgaccacttcaggcatctgacggtggtggaaagttccggcggtgatggatgagctcgcggcctatcagcttgttggtggggtaacggcccaccaaggcttcgacgggtagccggcctgagagggtgaccggccacactgggactgagacacggcccagactcctacgggaggcagcagtggggaatattggacaatgggcgaaagcctgatccagcaacgccgcgtgagggatgacggccttcgggttgtaaacctctttcacccatgacgaagcgcaagtgacggtagtgggagaagaagcaccggccaactacgtgccagcag

SEQ ID NO: 4046 - DNA, 490 bp, Unknown
  Ascusbbf_818707, encodes 16S rRNA
ctcttttgctcctggctcaggacgaacgctggcggcgtgcttaacacatgcaagtcgaccgctgccgcccagcttgctgggtggaagagtggcgaacgggtgagtaacacgtgagtaacctgcccttgactctgggataagcgctggaaacggcgtctaatactggatacgagcagcctctgcatgggggttgttggaaagatttatcggttttggatggactcgcggcctatcagcttgttggtgaggtaatggctcaccaaggcgacgccgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcgtttagtagggaagaagcgcaagtgacggtacctacagaaaaagcaccggctaactacgtgccag

SEQ ID NO: 4047 - DNA, 490 bp, Unknown
  Ascusbbf_524388, encodes 16S rRNA
agagtttgatcatggctcaggatgaacgctagctacaggcttaacacatgcaagtcgaggggcagcgggaagtcagcttgctgactttgccggcgaccggcgcacgggtgagtaacgcgtatccaacctgcccccgggcagggcacagcccggcgaaagtcggattaatgccctatgctgtccgaagcggacatctaattcggacgaaaggttttttccgtccggggatggggatgcgtatgattagcttgccggcggggtaacggcccaccggggcgacgatcattaggggttctgagaggaaggtcccccacactggtactgagacacggaccagactcctacgggaggcagcagtgaggaatattggtcaatggccgggaggctgaaccagccaagtagcgtgcaggatgacggccctatgggttgtaaactgcttttatcaggggataaagtgacccacgtgtgggtttttgtaggtacctgatga

SEQ ID NO: 4048 - DNA, 490 bp, Unknown
  Ascusbbf_1407733, encodes 16S rRNA
agagtttgatcatggctcaggacgaacgctggcggcgtgcttaacacatgcaagtcgagcggtaaggcccttcggggtacacgagcggcgaacgggtgagtaacacgtgggtgacctgccctcagctctgggataagcctgggaaaccgggtctaataccggataggacctcggggcgcatgtcctggggtggaaagccagttgctttggtttctggcggttggggatgggcccgcggcctatcagcttgttggtggggtgatggcctaccaaggcggtgacgggtagccggcctgagagggcgaccggccacactgggactgagacacggcccagactcctacgggaggcagcagtggggaatattgcgcaatgggcggaagcctgacgcagcgacgccgcgtgggggatgacggccttcgggttgtaaacctctttcgccggggacgaagctttgtgtgacggtacctggagaagaagcaccggccaa

SEQ ID NO: 4049 - DNA, 490 bp, Unknown
  Ascusbbf_433653, encodes 16S rRNA
agagtttgatcctggctcaggatgaacgctagctacaggcttaacacatgcaagtcgaggggcagcatggcggtagcaataccgctgatggcgaccggcgcactggtgagtaacacgtatgcaacctgccccgcgcagggggataatccggagaaatctggtctaataccccgtacgccgcgcttccgcatgggagtgcggtgaaaggagcgatccggcgcgggatgggcatgcggcgcattagctagtcggcggggtgacggcccaccgaggcgacgatgcgtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttatatagggataaagtgacccacgtgtgggtttttgtaggtactatatgaata

SEQ ID NO: 4050 - DNA, 490 bp, Unknown
  Ascusbbf_871495, encodes 16S rRNA
agagtttgatcatggctcagattgaacgctggcggcatgcttaacacatgcaagtcgaacgggggaagtagcttgctattttcctagtggcggacgggtgagtaatgtataggaatctgccttggggtgggggataacgtagggaaacttacgctaataccacataacacttacgagtcaaagcgggggatcttcggacctcgcgcccttagatgagcctatatcggattagctagttggtgaggtaatggctcaccaaggcgacgatccgtagctggtttgagaggatgatcagccacatcgggactgagacacggcccgaactcctacgggaggcagcagtggggaatattggacaatgggggcaaccctgatccagcaatgccgcgtgtgtgaagaaggccttcgggttgtaaagcactttcgttagtgaagaaaggtttatggctaatacctatagatttgacattagctaaagaagaagcaccgg

SEQ ID NO: 4051 - DNA, 490 bp, Unknown
  Ascusbbf_1525333, encodes 16S rRNA
agagtttgatcctggctcagattgaacgctggcggcaggcctaacacatgcaagtcgagcggcagcacaagggagtttacttctgaggtggcgagcggcggacgggtgagtaatgcctagggatctgcccagtcgagggggataacagttggaaacgactgctaataccgcatacgccctacgggggaaaggaggggaccttcgggccttccgcgattggatgaacctaggtgggattagctagttggtgaggtaatggctcaccaaggcgacgatccctagctattctgagaggatgatcagccacactgggactgagacacggcccagactcctacgggaggcagcagtggggaatattgcacaatgggggaaaccctgatgcagccatgccgcgtgtgtgaagaaggccttcgggttgtaaagcactttcagtagggaggaaagggtaaggttcaatacgccttatctgtgacgttacctacagaag

SEQ ID NO: 4052 - DNA, 490 bp, Unknown
  Ascusbbf_897960, encodes 16S rRNA
agagtttgatcctggctcagaataaacgctggcggcgtgcctaacacatgcaagtcgagcgagaaaggccttcgggcttagtaaagcggcaaacgggtgagtaacgcgtaagaatctgcctttcagtgaggaataccttcgagaaattgaagttaatactgcatacgtccctacggggagaaagatggcctctttgctgtcgctgaaagatgagcttgcgtactattagctagttggtggggtaaaggcctaccaaggcgtagatagttagccggcttgagagggtgtacggccacactggaactgagatacggtccagacacctacgggaggcagcagtgaggaatattgcgcaatgggcgaaagcctgacgcagcgacgccgcgtggaggatgaaggtcttcggattgtaaacttctgttaagtgggaagaaatactctgttctaataaagcagggcgatgacggtaccattagagaaagcaccggct

SEQ ID NO: 4053 - DNA, 490 bp, Unknown
  Ascusbbf_1218147, encodes 16S rRNA
agagtttgatcatggctcaggatgaacgctagcggcaggcttaacacatgcaagtcgaggggtaaaaatagcttgctattttgagaccggcgcacgggtgcgtaacgcgtatgcaatctgccttttgcaaagggatagcccagagaaatttggattaataccttatagtatatgattttggcatcagtatcatattaaagatttatcggcaaaagatgagcatgcgtcccattagctagttggtaaggtaacggcttaccaaggctacgatgggtaggggtcctgagagggagatcccccacactggtgctgagacacggaccagactcctacgggaggcagcagtgaggaatattggacaatgggcgcaagcctgatccagccatgccgcgtgcaggatgaagcatctatggtgtgtaagctgcttttatacgggaagaaaccctggctcgtgagccagactgacggtaccgtaagaataaggaccggc

SEQ ID NO: 4054 - DNA, 490 bp, Unknown
  Ascusbbf_1599495, encodes 16S rRNA
agagtttgatcctggctcagaatgaacgctggcggcgtggattaggcatgcaagtcgaacggacattggggcttgctccaatgttagtggcgacctggtgattacaagttgggcaacctgcccggaagtggggaataactcctcgaaagaggggctaataccgcatgtggtttgggggtcttcggactttctaactaaagcagcgatgcgcttccggatgggcccgactcccattagcttgttggcggggtaatggcccaccaaggctacgatgggtagctggcttgagagagtggccagccacacgaggactgagatacggcctcgactcctacggggggcagcagtctagaggcttcggcaatgggggaaaccctgaccgagcgacgccgcgtggaggatgaaggccttcgggttgtaaactcctttcggccggaaggaaggcctgcatggtgaatgcgggattgaccgaccggcggaagaagccccg

SEQ ID NO: 4055 - DNA, 288 bp, Unknown
  Ascusbbf_1412864, encodes 16S rRNA
agagtttgatcctggctcaggtgtgaacccggttcaggctctggatctcggaactgattcacagggtacgtcagcattttttaaggataagcaaaatgtggtttaagaatctcagactataccgtctcgccgacaccttcagcactacggcggcagatcttgaaaaggccgtcgggcagaacagattcgagcactgcagcgggcagaacacctcctcaagcggatttgtctccccgttcggccacaggtcggagtcgctcgtgttcagcggccagcagccgcggtaat

SEQ ID NO: 4056 - DNA, 490 bp, Unknown
  Ascusbbf_1321708, encodes 16S rRNA
agagtttgatcctggctcaggataaacgctggcggcgcacataagacatgcaagtcgaacggacttaactcattcttaacgattgagagcggttagtggcggactggtgagtaatgtctaagtaacctgcctatcagaggggaacaaccgttggaaacgactgctaataccgcatatgccacgagaatcacattgttcaagtgggaaaggagcaatccgctgatagatggacttatatctgattagctagttggtggggtaacggcctaccaaggcgacgatcagtagccggactgggaggttaaacgacgacattgggaccgaggtacggcccagattcatacgagaggcagcaggcgggaagattgcgcaatggaggaaacgctgacgcagtgacgccgcgtgcaggaagaaggttttcggattgtaaactgctgtagacagggaagaaaaaagacagtacctgtagaataagctccggctaactacg

SEQ ID NO: 4057 - DNA, 490 bp, Unknown
  Ascusbbf_1378694, encodes 16S rRNA
agagtttgatcctggctcaggatgaacgctagcggcaggcttaacacatgcaagtcgaggggtaacgcggggtagcaatactctggcgacgaccggcgcacgggtgcgtcacgcgtatgcaacctacctgtaacaggggtataacggagagaaatttccactaatcccccatattgttagagattcgcatgtttctctaacgaaagcttcggtggttacggatgggcatgcgtgacatgagatagttggtacggtaacggcttaccaaggcgacgatgtctaggggagatgcgagccttatcacacacgctggtactgaggaccggaccagactcctacgggaggcagcagtggggaatattggtcaatggacggaagtctgaaccagccatgccgcgtggaggaagaaggtcctatgggttgtaaactccttttgttcgagagtaataagaggcttgcgagcctcgatgagagtatcggacgaataagc

SEQ ID NO: 4058 - DNA, 490 bp, Unknown
  Ascusbbf_1371959, encodes 16S rRNA
agagtttgatcctggctcaggatgaacgctagcggcaggcttaacgcatgcaagtcgaggggtaacgcggggtagcaatactctggcgacgaccggcgcacgggtgcgtaacgcgtatgcaacctacctgtaacaggggtataacggagagaaatttccactaattccccatattgttagagattcgcatgtttctctaacgaaagcttcggtggttacggatgggcatgcgtgacattagctagttggtaaggcaacggcttaacaaggcgacgttggctaggggagctgagaggcttatacccaaacctggtactgggacccggaccagattcctacgggaggcagcagtgaggaagagtggtcaatggacggaagtctgaaccagccatgccgcgtggaggaagaaggtcctatgggttgtaaactccttttgttcgagagtaataagaggcttgcgagcctcgatgagagtatcggacgaataagc

SEQ ID NO: 4059 - DNA, 472 bp, Unknown
  Ascusbbf_1342155, encodes 16S rRNA
agagtttgatcctggctcagagcgaacgctggcggcatgcttaacacatgcaagtcgcacgaaggtttcggccttagtggcggacgggtgagtaacgcataggaatctatccatgggtgggggataactctgggaaactggagctaataccgcatgatacctgatggtaaaaggcgcaagtcgcctgtggaggagcctgcgttcgattagcttgttggtggggtaatggcctaccaaggcgatgatcgatagctcgtctgagaggatgatcagccacactgggactgagacacggcccagactcctgcgggggacagcaatggggaatattggacaagggggacaacccagatccagcaatgccgcgtgtgtgaagaaggttttcggagtgtaaagcacttgcggcggggacgatgatgacggtacccgcagaagaagccccggctaactgcgtgccagcagccgcggtaat

SEQ ID NO: 4060 - DNA, 490 bp, Unknown
  Ascusbbf_125805, encodes 16S rRNA
agagtttgatcctggctcaggatgaacgctagctacaggcttaacacatgcaagtcgaggggcagcagggatctagcttgctagatttgctggcgaccggcgcacgggtgcgtaacacgtatccaacctacccatggcccggggatagccttccgaaaggaagattaatacccgatggtctcatttcaggacatcctgttatgagtaaagattcatcggcgttggatggggatgcgtccgattagcttgttggcggggcaacggcccaccaaggcttcgatcggtaggggctctgagaggggggtcccccacactggaactgagacacggtccagactcctacgggaggcagcagtgaggaatattggtcaatgggcgagagcctgaaccagccaagtagcgtgagggaggacggccctacgggttgtaaacctcttttgtttgggaataaagtgccgcacgtgtgcggttttgtatgtaccttacgaat

SEQ ID NO: 4061 - DNA, 331 bp, Unknown
  Ascusbbf_68018, encodes 16S rRNA
agagtttgatcctggctcaggatgaacgctagctacaggcttaacacatgcaagtcgaggggtaacggcccaccaagcccgcgatcagtaggggttctgagaggaaggtcccccacattggaactgagacacggtccaaactcctacgggaggcagcagtgaggaatattggtcaatgggcgagagcctgaaccagccaagtagcgtgcgggacgaaggccctatgggttgtaaaccgcttttacggggggataaagtgagtgacgtgtcattcattgcaggtaccccgcgaataaggaccggctaattccgtgccagcagccgcggtaat

SEQ ID NO: 4062 - DNA, 490 bp, Unknown
  Ascusbbf_723640, encodes 16S rRNA
agagtttgatcatggctcagattgaacgctggcggcaggcctaacacatgcaagtcgagcgcgaaagttcttcggaatgagtagagcggcggacgggtgagtaacgcgtgggaatctgcccagtagtgggggataacgttccgaaaggagcgctaataccgcatacgccctacgggggaaagggggggatcttcggacctctcgctattggatgagcccgcgtcggattagctagttggtagggtaatggcctaccaaggcgacgatccgtaactggtctgagaggatgatcagtcacactggaactgagacacggtccagactcctacgggaggcagcagtggggaatattggacaatgggggaaaccctgatccagccatgccgcgtgtgtgaagaaggccttagggttgtaaagcactttcagtggggagaaaggcttgttgattaatactcggcgagattgatgttacccacagaagaagcaccgg

SEQ ID NO: 4063 - DNA, 490 bp, Unknown
  Ascusbbf_662367, encodes 16S rRNA
agatttgatcctggctcaggatgaacgctggcggcgtgcttaacacatgcaagtcgaacggaaaggcctctagcttgctagaggtactcgagtggcgaacgggtgagtaacacgtgggtgatctgccctgcactgtgggataagcctgggaaactgggtctaataccatataggaccgcactttggatggtgtggtggaaagcttttgcggtgtgggatgagcctgcggcctatcagcttgttggtggggtaatggcctaccaaggcggcgacaggtatccggcctgagagggtgtacggacacattgggactgagatacggcccagactcctacgggaggcagcagtggggaatattgcacaatgggcgcaagcctgatgcagcgacgccgcgtgggggatgaaggccttcgggttgtaaactcctttcgctgtcgacgaagccacttgtggtgacggtaggtagataagaagcaccggctaactacgt

SEQ ID NO: 4064 - DNA, 490 bp, Unknown
  Ascusbbf_179773, encodes 16S rRNA
agagtttgatcatggctcaggatgaacgctggcggcgtgcctaacacatgcaagtcgaacggttaaaccggcttcggccggatatagagtggcgaacgggtgagtaacacgtgaccaacctgccccccgctccgggataacccagggaaacctgcgctaataccggacgatgccgcaagggcgcatgccctcgcggccgaagcccaggcggcgggggatggggtcgcggcccattaggtagacggcggggtaacggcccaccgtgcccgcgatgggtagccgggctgagaggctgatcggccacattgggactgagatacggcccagactcctacgggaggcagcagtggggaattttgcgcaatgggggcaaccctgacgcagcaacgccgcgtgcgggacgaaggccttcgggttgtaaaccgctttcagcggggacgattatgacggtacccgcagaagaagctccggctaactacgtgccagcagc

SEQ ID NO: 4065 - DNA, 490 bp, Unknown
  Ascusbbf_1686186, encodes 16S rRNA
agagtttgatcctggctcagattgaacgctagcgggatgctttacacatgcaagtcgaacggcagcgcggacttcggtctggcggcgagtggcggacgggtgagtaatgtatcggaacgtgcccagtagcgggggataactacgcgaaagcgtagctaataccgcatacgccctacgggggaaagggggggattcttcggaacctctcactattggagcggccaatatcggattagctagttggtggggtaaaggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttgtcagggaagaaacagcacaggctaatatcctgtgcgaatgacggtacctgaagaataagc

SEQ ID NO: 4066 - DNA, 490 bp, Unknown
  Ascusbbf_1712731, encodes 16S rRNA
agagtttgatcctggctcaggacgaacgctggcggcgtgcctaacacatgcaagtcgaacgagaatctatggaaggagttttcggacaacggaaatagaggacagtggcggacgggtgagtaacgcgtgagcaacctgcccttcagagggggacaacagagggaaacttctgctaataccgcatgacatcccggggaggcatcttcctgggatcaaagatttgtcgctgagggatgggctcgcgtctgattagctagttggtgaggtaacggctcaccaaggcgacgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttatcagggacgaaggatgtgacggtacctgatgaataagccacgg

SEQ ID NO: 4067 - DNA, 490 bp, Unknown
  Ascusbbf_1467921, encodes 16S rRNA
agagtttgatcctggctcaggataaacgctggcggcgcgcataacacatgcaagtcgagcgagaggagtgacttcggtcacaaatctagcggcggacgggtgagtataatatgaacaacctgccttacagagggggatagccggaagaaatttcgattaataccgcatattttaagatagtcgcatgattattttaagaaagtccgaaaggacgctgtaagaggggtttgtatccgattagctagttggagtggtaacggcacaccaaggcgacgatcggtagctggttcgagaggatgtacagccacattgggactgagatacggcccagactcctacgggaggcagcagtggggaatattgcgcaatggaggaaactctgacgcagcgacgccgtgtaaaggaagaaggtcttcggatcgtaaacttatatcgattatgaaaagtaaggatggtaataaagtaagaagccccggctaactacgtgcca

SEQ ID NO: 4068 - DNA, 490 bp, Unknown
  Ascusbbf_345145, encodes 16S rRNA
agagtttgatcatggctcaggatgaacgctggcggcgtgcttaacacatgcaagtcgaacgaatttctttcgaagtgcggcttcggccaagcgacgaatgaagtgagtggcggacgggtgagtaacgcgtgggtaacctgccttacactgggggataacgattggaaacgatcgctaataccgcataagaccacggtgccgcatggcacaggggtaaaagaatttcgatgtaagatggacccgcgtctgattaggcagttggcgaggtaacggctcaccaaaccgacgatcagtagccgacctgagagggtgatcggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagacaatgacggtacctgactaagaagctccggct

SEQ ID NO: 4069 - DNA, 490 bp, Unknown
  Ascusbbf_643932, encodes 16S rRNA
agagtttgatcctggctcaggacgaacgctggcggcgtgcctaacacatgcaagtcgaacggagttaagacttcggttttaacttagtggcgaacgggtgagtaacgcgtgagaaacctacctttcagtgggggacaacagttggaaacgactgctaataccgcataatgttatttgggggcatccctgaataaccaaagatttattgctgaaagatggtctcgcgtctgattagctagttggtgaggtaacggctcaccaaggcgacgatcagtagccggtctgagaggatgaacggccacattgggactgagatacggcccagactcctacgggaggcagcagtggggaatattgggcaatgggggaaaccctgacccagcaacgccgcgtgaaggaagaaggccttcgggttgtaaacttcttttaccagggacgaaaaaagtgacggtacctggagaaaaagcaacggctaactacgtgccagcag

SEQ ID NO: 4070 - DNA, 490 bp, Unknown
  Ascusbbf_1571879, encodes 16S rRNA
agagtttgatcatggctcagattgaacgctggcggcatgctttacacatgcaagtcgaacggcagcacgggtgcttgcacctggtggcgagtggcgaacgggtgagtaatacatcggaacgtgcctggtagtgggggataactgctcgaaagagcagctaataccgcatgagatctaaggatgaaagcaggggaccttcgggccttgtgctaccagagcggctgatggcagattaggtagttggtggggtaaaggcttaccaagcctgcgatctgtagctggtctgagaggacgaccagccacactgggactgagacacggcccagactcctacgggaggcagcagtggggaattttggacaatgggcgcaagcctgatccagcaatgccgcgtgcaggatgaaggcctttgggttgtaaactgcttttgtacggaacgaaaagtacttctctaatacagaggtgcgatgacggtaccgtaagaataagc

SEQ ID NO: 4071 - DNA, 486 bp, Unknown
  Ascusbbf_657817, encodes 16S rRNA
agagtttgatcctggctcagaacgaacgctggcggcatgcttaacacatgcaagtcgaacggtaatgtatagtacttgtattatatattatagtggcaaacgggtgagtaacgcgtggggacgtacccttcagtaatgaataacggatggaaacgtacgctaatacattatagaattgagagatgaaagagagatcgctgagggagcggcccgcgttagattaggtagttagtggggtaaaggcctaccaagccgatgatctatagctggtctgagaggatgatcagccacattgggactgagatacggcccagactcctacgggaggcagcagtggggaatattggacaatgggggaaaccctgatccagcgatgccgcgtgagtgaagaaggccttcgggttgtaaagctcttttataagtggagataatgacggtaacttatgaataagctccggcaaacttcgtgccagcagccgcggtaat

SEQ ID NO: 4072 - DNA, 490 bp, Unknown
  Ascusbbf_716829, encodes 16S rRNA
agagtttgatcatggctcaggacgaacgctggcggcatgcctaacacatgcaagtcgaacgggactcttaacgaccgaggcttcggccaagtgaattatgagtttagtggcggacgggtgagtaacgcgtgagcaacctgcctttcagagggggacaacagttggaaacgactgctaataccgcatgacatacagagggggcatcctttctgtatcaaagatttatcgctgaaagatgggctcgcgtctgattagatagttggcggggcaacggcccaccaagtcgacgatcagtagccggactgagaggttgaacggccacattgggactgagatacggcccagactcctacgggaggcagcagtggggaatattggtcaatgggggcaaccctgaaccagcaatgccgcgtgaaggaagaaggccttcgggttgtaaacttctttgacgagggacgataatgacggtacctcgaaaacaagccacggc

SEQ ID NO: 4073 - DNA, 490 bp, Unknown
  Ascusbbf_853732, encodes 16S rRNA
agagtttgatcatggctcaggatgaacgctggcggcgtgcctaatacatgcaagtcgaacgcactagtttactagtgagtggcgaacgggtgagtaacacgtgggtaacctgcccttaagacgaggataaccattggaaacgatggctaagactggataggaatatttgaggcatcttaaatattttaaaagacctagcaataggtatgcttaaggaggggcctgcggcgcattagttagttggtgaggtgagagctcaccaagacgatgatgcgtagccggactgagaggttgaacggccacattgggactgagaaacggcccaaactcctacgggaggcagcagtagggaattttcggcaatggaggaaactctgaccgagcaacgccgcgtgaatgacgaagtacttcggtatgtaaagttcttttatcagggaagaatgggcagtggaaaaactgttttgacggtacctgatgaataagccccggc

SEQ ID NO: 4074 - DNA, 490 bp, Unknown
  Ascusbbf_1562959, encodes 16S rRNA
agagtttgatcctggctcagaacgaacgctggcggcatgcctaacacatgcaagtcgaacggtaaggccccttcgggggtacacgagtggcgaacgggtgagtaacacgtgggtaacctgcccttcactgggggataaccgagggaaacctcggctaataccgcataatgtgctttctcataagtgaaagcaccaaaactccggtggtgaaggatgggcccgcggcagattagctagttggtggggtaaaggcctaccaaggcaacgatctgtagctggtttgagaggacgatcagccacactgggactgagacacggcccagactcctacgggaggcagcagtggggaatcttgcgcaatgggcgaaagcctgacgcagcaatgccgcgtgagggacgaaggtcttaggatcgtaaacctctttcagtagggacgaaaacagacggtacctacagaagaagccccggctaactacgtgccagcagccgc

SEQ ID NO: 4075 - DNA, 469 bp, Unknown
  Ascusbbf_671740, encodes 16S rRNA
agagtttgatcatggctcagaacgaacgctggcggcaggcctaacacatgcaagtcgagcgcccccttcggggggagcggcagacgggtgagtaacgcgtgggaacctacccagtggtacggaataactcggggaaacccgtgctaataccgtatacgcccttcgggggaaagatttatcgccattggatgggcccgcgtctgattagcttgttggtgaggtaacggctcaccaaggcgacgatcagtagctggtctagaggatgatcagccacactgggactgagacacggcccagactcctacgggaggcagcagtggggaatattggacaatgggcgaaagcctgatccagccatgccgcgtgagtgaagaaggccttagggttgtaaagctctttcaccagggaagataatgacggtacctggagaagaagccccggctaactccgtgccagcagccgcggtaat

SEQ ID NO: 4076 - DNA, 490 bp, Unknown
  Ascusbbf_1612974, encodes 16S rRNA
agagtttgatcctggctcagagtgaacgctggcggcgtgcttaacacatgcaagtcgaacggatgaaataagcttgcttatttcgttagtggcgcacgggtgagtaatgtatagttaacctgccctttagtgggggacaacagttggaaacgactgctaataccccatattccttcttatcataaggtaagttgggaaagatttattgctaaaggatggggctttatggtatcagctagttggtggggtaacggcctaccaaggctatgacgcctacctggtctgagaggatgatcaggcacactggaactgagacacggtccagactcctacgggaggcagcagtggggaatattgcacaatggaggaaactctgatgcagcaacgccgcgtggaggatgacgcatttcggtgtgtaaactccttttataagggaagataatgacggtaccttatgaataagcaccggctaactccgtgccagcagccg

SEQ ID NO: 4077 - DNA, 484 bp, Unknown
  Ascusbbf_1666542, encodes 16S rRNA
agagtttgatcatggctcagaacgaacgctggcggcaggcttaacacatgcaagtcgagcgaggacttcggtcctagcggcggacgggtgagtaacgcgtgggaacgtgcccctttcttcggaatagcctcgggaaactgggagtaatgccgaatacgccggatcatcgcgagatggtttgggaaagatttatcggagagggatcggcccgcgttggattaggtagttggtggggtaatggcctaccaagccgacgatccatagctggtttgagaggatgatcagccacactgggactgagacacggcccagactcctacgggaggcagcagtggggaatcttggacaatgggggaaaccctgatccagccatgccgcgtgaacgatgaaggccttagggttgtaaagttctttcagcggggaagataatgactgtacccgcagaagaagccccggctaactccgtgccagcagccgcggtaat

SEQ ID NO: 4078 - DNA, 490 bp, Unknown
  Ascusbbf_1090563, encodes 16S rRNA
agagtttgatcctggctcaggacgaacgctggcggcgtgcttaacacatgcaagtcgaacggacgcggaggagcttgctcctccaagttagtggcgaacgggtgagtaacgcgtgagcaacctgaccttcagagggggataacatctggaaacaggtgctaataccgcatgagaccacagcaccgcatggtaaaggggtcaaaggagcaatccgctgaaggaggggctcgcgttccattagatagttggtgaggtaacggcccaccaagtcgacgatgggtagccgagctgagaggctgatcggccacactggaactgagacacggtccagactcctacgggaggcagcagtggggaatattgggcaatgggcgaaagcctgacccagcaacgccgcgtgagggaagaaggtcttcggattgtaaatctctgtcgcaggggacgaaggaagtgacggtaccctgtgaggaagccccggctaactacgtgc

SEQ ID NO: 4079 - DNA, 490 bp, Unknown
  Ascusbbf_1495340, encodes 16S rRNA
agagtttgatcctggctcaggataaacgctggcggcgcacataagacatgcaagtcgaacggaagccgttataaatgaaacggattgaagatttatcagattgaagtagattttataacaatgactttagtggcggactggtgagtaacgcgtgagcaacctgcctattagaggggaataacagtgagaaatcattgctaataccgcataagcttgtaggaatgcatgttctagcaagaaaaggagaaatccgctaatagatgggctcgcgtctgattagctagttggtgtggtaacggcataccaaggcaacgatcagtagccgagctgagaggctctacggccacattgggactgagatacggcccagactcctacgggaggcagcagtcgggaatattgcgcaatggaggaaactctgacgcagtgacgccgcgtataggaagaaggttttaggattgtaaactattttagacagggaagagaaaag

SEQ ID NO: 4080 - DNA, 488 bp, Unknown
  Ascusbbf_402683, encodes 16S rRNA
agagtttgatcctggctcaggacgaacgctggcggcgtgcttaacacatgcaagtcgagcgggaaacttcggtttccagcggcggacgggtgagtaacacgtgggcaacctgcctcacaataggggatagccctccgaaaggaggattaataccctataacacaaggaaaacgcatgttttctttgccaaagaatttcgttgtgagatgggcccgcggcgcattagcttgttggtgaggtaacggctcaccaaggcttcgatgcgtagccgacctgagagggtgatcggccacattggaactgagacacggtccagactcctacgggaggcagcagtggggaatattgcacaatggaggaaactctgatgcagcaacgccgcgtgagtgatgaaggtcttcggattgtaaaactctgtcttatgggacgataatgacggtaccataggaggaagccacggctaactacgtgccagcagccgcggtaat

SEQ ID NO: 4081 - DNA, 488 bp, Unknown
  Ascusbbf_1511520, encodes 16S rRNA
agagtttgatcatggctcaggacgaacgctggcggcgttcctaatacatgcaagtcgagcgggtgcagcaatgcatcagcggcggacgggtgagtaacgcgtgggcaatctgccctctagcctgggataatagttcgaaaggactgctaacaccggatatgctcactagggagacatctcccggtgaggaaagtttacactagaggatgagcccgcgtcccattagctagttggtgaggtaacggcccaccaaggcgacgatgggtagccgacctgagagggtgatcggccacactgggactgagacacggcccagactcctacgggaggcagcagtagggaattttccgcaatgggcgcaagcctgacggagcaacgccgcgtgagggatgaaggttttcggatcgtaaacctctgtcttcagggacgataatgacggtacctgaggaggaagccacggctaactacgtgccagcagccgcggtaat

SEQ ID NO: 4082 - DNA, 488 bp, Unknown
  Ascusbbf_1272452, encodes 16S rRNA
agagtttgatcctggctcagggctaacgctggcggcgcgcctaacacatgcaagtcgaacgggcacttcggtgctagtggcagacgggtgagtaacgcgtgagcaacgtgccttctttctggggataccgtttggaaacgaacgttaataccgaatgtgcccatactgtggcatcgcagtatgtgtaaactattagggagaggagagcggctcgcgttctatcagctagatggtggggtaatggcctaccatggctacgacggataactggtctgagaggatgatcagtcacactggaactgagacacggtccagactcctacgggaggcagcagtgaggaatcttgcacaatgggcgaaagcctgatgcagcgacgccgcgtgagggacgaaggccttcgggttgtaaatctctgtcagtggggaagaagaatgacggtacccactgaggaagcttcggctaactacgtgccagcagccgcggtaat

SEQ ID NO: 4083 - DNA, 490 bp, Unknown
  Ascusbbf_919857, encodes 16S rRNA
agagtttgatcctggctcaggacgaacgctggcggtgtgcctaatacatgcaagtagaacgctgaagaggagcttgctccttggatgagttgcgaacgggtgagtaacgcgtaggtaacctaccttatagcgggggataactattggaaacgatagctaataccgcataacaatgattgccgcatggcagtgatttgaaaggcgcaattgcgtcactatgagatggacctgcgttgtattagctagttggtgaggtaagggctcaccaaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagtcaagaatagatgtgagagtggaaagttcacattatgacggtagcttacc

SEQ ID NO: 4084 - DNA, 490 bp, Unknown
  Ascusbbf_451673, encodes 16S rRNA
agagtttgatcatggctcaggacgaacgctggcggcgtgcttaacacatgcaagtcgagcggtaaggctccttcgggagtacacgagcggcgaacgggtgagtaacacgtgagtaatctacccttcacatcggaataaccccgggaaactggggctaataccggatatcacagcggatggcatcattcgctgttgaaagctccggcggtgagggatgagctcgcggcctatcagctagttggtgaggtaacggcccaccaaggcgacgacgggtagccggcctgagagggtgaccggccacactgggactgagacacggcccagactcctacgggaggcagcagtggggaatattggacaatgggcggaagcctgatccagcaacgccgcgtgagggatgacggccttcgggttgtaaacctctttcagcagggacgaagcgaaagtgacggtacctgcagaagaagcaccggccaactacgtgccagca

SEQ ID NO: 4085 - DNA, 490 bp, Unknown
  Ascusbbf_1244574, encodes 16S rRNA
agagtttgatcctggctcaggatgaacgctggcggcgtgcctaatacatgcaagtcgaacgaagcacttcggtgcttagtggcgaacgggtgagtaacacgtaggtaacctaccctatagtttggaataacagttggaaacgactgctaataccaaatgagtaacaagaaggcatcttctagttataaaagatcctcatgggatcgctatgggaggggcctgcggcgcattagttagttggtgaggtaaaggctcaccaagacagtgatgcgtagccggactgagaggttgaacggccacactgggactgagacacggcccagacacctacgggaggcagcagtagggaattttcggcaatgggggaaaccctgaccgagcaacgccgcatgaacgaagaagcacctaggtgtgtaaagttcttttataagggaagaatggctaatgtaggaaatgacattagaatgacggtaccttttgaataagcccc

SEQ ID NO: 4086 - DNA, 490 bp, Unknown
  Ascusbbf_702399, encodes 16S rRNA
agagtttgatcatggctcagaatgaacgctggcggcgtgcctaacacatgcaagtcgagcgagaaagatcttcggatcgagtacagcggcggacgggtgagtaacgcgtgagaatctgcctttcagtgaagaatactctcgagaaatcgaggttaatgctgcatacgtctcgaaagagagaaagatggcctcttgctgtcgctgaaagatgagcttgcgtactattagctagttggtggggtaaaggcctaccaaggcgatgatggttagccggcctgagagggtgtacggccacattggaactgagacacggtccagactcctacgggaggcagcagtggggaatattgcgcaatgggcgaaagcctgacgcagcgacgccgcgtggaggatgaaggtcttcggatcgtaaactcctgttaagtgggaggaaagaacgagctttaatacagctcggtgatgactgtaccattagagaaagcaccggcta

SEQ ID NO: 4087 - DNA, 490 bp, Unknown
  Ascusbbf_1633652, encodes 16S rRNA
gagtttgatcatggctcaggatgaacgctagcggcaggcttaacacatgcaagtcgaggggtaacgcgaggtagcaatactttggcgacgaccggcgcacgggtgcgtaacgcgtatgcaacctacctgtagcagggggataacggagagaaatttccactaataccccattttgtcattccttcgcatgttgggatgacgaaagcttcggtggttacggatgggcatgcgtgacattagctagttggcggggcaacggcccaccaaggcgacgatgtctaggggagctgagaggcttatcccccacacaggtactgagacacggaccagactcctacgggaggcagcagtgaggaatattggtcaatggacggaagtctgaaccagccatgccgcgtggatgaagaaggtcctatgggttgtaaactccttttgttcgagagtaataagtgggatgcgtcccacgatgagagtatcggacgaataagca

SEQ ID NO: 4088 - DNA, 470 bp, Unknown
  Ascusbbf_1419765, encodes 16S rRNA
agagtttgatcctggctcagaacgaacgctggcggcaggcttaacacatgcaagtcgaacgcattcttcggaatgagtggcagacgggtgagtaacgcgtgggaacgtacctttcagttcggaataacccagggaaacttgggctaataccggatacgcccgagaggggaaagatttattgctgagagatcggcccgcgtctgattagctagttggtggggtaaaggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgacggcctcagggttgtaaagctctttcgcacgcgacgataatgacggtagcgtgagaagaagccccggctaacttcgtgccagcagccgcggtaat

SEQ ID NO: 4089 - DNA, 471 bp, Unknown
  Ascusbbf_1568733, encodes 16S rRNA
agagttgatcatggctcaggataaacgttggcggcgtgcctaatgcatgcaagtcgcacggagcttcggctcagtggcggacgggtgagtaacacgtaggaacctgcccagaagtgggggataactcctcgaaagaggagctaataccgcatgtggtctacggaccaaagcagcaatgcgcttctggaggggcctgcggtggattagctagttggtggggtaatggcctaccaaggcgacgatccatagctggtctgagaggacggccagccacactgggactgagacacggcccagactcctacgggaggcagcagcaaggaattttccgcaatcgacgcaagtcggacggagcaacgccgcgtgcgggaagacggccttcgggttgtaaaccgcttttgtgagggaagaagatctgacggtacctcacgaataagtcacggctaactacgtgccagcagccgcggtaat

SEQ ID NO: 4090 - DNA, 490 bp, Unknown
  Ascusbbf_1124549, encodes 16S rRNA
agagtttgatcatggctcagaacgaacgctggcggcgtgcctaacacatgcaagtcgaacggaagtagcaatactttagtggcgcacgggtgagtaacgcatgggtaacctgccctatggattgggatagctacgcgaaagtgtaggtaataccggataagctgaagtgattttttcatttcaggaaaggctagccgcaaggccggcgccaaaggatgggctcatgtcctattagctagttggtggggtaacggcccaccaggcgaagatgggtaactggtctgagaggacgatcagtcacactggaactgagacacggtccagactcctacgggaggcagcagtggggaatattgcacaatgggggaaaccctgatgcagcaacgccgcgtgagtgatgaaggccttcgggttgtaaagctctttcggctgggaagaagggtcatttggtgaatagccaggtgacttgatggtaccagaagaagaagca

SEQ ID NO: 4091 - DNA, 490 bp, Unknown
  Ascusbbf_604027, encodes 16S rRNA
agagtttgatcctggctcaggatgaacgctagctacaggcttaacacatgcaagtcgaggggcagcataacgaaagcttgcttttgttgatggcgaccggcgcacgggtgagtaacgcgtatccaaccttccccttagtagggcatagcccggcgaaagtcggattaataccctatgttatccgtcgaggacatctgaagtggattaaagatttatcgctaagggatggggatgcgtctgattaggttgttggcggggtaacggcccaccaagccatcgatcagtaggggttctgagaggaaggtcccccacattggtactgagacacggaccaaactcctacgggaggcagcagtgaggaatattggtcaatgggcgagagcctgaaccagccaagtagcgtgcaggatgacggccctatgggttgtaaaccgcttttgagtgagagcaataaggatcatgagtggtccgatgagagtatcattcgaat

SEQ ID NO: 4092 - DNA, 490 bp, Unknown
  Ascusbbf_1587439, encodes 16S rRNA
agagtttgatcctgcctcaggataaacgctggcggcgtgcctaatgcatgcaagtcgaacgggaagcccttcggggctcgaccgtggcggacgggtgaggagcacgtagctaacctgccctggtgtgggggatatccttcggaaacggagtgtaataccgcatgtgctcagttgaggggacttgactgaggaaagccgagaggcgtaccaggagggggctgcgtccgattagctagttggtgtggtaatggcgcaccaaggcgatgatcggtcgctggtctgagaggacgatcagccacacggggactgagacacggccccgactcctacgggaggcagcagcaaggaattttccacaatgggcgcaagcctgatggagcaacgctgcgtgcgggatgacgcccttcggggtgtaaaccgcttttcgaggggacgaaggcaatgacggtaccctcggaataaggatcggctaactacgtgccagcagctg

SEQ ID NO: 4093 - DNA, 490 bp, Unknown
  Ascusbbf_1566511, encodes 16S rRNA
agagtttgatcctggctcaggatgaacgctagcggcaggcctaatacatgcaagtcgaacgagatcaagagcttcggttcttggtttagtggcgcacgggtgcgtaacgcgtatgcaacctaccttccacagggggatagcccaccgaaaggtggattaataccgcataacacgaatgggtggcatcacctgctcgccaaagatttatcggtggtagatgggcatgcgtgccattagttagttggtagggtaacggcctaccaagacttcgatggctaggggttctgagaggatggtcccccacactggtactgagacacggaccagactcctacgggaggcagcagtagggaatattgggcaatggaagagattctgacccagccatgccgcgtgcaggaagaaggccttctgggttgtaaactgcttttatctgggaagaaaacgcccctgcgggggtaactgacggtaccagatgaataagcaccgg

SEQ ID NO: 4094 - DNA, 472 bp, Unknown
  Ascusbbf_565566, encodes 16S rRNA
agagtttgatcatggctcagaacgaacgctggcggcaggcttaatacatgcaagtcgaacggttgtagcaatacagcagtggcagacgggtgagtaacacgtgggaacctacctaggggtacggaataactcagggaaacttgtgctaataccgtatacgacctcagggtgaaagatttatcgcccctagatgggcccgcgttggattagctagttggtgaggtaaaagctcaccaaggcgacgatccatagctggtctgagaggatgatcagccacactgggactgagacacggcccagactcctacgggaggcagcagtagggaatcttggacaatgggcgaaagcctgatccagccatgccgcgtgagtgatgaaggccttagggttgtaaagctctttcgccagggaagataatgacggtacctggataagaagccccggctaacttcgtgccagcagccgcggtaat

SEQ ID NO: 4095 - DNA, 490 bp, Unknown
  Ascusbbf_1509420, encodes 16S rRNA
agagtttgatcatggctcaggatgaacgctggcggcgtgcctaatacatgcaagtcgaacgcactagtttactagtgagtggcgaacgggtgagtaacacgtgggtaatctacccttaagacgaggataacagttggaaacggctgctaatactggataggtatatttgaggcatcttgaatatattaaagatttatcgcttaaggaggagcctgcggcgcattagttagttggtggggtaaaagcctaccaagacgatgatgcgtagccggactgagaggttgaacggccacattggaactgagaaacggtccaaactcctacgggaggcagcagtagggaattttcggcaatggggggaaccctgaccgagcaacgccgcgtgattgaagaagctcttcggagcgtaaagatcttttattggggaagaaaaaaatgacggtacccaatgaataagccccggctaactatgtgccagcagccgcggtaa

SEQ ID NO: 4096 - DNA, 487 bp, Unknown
  Ascusbbf_510303, encodes 16S rRNA
agagtttgatcctggctcaggatgaatgctggcggcgtgtctaaggcatgcaagtcgaatgtctagtttactaggcatggcaaacgggagagtaacacattgataacttaccctgaagacggggataaccttgcgaaagcgagaataatacccgatagtatgtaatcacaaaagtgattccattaaagttccggcgcttcaggagaggtctatggcctatcagcttgttggtgaggtaatagctcaccaaggcaacgacgggtatcgggcgcgagagcgtgatccgactcactgggactgagaaactgcccagactcctacgggaggctgcagtcaagaatcttcctcaatggacgaaagtctgaaggagcgacgccgcgtgtatgaagaagcctttcggggtgtaaagtacttttaactgtgaaaaaacaatgatggtaacagttgaataaggggctgctaacctcgtgccagcagccgcggtaat

SEQ ID NO: 4097 - DNA, 484 bp, Unknown
  Ascusbbf_490557, encodes 16S rRNA
agagtttgatcctggctcagaacgaacgctggcggcaggcttaacacatgcaagtcgagcgctcccttcggggagagcggcggacgggtgagtaacgcgtgggaatatgcccgaaggtacggaataaccgctggaaacggcgactaatgccgtatgtgccctgccatggagacatggtgggggaaagatttatcgccttcggattggcccgcgtcggattaggtagttggtggggtaatggccttccaagccgacgatccgtagctggtttgagaggatgatcagccacactgggactgagacacggcccagactcctacgggaggcagcagtggggaatcttggacaatgggggcaaccctgatccagccatgccgcgtgagcgaagaaggccttagggttgtaaagctctttcacccgcgaagataatgacggtagcgggagaagaagccccggctaactccgtgccagcagccgcggtaat

SEQ ID NO: 4098 - DNA, 490 bp, Unknown
  Ascusbbf_1598128, encodes 16S rRNA
agagtttgtctggctcaggacgaacgctggcggcgtgcctaatacatgcaagtcgagcgaactctttaaaagcttgcttttgaagagttagcggcggacgggtgagtaacacgtgggcaacctgcctataagactgggataacttcgggaaaccggagctaataccggataattcttttctactcatgtagaaaagctgaaagacggtttacgctgtcacttatagaagggcccgcggcgcattagctagttggtgaggtaacggctcaccaaggccacgatgcgtagccgacctgagagggtgatcggccacactgggactgagacacggcccagacacctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtaccta

SEQ ID NO: 4099 - DNA, 490 bp, Unknown
  Ascusbbf_565492, encodes 16S rRNA
agagtttgatcctggctcaggacgaacgctggcggcgtgcttaacacatgcaagtcgaacggtgttcaggatgtagtaatacagcctgaacatagtggcggacgggtgagtaacgcgtgaggaacctgccttaaagagggggacaacattcggaaacggatgctaatatcgcataagaccccagtgccgcatggcacagaggtcaaaggagcaatctactttaagatggactcgcgtcccattagctagttggtgagataaaggctcaccaaggcaacgatgggtagccgacctgagagggtgatcggccacactggaactgagatacggtccagactcctacgggaggcagcagtggggaatattgggcaatgggcgaaagcctgacccagcaacgccgcgtgaaggaagaagatcttcggattgtaaacatctgtcctatgggaagaagaagtgacggtaccataggaggaagccccggctaactacg

SEQ ID NO: 4100 - DNA, 485 bp, Unknown
  Ascusbbf_407258, encodes 16S rRNA
agagtttgatcctggctcagaatgaacgctggcggtatgcttaacacatgcaagtcgaacgaattctcctggagcttgcttcaggaaagttagtggcaaacgggtgagtaacacgtgggaatctacctatcagtacggaataacatttggaaacaaatgctaataccgtataccctctaaggaggaaagatttatcgctgatagatgagcccgcgcaagattaggtagttggtagggtaatggcctaccaagtctatgatcttagctgatttgagaggatgatcagccacgctgggactgagacacggcccagactcctacgggaggcagcagtggggaatattggacaatgggcgaaagcctgatccagcaataccgcgtgaacgatgaaggccttagggttgtaaagttcttttagtagggaagataatgacggtacctacagaaaaagccccggctaactccgtgccagcagccgcggtaat

SEQ ID NO: 4101 - DNA, 490 bp, Unknown
  Ascusbbf_1683602, encodes 16S rRNA
agagtttgatcctggtcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggcaacgatgcatagccgacctgagagggtgaccggccacattgggactgagacacggcccagactcctacgggaggcagcagtggggaatattgcacaatggaggaaactctgatgcagcgacgccgcgtgagtgaagaagtatttcggtatgtaaagctctatcagcagggaagaagacgacggtacctgactaagaagccccggc

SEQ ID NO: 4102 - DNA, 490 bp, Unknown
  Ascusbbf_898661, encodes 16S rRNA
agagtttgatcatggctcaggacgaacgctggcggcgtgcctaacacatgcaagtcgaacggagctgcttggatcgagacttcggtcaagtgaattgcagcttagtggcgaacgggtgagtaacgcgtgagcaacctgcctttcagagggggacaacagttggaaacgactgctaataccgcataatacaggatgggggcatccccgacctgtcaaagatttatcgctgaaagatgggctcgcgtctgattagctagttggtggggtaacggcccaccaaggcgacgatcagtagccggactgagaggttgaacggccacattgggactgagatacggcccagactcctacgggaggcagcagtggggaatattgggcaatgggggaaaccctgacccagcaacgccgcgtgaaggaagaaggccttcgggttgtaaacttcttttaccagggacgaagacgtgacggtacctggagaaaaagccacggc

SEQ ID NO: 4103 - DNA, 490 bp, Unknown
  Ascusbbf_1457960, encodes 16S rRNA
agagtttgatcctggctcaggacgaacgctggcggcgtgcctaacacatgcaagtcgaacggagaacatttagcaataggtgttcttagtggcggacgggtgagtaacgcgtgagcaatctgcccttcggagggggacaacagctggaaacggctgctaataccgcataatgtatataggtggcatcatcgatataccaaagattcatcgccgaaggatgagctcgcgtctgattagctagttggtagggtaatggcctaccaaggctgcgatcagtagccggactgagaggttgaacggccacattgggactgagatacggcccagactcctacgggaggcagcagtggggaatattgggcaatgggggaaaccctgacccagcaacgccgcgtgaaggaagaaggctttcgggttgtaaacttctttgacgagggaagaaagaaatgacggtacctcgaaaacaagccacggctaactacgtgccagc

SEQ ID NO: 4104 - DNA, 490 bp, Unknown
  Ascusbbf_1586521, encodes 16S rRNA
agagtttgatcctggctcaggacgaacgctggcggcgcgcttaacacatgcaagtcgagcgagaaccagtccttcgggactggggacagcggcgaacgggtgagtaacacgtgggtaatctgccctcgattctgggatagcccggggaaacccggattaataccggatagcctctcgagcttacgagctcgtgagaaaaggtagcttcggcctccgatcgaggatgagcccgcggcggattagcttgttggtggggtaatggcccaccaaggcgacgatccgtagcaggtctgagaggacgatcagccacactgggactgagacacggcccagactcctacgggaggcagcagtggggaatcttgcgcgatgggcgaaagcctgacgcagcgacgccgcgtgggggaagaaggccttcgggttgtaaacctctttcagcagggacgaagccactcgggtgaatagcccagagggtgacggtacctgcaga

SEQ ID NO: 4105 - DNA, 490 bp, Unknown
  Ascusbbf_1322134, encodes 16S rRNA
agagtttgatcatggctcaggatgaacgctagctacaggcttaacacatgcaagtcgaggggtaacgtgagagaagcttgcttctcttgacgacgaccggcgaatgggtgagtaacgcgtatccaacctgccgcacgcccgggaacagcccttggaaacgaggattaaatcccgataccttattattccgcatggagtgataagaaaacaggcatgcgatggggatgcgtctgattagcttgttggcggggtaacggcccaccaaggcgacgatcagtacgggttctgagaggaaggtccccagcgttggaactgagacacggaccaaaatcctacgggaggaagccgtgaggaatattggtcaatgggcgcgagcctgaaccagccaagtagcgtgcaggatgacggccctatgggttgtaaactgcttttgcatgggaataaagtgagggacgtgtccctttttgtatgtaccatgagaataaggacc

SEQ ID NO: 4106 - DNA, 490 bp, Unknown
  Ascusbbf_901094, encodes 16S rRNA
agagtttgatcctggctcaggatgaacgctggcggcgtgcctaacacatgcaagtcgaacggggttaagtgaaattttcggatggaccttaacttagtggcggacgggtgagtaacgcgtgggtaacctgccttatacagggggataacagccggaaacggctgctaataccgcataagcgcacagtgctgcatggtacggtgtgaaaagatttatcggtataagatggacccgcgtctgattagctagttggtaaggtaacggcctaccaaggcaacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaacgggaggcaactcctttgacggtacctgactaagaagccc

SEQ ID NO: 4107 - DNA, 490 bp, Unknown
  Ascusbbf_498509, encodes 16S rRNA
agagtttgatcctggctcaggatgaacgctagctacaggcttaacacatgcaagtcgaggggaaacgatattgaaagcttgctttctttaggcgtcgaccggcgaatgggtgagtaacgcgtatccaacctgcccctgagtaagggatagcccatcgaaagatggattaataccttatagtctcctttgcagacatctaattaggagtaaagattcatcgcctcgggatggggatgcgtaggattaggcaggcggcggggtaacggcccaccgcgccgacgatccttaggggttctgagaggaaggtcccccacactggtactgagacacggaccagactcctacgggaggcagcagtgaggaatattggtcaatggacgagagtctgaaccagccaagtagcgtgcaggacgacggccctatgggttgtaaactgcttttatgcggggataaagtgcgccacgtatggtgtattgcaggtaccgcaaga

SEQ ID NO: 4108 - DNA, 482 bp, Unknown
  Ascusbbf_1764596, encodes 16S rRNA
agagtttgatcctggctcaggatgaacgctggcggcgtgcctaatacatgcaagtcgagcggaaaggccacttcggtggtactcgagcggcggacggctgagtaacgcgtaggaacgtaccccaaactgagggataagcaccagaaatggtgtctaataccgcatgtgctctttcgagagtaaagcttcggcggtttgggaacggcctgcgtaagattagcttgttggtgaggtaatggctcaccaaggcgacgatctttagctggtctgagaggatgatcagccagactgggactgagacacggcccagactcctacgggaggcagcagtagggaattttccacaatgggcgaaagcctgatggagcaacgccgcgtgcaggatgaatgccttcgggttgtaaactgcttttatctgtgaagattatgacggtaacagatgaataaggatcggctaactccgtgccagcagccgcggtaat

SEQ ID NO: 4109 - DNA, 472 bp, Unknown
  Ascusbbf_1671498, encodes 16S rRNA
agatttgatcatggctcaggatgaacgctggcggcgtgcctaatacatgcaagtcgagcggtaacacttcgggtgacgagcggcggacggctgagtaacacgtaggaacgtaccccaaactgagggataactgcccgaaagggtagctaataccgcatatggtcttcggattaaagcttcggcggtttgggaacggcctgcgcatgattagttagttggtgaggtaaaagctcaccaagacgacgatcattagctggtctgagaggatgatcagccagactgggactgagaacggcccagactcctacgggaggcagcagtagggaattttccacaatggacgaaagtctgatggagcaacgccgcgtgcaggatgaagggtttcggctcgtaaactgcttttgtctgtgacgattatgacggtagcagacgaataaggatcggctaactccgtgccagcagccgcggtaat

SEQ ID NO: 4110 - DNA, 490 bp, Unknown
  Ascusbbf_1078300, encodes 16S rRNA
agagtttgatcctggctcagattgaacgctggcggcatgcttaacacatgcaagtcgaacggcagcaagacctagcttgctaggttgatggcgagtggcgaacgggtgagtaacgcgtaggaatatgccttgaagtgggggacaacctggggaaactcaggcaaataccgcataagctctgaggagtgaagctggggaccttatggcctggcgctttgagattagcctgcgtccgattagctagttggtggggtaagggcctaccaaggcgacgatcggtagctggtctgagaggatgatcagccacactgggactgagacacggcccagacccctacgggaggcagcagtggggaatattggacaatggggggaaccctgatccagcaatgccgcgtgtgtgaagaaggcctgagggttgtaaagcactttcggtggggaggatggaatggtaggttaagagctgactgttctgacgttacccaaagaa

SEQ ID NO: 4111 - DNA, 490 bp, Unknown
  Ascusbbf_1435714, encodes 16S rRNA
agagtttgatcctggctcaggatgaacgctagcggcaggcttaacacatgcaagtcgaggggcagcgcggggtagcaatactctggcggcgaccggcggaagggtgcgtaacgcgtgagcaacttgcccgtcactgggggataggcactggaaacggtgtgtaatactccataacatttggattcacatggattcatattgaaagattcgttggtgacggatgggctcgcgtaacattagctagtcggcggggtaacggcccatcgaggctacgatgtttaggggttctgagaggaagttccccggaaatggaactgagacacggtccagattccaacggggggcagaggtgaggaagatgggtcaatgggcggaagcctgaaccagccatgccgcgtgtaggaataaggccctatgtgtcgtaaactgcttttccttgagggcaataagggtcacgtgtggtccgatgagagtatcaggggaataagca

SEQ ID NO: 4112 - DNA, 490 bp, Unknown
  Ascusbbf_1342088, encodes 16S rRNA
agagtttgatcctggctcaggatgaacgctggcggcgtgcttaacacatgcaagtcgaacggagttatctcgctgaggagagcttgctcaaatcctgagataacttagtggcggacgggtgagtaacgcgtggataacctgccttatactgggggataacacttagaaataggtgctaataccgcataagcgcacgttcccgcatgggaaagtgtgaaaaactccggtggtgtaagatggatccgcgtctgattagatagttggtgaggtaacggcccaccaagtcaacgatcagtagccggcctgacagagtgaccgacaaccagcggactgggacacggcccaaacacctacggtaggcagcagtggggaatattgcacaatcggggaaaccctgatgcagcgacgccgcgtgagtgaagaagtatttcggtatgtaaagctctatcagcaaggaagaaaaaaatgacggtacttgactaagaagccc

SEQ ID NO: 4113 - DNA, 490 bp, Unknown
  Ascusbbf_1591839, encodes 16S rRNA
agagtttgatcatggctcaggatgaacgctagctacaggcctaacacatgcaagtcgaggggcagcatgggagaagcttgcttttcctgatggcgaccggcgaatgggtgagtcacgcgtgtccaacctgcctccggcccggggatagcccttggaaatgaggattaagacccgatacgtggcgcttccgcatggcggcgccatgaaacgagaccggagatggggacgcgtccgattagatagttggcggggcaacggcccaccaagtcaacgatcggtagccggactgagaggttgaacggccacattggaactgagaaacggtccagactcctacgggaggcagcagtggggaatattgggcaatgggcgaaagcctgatgcagcaacgccgcgtgagggaagaaggtcttcggattgtaaacctttgtccttgctgacgaataaagtgacggtaagcaaggaggaagtcacggctaactacgtgcca

SEQ ID NO: 4114 - DNA, 490 bp, Unknown
  Ascusbbf_1346533, encodes 16S rRNA
agagtttgatcctggctcaggatgaacgctagcggcaggcttaacacacgcaagtcgaggggcagcgaggggtagcaatactctgtcggcgaccggcgaaagggtgagtaacgcgtgagcaacatgcccgttgcagggggatagtcattggaaacgatgcgtaataccccgtaacatcatggaccgcatggtttatgattgaaagatttatcggcgacggattggctcgcgtaccattagctagatggcggggtaacggcccaccatggctacgatggttaggggttctgagaggaaggtccccaacattggaatggagaacagggccagaatcctacgggaggaagcagtgaggaatattggtcaatggccgagaggctgaaccagccatgccgcgtgcgggaggacggtcctatgggttgtaaaccgcttttttgtgggagcaataagttgcacgtgtgcaatgatgagagtaccatgagaataagca

SEQ ID NO: 4115 - DNA, 488 bp, Unknown
  Ascusbbf_137835, encodes 16S rRNA
agagtttgatcctggctcaggacaaacgctggcggcgtgcctaacacatgcaagtcgaacgagcccttcggggctagtggcagacgggtgagtaacgcgtaggtaatgtacctcttcgctggggataccgttccgaaaggaacgttaataccgaatgaattcttcgggcggcatcgcttgaagaataaaccgcaagggcgaggagatcagcttgcgtactatcagctagtaggtggggtaacggcctacctaggctgcgacggttagccggtctgagaggatgatcggccacattggaactgaaacacggtccagactcctacgggaggcagcagtgaggaatattgcgcaatgggcgaaagcctgacgcagcgacgccgcgtgagggatgacggccttcgggttgtaaacctctgtcagtggggaagagaacggacggtacccgctgaggaagcatcggcttactacgtgccagcagccgcggtaat

SEQ ID NO: 4116 - DNA, 490 bp, Unknown
  Ascusbbf_128553, encodes 16S rRNA
agagtttgatcctggctcaggatgaacgctggcggcgtgcctaatacatgcaagtcgaacgcgagccttcgggctcgagtggcgaacgggtgagtaatacgtaagcaacctggcctttacagggggataactgatggaaacgtcagctaagaccgcataggtacagagatcgcatgataactgtattaaaagtgctacgggactggtagaggatgggcttacggcgcattagcttgttggaggggtaacggcccaccaaggcgacgatgcgtagccgacctgagagggtgaccggccacactgggactgagacacggcccagactcctacgggaggcagcagtagggaattttcggcaatggggggaaccctgaccgagcaacgccgcgtgaaggaagaaggaattcgttctgtaaacttctgttataaaggaagaacggcacatatagggaatgatatgtgagtgacggtactttatgaggaagccacg

SEQ ID NO: 4117 - DNA, 490 bp, Unknown
  Ascusbbf_1543789, encodes 16S rRNA
agagtttgatcctggctcaggacgaacgctggcggcgtgcctaatacatgcaagtcgagcggggtccatccagtggcaacactggggacgacctagcggcgaacgggtgagtaacacgtaaggaacctgccccgaagtctgggataactcgaggaaactcgtgctaataccggatgcccccactgcaatcgcatggttgtgtggggaaagttttttcgcttcgggagggccttgcggcctatcagctagttggtggggtaacggcctaccaaggcgtcgacgggtagctggtctgagaggacgatcagccacactggggctgagacacggcccagactcctacgggaggcagcagtagggaatcttgcgcaatgggcgaaagcctgacgcagcaacgccgcgtgggggatgaaggctctcgggttgtaaacccctttcagcagggacgaaattgacggtacctgcagaagaagccccggccaactacgtg

SEQ ID NO: 4118 - DNA, 490 bp, Unknown
  Ascusbbf_1512828, encodes 16S rRNA
agagtttgatcctggctcaggatgaacgctggcggcgtgcttaacacatgcaagtcgaacggagcaccctagaaggagttttcggacaactgataggaatgcttagtggcggacgggtgagtaacgcgtgaggaacctgcctaggagtggggaataacacagtgaaaattgtgctaataccgcataacatattggtgtcgcatggcactgatatcaaagatttatcgctcttagatggcctcgcgtctgattagctagtaggtggggtaacggcccacctaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttaagagggacgaagtaagtgacggtacctcttgaataagccacg

SEQ ID NO: 4119 - DNA, 490 bp, Unknown
  Ascusbbf_704402, encodes 16S rRNA
agagtttgatcatggctcaggatgaacgctagctacaggcctaacacatgcaagtcgaggggcatcgcggtggtgagcgatcaccactggcggcgaccggcggatgggtgagtaacgcgtatccaacctgccccaagcccgggcacagcccctggaaacggggagtgactcccgatagtgcgtgtatcccgcatgggttgcgcgctaaattctgaggcttgggatgggggtgcgtccgattaggtagttggcggggcaacggcccaccaagcctacgatcggtaggggttctgagaagaaggtcccccacattgggactgagacacggcccaaactcctacgggaggcagcagtgaggaatattggtcaatgggcggaagcctgaaccagccaagtagcgtggaggatgacggccctacgggttgtaaactcctttagcgcggggataacatgcgccacgtgtggtgcactgcaggtaccgcgagaataa

SEQ ID NO: 4120 - DNA, 490 bp, Unknown
  Ascusbbf_1475855, encodes 16S rRNA
agagtttgatcatggctcaggatgaacgctggcggcgtgcctaacacatgcaagtcgaacggaactgcatatgaagattaacttcggttatgattcgcttgtagtttagtggcggacgggtgagtaacgcgtgagtaacctgcccttgagagggggataacgccctgaaaagagcgctaataccgcataacattactttgtcgcatggcagagtaatcaaaactccggtgctcagggatggactcgcgtccgattagttagttggtgaggtaacggctcaccaagacgacgatcggtagccggactgagaggttgaacggccacattgggactgagacacggcccagactcctacgggaggcagcagtgggggatattgcgcaatgggggaaaccctgacgcagcaacgccgcgtggatgaagacggttttcggattgtaaagcactttcggcggggacgatgatgacggtacccgcagaagaagccccg

SEQ ID NO: 4121 - DNA, 486 bp, Unknown
  Ascusbbf_41992, encodes 16S rRNA
agagtttgatcatggctcagaacgaacgctggcggcatgcttaacacatgcaagtcgaacggtggagggtagtacttgtattacctgacatagtggcaaacgggtgagtaacgcgtgggaatgtaccccttggtgttggataacggttggaaacgaacgctaatacaacataatgtcgagagacaaaagagaaattgctgagggaacagcccgcgttagattaggtagttggtagggtaatggcttaccaagcctgtgatctatagctggtctgagaggatgatcagccacattgggactgagacacggcccagactcctacgggaggcagcagtggggaatattggacaatgggggaaaccctgatccagcgatgccgcgtgagtgatgaaggccttcgggttgtaaagctcttttataaatgaagatgatgacggtaatttatgaataagctccggctaacttcgtgccagcagccgcggtaat

SEQ ID NO: 4122 - DNA, 490 bp, Unknown
  Ascusbbf_158224, encodes 16S rRNA
agagtttgatcctggctcaggacgaacgctggcggcgtgcctaacacatgcaagtcgaacggacttaaagagcttgctctttaagttagtggcggacgggtgagtaacgcgtgagtaacctgccttacagagggggataacgttttgaaaagaacgctaataccgcataacgtacggatatcgcatggtgaccgtaccaaaggagcgatccgctgtaagatggactcgcgtccgattagatagttggcggggtaacggcccaccaagtcgacgatcggtagccggactgagaggttgatcggccacattgggactgagacacggcccagactcctacgggaggcagcagtgagggatattgcacaatgggcgaaagcctgatgcagcaacgccgcgtgagggaagacggttttcggattgtaaacctctgttcttgctgatgataatgacattaggcaaggagaaagccacggctaactacgtgccagca

SEQ ID NO: 4123 - DNA, 490 bp, Unknown
  Ascusbbf_220358, encodes 16S rRNA
agagtttgatcatggctcagattgaacgctggcggcaggcttaacacatgcaagtcgaacgatgaggtctagcttgctagactgattagtggcgaacgggtgagtaaagcttaggaatctgccttgtagtgggggacaacatttcgaaagggatgctaataccgcatgagacctaggggtgaaagggtgcgaaagcacttgctacaagatgagcctaagttagattagctagatggtggggtaaaggcctaccatggcgacgatctatagctggtcttagaggatgatcagccacactgggactgagacacggcccagactcctacgggaggcagcagtggggaatattggacaatgggcgaaagcctgatccagccatgccgcgtgtgtgaagaaggccttttggttgtaaagcactttaagtggggaggagggtacttgagttaatagcttgagatactggacgttacccacagaataagcaccggct

SEQ ID NO: 4124 - DNA, 490 bp, Unknown
  Ascusbbf_286622, encodes 16S rRNA
agagtttgatcatggctcagattgaacgctagcgggatgctttacacatgcaagtcgaacggcagcacgagagagcttgctcttttggtggcgagtggcggacgggtgagtaatgtatcggaacgtgcccagtagcgggggataactactcgaaagagtggctaataccgcatacgccctacgggggaaagggggggatcgcaagacctctcactattggagcggccgatatcggattagctagttggtggggtaaaggcctaccaaggcgacgatccgtagctggtttgagaggacgaccagccacactgggactgagacacggcccagactcctacgggaggcagcagtggggaattttggacaatgggggaaaccctgatccagccatcccgcgtgtgtgatgaaggccttcgggttgtaaagcacttttgacagggaagaaatgacaggagctaataacttctgtagatgacggtacctgtagaat

SEQ ID NO: 4125 - DNA, 470 bp, Unknown
  Ascusbbf_151019, encodes 16S rRNA
agagtttgatcctggctcagattgaacgctggcggcatggttaaaacatgcaagtcgaacgatcccttcggggagagtggcgaaagggcgaggaatacgatcgaacgtaccccgaggtgggggatagcgtggggaaactcacggtaataccccatgtcctctacggagaaaaggtttaccgccttgggagcggcgatcgtcctatcaggtagttggcggggtaatggcccaccaagccgaagacgggtagcgggtgtgagagcacgacccgccgcatcgggactgagacactgcccggactcctacgggaggctgcagtaacgaatcttccgcaatggacgaaagtctgacggagcaatgccgcgtgtgggatgaagcgtcttcgacgtgtaaaccactgtcagggtttaggaacaatgaccagacccaaaggaagggccggctaactctgtgccagcagccgcggtaat

SEQ ID NO: 4126 - DNA, 470 bp, Unknown
  Ascusbbf_1645125, encodes 16S rRNA
agagtttgatcatggctcagagcgaacgctggcggcaggcttaacacatgcaagtcgaacggttccttcggggacagtggcagacgggtgagtaacacgtgggaacgtaccttttggttcggaacaactgagggaaacttcagctaataccggatacgcccttatggggaaagatttatcgccgaaagatcggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggggcaaccctgatccagccatgccgcgcgagtgatgaaggccttagggctgtaaagctcttttatccgggacgataatgacggtaccagaagaataagccccggctaacttcgtgccagcagccgcggtaat

SEQ ID NO: 4127 - DNA, 490 bp, Unknown
  Ascusbbf_297799, encodes 16S rRNA
agagtttgatcctggctcagaacgaacgctggcggcatggattaggcatgcaagtcgaacgcaaacagcaatgtttgagtggcgcaagggtgaggaacacgtgagtaatctgccttcgagtcgggaatagctccgggaaactggaattaataccggatgaaactgcgataccgcatggtattgcattgaaagcagcaatgcgcttgaagaggagctcgcgtcccattagctggttggtgaggtaacggcccaccaaggcgatgatgggtagctggtctgagaggacgatcagccacagtgggactgagaactgcccacactcctacgggaggctgcagtcgagaattttgggcaatgggcgaaagcctgacccagcaatgccgcgtgcgggatgaaggtcttcggattgtaaaccgctgtcaagagggacgaaaaatgacggtacctctgaaggaagtcacggctaactacgtgccagcagccgcggtaa

SEQ ID NO: 4128 - DNA, 490 bp, Unknown
  Ascusbbf_383542, encodes 16S rRNA
agagtttgatcatggctcagaatgaacgttggcggcgtggattaggcatgcaagtcgcgcggtaggttttccttcgggagaactgagagcggcgaaagggagagtaacgcgtggataacctgcctctaggaccgggatagccgggggaaaccccgggtaataccggatgaagtctccggactaaatggtgtgattccgcctagagatgggtccgcgtcctattagctagttggtgaggtaacggctcaccaaggcgatgatgggtactgggtgtgagagcatggcccagctcactgggactgagatactgcccagacacctacgggtggctgcagtcgagaatcttcggcaatgggcgcaagcctgaccgagcgacgccgcgtgcgggatgaaggccttcgggttgtaaaccgctgtcagaggggaggaaatgagtaggggttatcccctgcacttgaccgatcctcagaggaagtacgggctaagttcg

SEQ ID NO: 4129 - DNA, 490 bp, Unknown
  Ascusbbf_1538100, encodes 16S rRNA
agagtttgatcatggctcaggatgaacgctggcggcgtgcttaacacatgcaagtcgaacgaggttagagtcttcggactttaaccgagtggcggacgggtgagtaacgcgtgaacaatccgtcctgcaaagggggataacaactggaaacagttgctaataccgcataagaccacagtatcgcatggtacagaggtaaaagcagcaatgcgatgcagggtgagttcgcgtctgattaggcagttggcggggtaacggcccaccaaaccgacgatcagtagccgacctgagagggtgatcggccacattgggactgagacacggcccagactcctacgggaggcagcagtggggaatattgggcaatgggcgcaagcctgacccagcaacgccgcgtgagggaagaaggttttcggattgtaaacccctgtccttgtagacgaaggaagtgacggtatacaaggaggaagccccggctaactacgtgcca

SEQ ID NO: 4130 - DNA, 490 bp, Unknown
  Ascusbbf_1021582, encodes 16S rRNA
agagtttgatcctggctcagagcgaacgttcgcggcgggcctaacacatgcaagtcgaacgcgaaagcccttcggggtgagtaaagtggcgcacgggtgagtaacgcgtgggtaatctaccttccgacgggggataactattcgaaaggatagctaataccgcataagctcacggcccttacgggggcagggagaaaaggtggcctctgcttgcaagctaccatcggaaggcgagcctgcgtcccatcagctagttggtagggtaatggcctaccaaggcgaagacgggtagctggtctgagaggatgatcagccacactggcactggaacacgggccagactcctacgggaggcagcagtgaggaatattgggcaatgggcgaaagcctgacccagccacgccgtgtgagtgatgaaggccttcgggttgtaaagctctgtaagagagggacgaaaatccttgttcgaataggacgagggattgacggt

SEQ ID NO: 4131 - DNA, 490 bp, Unknown
  Ascusbbf_484074, encodes 16S rRNA
agagtttgatcctggctcaggacgaacgctggcggcgtgcctaacacatgcaagtcgaacggagccatggaaaagattccttcgggatgattttccggaagcttagtggcggacgggtgagtaacgcgtgagtaacctgcccttgagagggggataacacaccgaaaggtgtgctaataccgcataacatattgaagccgcatgactttaatatcaaagatttattgctcaaggatggactcgcgtctgattagctagttggtgaggtaacggctcaccaaggcgacgatcagtagccgaactgagaggttgatcggccacattgggactgagacacggcccagactcctacgggaggcagcagtgggggatattgcgcaatgggggaaaccctgacgcagcaacgccgcgtgaaggatgaaggtcttcggatcgtaaacttttgtcttatgggaagaaacctgacggtaccataggaggaagccacggc

SEQ ID NO: 4132 - DNA, 490 bp, Unknown
  Ascusbbf_202800, encodes 16S rRNA
agagtttgatcatggctcaggacgaacgctggcggcgtgcctaacacatgcaagtcgagcggggacatgagggaataagcttcggcagaaagaatcatgtttcagcggcggacgggtgagtaacgcgtgagcaatctgtccctgacagggggataacacttggaaacaggtgctaataccgcataagaccacgagatggcatcatcttggggtaaaagtggagacacggtgaggggtgagctcgcgtccgattagccagttggtgaggtaacggcccaccaaagcgacgatcggtagccgacctgagagggtgatcggccacattggaactgagacacggtccaaactcctacgggaggcagcagtgggaatattgggcaatgggcgaaagcctgacccagcaacgccgcgtgagggaagaaggttttcggattgtaaacctctgtccttggtgacgaaggacgtgacggtagccaaggaggaagccccg

SEQ ID NO: 4133 - DNA, 241 bp, Unknown
  Ascusbbf_194910, encodes 16S rRNA
agagtttgatcctggctcaggatgaacgctagcggcaggcttaacacatgcaagtcgaggaggcagcagtgaggaatattggtcaatgggcggaagcctgaaccagccatgccgcgtgcaggaataaggccctacgggtcgtaaactgcttttgtacgggagcaataagggccacgtgtgacctgatgagagtaccgtacgaataagcatcggctaactccgtgccagcagccgcggtaat

SEQ ID NO: 4134 - DNA, 490 bp, Unknown
  Ascusbbf_1466690, encodes 16S rRNA
agagtttgatcatggctcaggatgaacgctagctacaggcttaacacatgcaagtcgaggggcagcacgtctgggtggcgaccggcgcacgggtgagtaacgcgtatccaacctggcccatagtagggaacagcccggcgaaagtcggattaatgccctatgttttcctcatggagcattttatgaggaacaaagacttgtcgctatgggatggggatgcgtccgattaggcagcaggcggggcaacggcccacctggccttcgatcggtaggggttctgagaggaaggtcccccacactggtactgagacacggaccagactcctacgggaggcagcagtgaggaatattggtcaatgggcgcgagcctgaaccagccaagtagcgtgcgggacgacggccctatgggttgtaaaccgcttttgcacgggaataaagtgggggacgtgtccccttttgcatgtaccgtgagaataaggaccggctaatt

SEQ ID NO: 4135 - DNA, 490 bp, Unknown
  Ascusbbf_532402, encodes 16S rRNA
agagtttgatcatggctcaggatgaacgctagctacaggcttaacacatgcaagtcgaggggcagcacaaggcagcaatgctgaggtggcgaccggcgcacgggtgcgtaacgcgtatccaaccttcccgttactcttggatagccttccgaaagggagattaatacaagatggtgttgaaattccgcatgttatttcaactaaagatttatcggtaacggatggggatgcgtgacattagatagatggcggggtaacggcccaccatgtccacgatgtctaggggttctgagaggaaggtcccccacactggaactgagacacggtccagactcctacgggaggcagcagtgaggaatattggtcaatggccggaaggctgaaccagccaagtagcgtgaaggatgaaggttctatggattgtaaacttcttttatacgggaataaaacctcccacgtgtgggagcttgtatgtaccgtatgaataagc

SEQ ID NO: 4136 - DNA, 490 bp, Unknown
  Ascusbbf_739701, encodes 16S rRNA
agagtttgatcatggctcagattgaacgctggcggcaggcttaacacatgcaagtcgaacgatgattactagcttgctagtatgattagtggcgaacgggtgagtaatgcttaggaatctgcctagtagtgggggataacttaccgaaaggtaagctaataccgcatacgacctacgggtgaaagggggcgcaagctctcgctattagatgagcctaagttagattagctagttggtggggtaaaggcctaccaaggcgacgatctataactggtcttagcggatgatcagtcacaccggaactgagacacggtccggactcctacgggaggcagcagtggggaatattggacaatgggcgaaagcctgatccagccatgccgcgtgtgtgaagaaggccttttggttgtaaagcactttaagtggggaggaaaagcaactggttaatacccagtcgccctgacgttacccacagaataagcaccggcta

SEQ ID NO: 4137 - DNA, 490 bp, Unknown
  Ascusbbf_1191282, encodes 16S rRNA
agagtttgatcctggccaggacgaacgctggcggcgggtttaacacatgcaagtcgagggtcgaagtttggtgcttgcaccgaacggaaaccggcgaacgggtgagtaacacgtgaggaaccaacccttcactttgggataacccaaggaaacttgggctaataccggatgccccggattgatcgcatgatctatccaggaaagctccggcggtgatggacggtctcgcggcctatcagctagttggtgaggtaacggctcaccaaggcgacgacgggtagctggagtgagagctcgaacagccacactgggactgagacacggcccagactcctacgggaggcagcagtggagaatcttgcacaatgggcgaaagcctgatgcagccgcgccgcgtgagggacgaaggtcttcggattgtaaacctctttcagtcgtgaagaagcgcaagtgacggtaacgacagaagaagccccggctaactacgtgc

SEQ ID NO: 4138 - DNA, 490 bp, Unknown
  Ascusbbf_1526457, encodes 16S rRNA
agagtttgatcctggctcaggacgaacgctggcggcgtgcctaacacatgcaagtcgaacggaagtaagagcttcggtttttactttagtggcgaacgggtgagtaacgcgtgaagaacctgcctttcagtgggggacaacagttggaaacgactgctaataccgcataatgtatcgatggggcatcctgttgataccaaagatttattgctgaaagatggcttcgcgtctgattagctagatggcggggtaacggcccaccatggcgacgatcagtagccggtctgagaggatgaacggccacattgggactgagatacggcccagactcctacgggaggcagcagtggggaatattgggcaatgggggaaaccctgacccagcaacgccgcgtgaaggaagaaggccctcgggttgtaaacttcttttaccagggacgaagaacgtgacggtacctggagaaaaagccacggctaactacgtgccagc

SEQ ID NO: 4139 - DNA, 490 bp, Unknown
  Ascusbbf_1802349, encodes 16S rRNA
agagtttgatcatggctcaggacgaacgctggcggcgtgcctaacacatgcaagtcgagcggagaacatgaagtgtttacacggattgttcttagcggcggacgggtgagtaacacgtgggtaacctgcctcaaagtgggggatagcctttcgaaaggaagattaataccgcataagcctgcagcaccgcatggtgcagcaggaaaaggagcaatccgctttgagatggacccgcggcgcattagctagttggtgaggtaacggctcaccaaggccacgatgcgtagccgacctgagagggtgatcggccacattggaactgagacacggtccagactcctacgggaggcagcagtggggaatattgcacaatgggcgaaagcctgatgcagcaacgccgcgtgagtgatgaaggccttcgggtcgtaaagctctttgatcagggatgataatgacagtacctgaaaaacaagccacggctaactacgtg

SEQ ID NO: 4140 - DNA, 207 bp, Unknown
  Ascusbbf_612830, encodes 16S rRNA
agagtttgatcatggctcaggacgaacgctggcggcgtgcctaataatggacgcaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaat

SEQ ID NO: 4141 - DNA, 490 bp, Unknown
  Ascusbbf_519860, encodes 16S rRNA
agagtttgatcctggctcagattgaacgctagcggaatgccttacacatgcaagtcgaacggcagcacggacttcggtctggtggcgagtggcgaacgggtgagtaatgtatcggaacgtacccagtagcgggggataactactcgaaagagtagctaataccgcatacgcccttcgggggagagcgggggatcttcggacctcgcactattggagcggctgatatcggattagctagttggtgaggtaaaggctcaccaaggcgacgatccgtagctggtttgagaggacgaccagccacactggaactgagacacggtccagactcctacgggaggcagcagtggggaattttggacaatgggggaaaccctgatccagccattccgcgtgtgtgaagaaggccttcgggttgtaaagcacttttggcgggaaagaaacggcgccgactaatactcggcgtaactgacggtacccgcagaataagcac

SEQ ID NO: 4142 - DNA, 471 bp, Unknown
  Ascusbbf_526575, encodes 16S rRNA
agagtttgatcctggctcagagcgaacgctggcggaatgcttaacacatgcaagtcgcacgggcctttcggggtcagtggcggacgggtgagtaacgcgtacgaatgtgtcctgagatgggggacaacgccgggaaactggcgctaataccgcatatgtcctgaggggcaaagccgcgaggcgtcttaggagcagcctgcgtccgattagcttgttggtggggtaaaggcttaccaaggcgacgatcggtagctggtctgagaggatgatcagccacactggaactgagacacggtccagactcctacgggaggcagcagtggggaatattggacaatgggcggaagcctgatccagcaattccgcgtgggtgaagaaggtcttcggattgtaaagccctttcggcggggacgatgatgacggtacccgcagaagaagccccggctaacttcgtgccagcagcccggtaat

SEQ ID NO: 4143 - DNA, 490 bp, Unknown
  Ascusbbf_1899831, encodes 16S rRNA
agagtttgatcatggctcagaatgaacgctggcggcatggattaggcatgcaagtcggacgggccgccctcgggcggccagtggcggaagggtgagtaacacgtgagcaacctgcccccgaggccggaacaagcgccggaaacggcgtctgacaccggatgaggcgcccccccgcatgggggggacgcgaaatattcatacctcggggatgggctcgcggcccattagcctgtcggcggggtagcggcccaccgaagctgcgacgggtaggtggtctgagaggacggtcacccacactgggactgagacactgcccagactcctgcgggaggctgcagtcgagaatcttccgcaatgggcgcaagcctgacggagcgatgccgcgtgggggacgaaggccctcgggtcgtaaacccctgtcgcccgggacgatcgtgacggtaccgggaaaggaagccacggctaaccacgtgccagcagccgcggtaat

SEQ ID NO: 4144 - DNA, 490 bp, Unknown
  Ascusbbf_471154, encodes 16S rRNA
agagtttgatcctggctcaggacgaacgctggcggcgtgcctaatacatgcaagtcgagcggatcttttggagcttgctccttaaggttagcggcggacgggtgagtaacacgtgggcaacctgccctatagttggggataactccgggaaaccggagctaataccgaatgatacatttaagctcctgcttgaatgttgaaagatggtttcggctatcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaaactctgttgtaagggaagaacaagtgtagtagtaactggctgcaccttgacggtacctt

SEQ ID NO: 4145 - DNA, 490 bp, Unknown
  Ascusbbf_343113, encodes 16S rRNA
agagtttgatcatggctcagattgaacgctggcggcaggcctaacacatgcaagtcgagcgcgaaagttcttcggaatgagtagagcggcggacgggtgagtaacacgtgggaatctacccagtagcgggggacaacagtcggaaacgactgctaataccgcatacgccctacgggggaaagcaggggatcttcggaccttgcactattggatgagcccacgtcggattagctagttggtagggtaaaggcctaccaaggctacgatccgtaactggtctgagaggatgatcagtcacactggaactgagacacggtccagactcctacgggaggcagcagtggggaatattgcacaatgggcgcaagcctgatgcagccatgccgcgtgtgtgaagaaggccttcgggttgtaaagcactttaagcggggaggaaggctatacggttaatacccgtgtagattgacgttacccgcagaataagcaccgg

SEQ ID NO: 4146 - DNA, 490 bp, Unknown
  Ascusbbf_1062590, encodes 16S rRNA
agagtttgatcatggctcaggatgaacgctggcggcgtgcctaacacatgcaagtcgaacggagatcatatggagattggcttcggccaaaggaagcatgatcttagtggcggacgggtgagtaacgcgtggggaacctgccccataccgggggataacagccagaaatggctgctaataccgcataagcgcccggggtcgcatgaccctgagtgaagaactccggtggtatgggatggacccgcgttggattagccagttggcggggtaacggcccaccaaagcgacgatccatagccggcctgagagggtggacggccacattgggactgagacacggcccagactcctacgggaggcagcagtggggaatattgcacaatggggggaaccctgatgcagcgacgccgcatgaaggaagaagtatctcggtatgtaaacttctatcagcagggaagaagatgacggtacctgcacaagaagccccggc

SEQ ID NO: 4147 - DNA, 184 bp, Unknown
  Ascusbbf_337571, encodes 16S rRNA
agagtttgatcctggctcagccactacgttgatgcggtgtctcacctgccatgagcgccgttgcgttattgatataacctgaaaataagccttgtaagaagcgcatacagataatgaaaagcgcactttgagctaagccggtaataaagatggttaaactcataacgccagcagccgcggtaat

SEQ ID NO: 4148 - DNA, 490 bp, Unknown
  Ascusbbf_1797963, encodes 16S rRNA
agagtttgatcctggctcaggacgaacgctggcggcgtgcctaacacatgcaagtcgaacggagatattttggaatgagatttcggttgaatgaagggatatcttagtggcggacgggtgagtaacgcgtgagtaacctgcccataagagggggataacgttctgaaaaggacgctaataccgcataaaatatttagatcgcatgatttagatatcaaaggagaaatccgcttatggatggactcgcgtccgattagctggttggcgggataacagcccaccaaggcgacgatcggtagccggactgagaggttgaacggccacattgggactgagacacggcccagactcctacgggaggcagcagtgggggatattgcgcaatgggggaaaccctgacgcagcaacgccgcgtgaatgaggaaggtcttcggattgtaaaattcttttgttgaggacgaaggaagtgacggtactcaacgaataagct

SEQ ID NO: 4149 - DNA, 470 bp, Unknown
  Ascusbbf_854865, encodes 16S rRNA
agagtttgatcctggctcagaacgaacgctggcggcaggcctaatacatgcaagtcgaacgcactcttcggagtgagtggcagacgggtgagtaacgcgtgggaattttccttgcagtacggaataactccgggaaaccggtgctaataccgtatacgccctttgggggaaagatttatcgctgcaagataagcccgcgtcggattagctagttggtggggtaatggcctaccaaggcttcgatccgtagctggtctgagaggatgatcagccacactgggactgagacacggcccagactcctacgggaggcagcagtagggaatattggacaatgggcgaaagcctgatacagccatgccgcgtgagtgaagaaggccttagggttgtaaagctcttttggcggggacgataatgacggtacccgcagaataagctccggctaacttcgtgccagcagccgcggtaat

SEQ ID NO: 4150 - DNA, 490 bp, Unknown
  Ascusbbf_568869, encodes 16S rRNA
agagtttgatcctggctcaggacgaacgctggcggcgtgcctaacacatgcaagtcgaacgagaatttcgtaacggaagtcttcggacagaagttatgaaaggacagtggcggacgggcgagtaacgcgtgagtaacctgcccataagagcgggatagcccatggaaacgtggagtaataccgcatgaggtatagtattcgcatggatacagtattaaagatttatcgcttatggatggactcgcgtcagattagctggttggagaggtaacggctcaccaaggcgacgatctgtagccgaactgagaggttgaacggccgcattgggactgagacacggcccagactcctacgggaggcagcagtgggggatattgcgcaatgggggaaaccctgacgcagcaacgccgcgtgcaggaagaaggtcttcggattgtaaactgttgtcgcaagggaagaagacagtgacggtaccttgtgagaaagtcac

SEQ ID NO: 4151 - DNA, 490 bp, Unknown
  Ascusbbf_1332564, encodes 16S rRNA
agagtttgatcctggctcagattgaacgctggcggcatgcttaacacatgcaagtcgaacgagggaagcagcttgctgtggacctagtggcggacgggtgagtaacgtataggaatctaccttggggtgggggataacgtatggaaacgtacgctaataccacataacacttacgagtcaaagcgggggatcttcggacctcgcgcccttggatgagcctatattggattagctagttggtagggtaaaggcctaccaaggcgacgatccatagctggtttgagaggatgatcagccacatcgggactgagacacggcccgaactcctacgggaggcagcagtggggaatattggacaatgggggcaaccctgatccagcaatgccgcgtgtgtgaagaaggccttagggttgtaaagcactttcgttagtgaagaaaggtttatggctaatacctatgaatttgacattagctaaagaagaagcaccgg

SEQ ID NO: 4152 - DNA, 152 bp, Unknown
  Ascusbbf_574568, encodes 16S rRNA
agagtttgatcctggctcagcatcgtcccgggtttaatctcgtcctcctcatcttgccagcagccgcggtaatagctagagtttgatcctggctcaggccagcagccgcggtaatagagtttgatcatggctcagccagcagccgcggtaat

SEQ ID NO: 4153 - DNA, 483 bp, Unknown
  Ascusbbf_911551, encodes 16S rRNA
agagtttgatcctggctcagggtgaacgctggcggtatgcctaagacatgcaagtcgaacgggctgtttatgcagccagtggcggacgggtgagtaacacgtaggtgacctaccccaaagtctgggacaactaggagaaatcttagctaatcctggatgtggacatctactttggtggatgtttaaagcttcggcgctttgggatgggcctgcggcgcatcaggtagttggtggggtaatggcctaccaagccgacgacgcgtagctggtctgagaggacgatcagccacaggggtactgagacacggaccccactcctacgggaggcagcagttaggaatcttccgcaatgggcgaaagcctgacggagcgataccgcttgaaggacgaagcccttcggggtgtaaacttctgaactcgggacgataatgacggtaccggggtaatagcaccggctaactccgtgccagcagccgcggtaat

SEQ ID NO: 4154 - DNA, 490 bp, Unknown
  Ascusbbf_1534675, encodes 16S rRNA
agagtttgatcctggctcaggatgaacgctagcggcaggcttaacacatgcaagtcgaggggcagcacgtcttcggatggtggcgaccggcgcacgggtgcgcaacgcgtatacaatctaccttttactggggcatagcccggggaaacccggattaatatcccatggtaccatgatatagcattatattatggttaaagctttggcggtgaaagatgagtatgcgttctattagctagatggtaaggtaacggcttaccatggctttgatagataggggtcctgagagggagatcccccacactggtactgagacacggaccagactcctacgggaggcagcagtgaggaatattggacaatgggcgagagcctgatccagccatgccgcgtgcaggaagacggccctatgggttgtaaactgcttttatacgggaagaaacaccccttcgtgaaggggcttgacggtaccgtatgaataaggatcggc

SEQ ID NO: 4155 - DNA, 261 bp, Unknown
  Ascusbbf_557827, encodes 16S rRNA
agagtttgatcctggctcaggatgaacgctagctacaggcttaacacatgcaagtcgaggggcagcattaaaggggaggcagcagtggggaatattgcacaatgggggaaaccctgatgcagccatgccgcgtgtgtgaagaaggccttcgggttgtaaagcacttttgcattcgaggaagacggcgtataaataaatgcgctatttgacgttagagtgtgaataagcaccggcaaactccgtgccagcagccgcggtaat

SEQ ID NO: 4156 - DNA, 490 bp, Unknown
  Ascusbbf_1073574, encodes 16S rRNA
agagtttgatcatggctcaggatgaacgctggcggcgtgcttaacacatgcaagtcgaacgctgaagctcccagcttgctgggggtggatgagtggcgaacgggtgagtatcacgtgagtaacctgccctgaactctgggataagcctgggaaactgggtctaatactggataggaccaatcatcgcctggtggttggtggaaagcctttgtgcggtttgggatggactcgcggcctatcagcttgttggtgaggtaatggcttaccaaggctttgacgggtagccggcctgagagggtgaccggccacactgggactgagacacggcccagactcctacgggaggcagcagtgggggatattgcacaatgggggaaaccctgatgcagcgacgccgcgtgagggatgacggccttcgggttgtaaacctctttcagttgggacgaagcccctttgggggtgacggtaccttcagaagaagcaccggcta

SEQ ID NO: 4157 - DNA, 490 bp, Unknown
  Ascusbbf_1862553, encodes 16S rRNA
agagtttgatcatggctcaggatgaacgctagcggcaggcctaacacatgcaagtcgaggggtagagttagcttgctaacttgagaccggcgcacgggtgcgtaacgcgtatgcaatctaccttgtagagggggatagcccagagaaatttggattaataccccatagtataatagagtggcatcattttattattaaagttccaacgctacaagatgagcatgcgtcccattagttagttggtgtggtaacggcgcaccaagacgatgatgggtaggggtcctgagagggagatcccccacactggtactgagacacggaccagactcctacgggaggcagcagtgaggaatattggtcaatggacgcaagtctgaaccagccatgccgcgtgcaggaagaaggctctatgggttgtaaactgcttttgtacgggaagaaattatccctcgtgagggagcttgacggtaccgtaagaataaggatcggc

SEQ ID NO: 4158 - DNA, 474 bp, Unknown
  Ascusbbf_1793580, encodes 16S rRNA
agagtttgatcctggctcaggatgaacgctggcggcgtgcttaatacatgcaagtcgagcggtaacacttcgggtgacgagcggcggacggctgagtaacgcgtaggaatgtaccccaaactgagggataactgcctgaaaaggtagctaataccgcatgtgatcttcggattaaagcttcggcggtttgggaacagcctgcgtatgattagctagttggtgaggtaatggctcaccaaggcaatgatcattagctggtctgagaggatgatcagccagactgggactgagacacggcccagactcctacgggaggcagcagtagggaattttccacaatggacgaaagtctgatggagcaacgccgcgtgcaggatgaaacccttcggggcgtaaactgcttttatatgtgaagattatgacggtagcatatgaataaggatcggctaactccgtgccagcagccgcggtaat

SEQ ID NO: 4159 - DNA, 472 bp, Unknown
  Ascusbbf_1769561, encodes 16S rRNA
agagtttgatcatggctcagagcgaacgctggcggcaggcttaacacatgcaagtcgagcggtcgtagcaatacggcagcggcagacgggagagtaacacgtgggaacgtgcccatcagttcggaacaacccagggaaacttgggctaataccggatacgcccttacggggaaagatttatcgctgatggagcggcccgcgtctgattagctagttggtgaggtaatggctcaccaaggcgacgatcagtagctggtctgagaggatgatcagcctcactgggactgagacacggcccagactcctacgggaggcagcagtgggggatattggacaatgggcgcaagcctgatccagccatgccgcgtggatgatgaaggccttagggttgtaaaatcctttcggcggggaagataatgacggtacccgcagaagaagccccggctaacttcgtgccagcagccgcggtaat

SEQ ID NO: 4160 - DNA, 490 bp, Unknown
  Ascusbbf_1886139, encodes 16S rRNA
agagtttgatcctagctcagattgaacgctggcggcaggcttaacacatgcaagtcgagcggatgaagggagcttgctcctggattcagcggcggacgggtgagtaatgcttaggaatctgcctattagtgggggacaacagttggaaacgactgctaataccgcatacgccctacgggggaaaggaggggatcttcggacctttcgctaatagatgagcctaagtcagattagctagttggtggggtaaaggcctaccaaggcgacgatctgtagcgggtctgagaggatgatccgccacactgggactgagacacggcccagactcctacgggaggcagccgtggggaatattggacaatgggggcaaccctgatccagccatgccgcgtgtgtgaagaaggccttttggttgtaaagcactttaagcgaggaggaggagctctagattaatactctagatgcttggacgttactcgcagaataagca

SEQ ID NO: 4161 - DNA, 490 bp, Unknown
  Ascusbbf_1713285, encodes 16S rRNA
agagtttgatcatggctcaagacgaacgctggcggcgcgcctaacacatgcaagtcgagcggggtaaggtttcggccttacttagcggcggacgggtgagtaacgcgtgagtaacctgcccttcagcgggggatagcgtcgggaaactgacggtaataccgcataatgtatagcgaaggcatcttagctataccaaaggagagattcactgaaggatggactcgcgtccaattaggtagttggtgaggcaatggctcaccaagccgacgattggtagccggactgagaggtcaatcggccacattgggactgagatacggcccaggctcctacgggaggcagcagtgggggatattgcacaatggaggaaactctgatgcagcgacgccgcgtgagggaagacggtcttcggattgtaaacctctgtcatacgggacgaaaaaaatgacggtaccgtatgaggaagccacggctaactacgtgccagcag

SEQ ID NO: 4162 - DNA, 480 bp, Unknown
  Ascusbbf_827778, encodes 16S rRNA
agagtttgatcatggctcagaacgaacgctggcggcatgcctaacacatgcaagtcgaacggtggcttcggccacagtggcgcacgggtgagtaacacgtgggaacctgcctttcggttcgggataacgtctggaaacggacgctaacaccggatacgcccttcctggagacaggttggggaaagttcacgccgagagaggggcccgcgtccgattaggtagttggtgaggtaacggctcaccaagccgacgatcggtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgcgacgatgatgacggtagcgtgagaagaagccccggctaacttcgtgccagcagccgcggtaat

SEQ ID NO: 4163 - DNA, 490 bp, Unknown
  Ascusbbf_1565529, encodes 16S rRNA
agagtttgatcctggctcaggacgaacgctggcggcgtgcttcatacatgcaagtcgaacgagaatctttagcttgctaaagaggaaagtggcggacgggtgagtaacacgtaggaaatctgcctcaaggagggggacaacatttggaaacggatgctaaaaccccgtatgaggttacctggaatggtaatcttgaaaactccggtgccttgagatgagcctgcgtccgattagcttgttggcggggtaaatgcccaccaaggcgacgatcggtagctggtttgagaagatgatcagccacaatgggactgagacacggcccatactcctacgggaggcagcagtagggaattttgcgcaatgggcgaaagcctgacgcagcaacgccgcgtgaatgaagaagcccttcggggtgtaaagttctgtcaccggggacgaaaaaatgacggtacccggagaggaagcaccggctaactccgtgccagcagcc

SEQ ID NO: 4164 - DNA, 490 bp, Unknown
  Ascusbbf_1779372, encodes 16S rRNA
agagtttgatcctggctcagattgaacgctggcggcaggcctaacacatgcaagtcgagcggcagcggggagtagcttgctactctgccggcgagcggcggacgggtgagtaatgcttgggaacttgcctttaggagggggataaccacgggaaactgtggctaataccgcataatgtctacggaccaaagcaggggatcttcggaccttgcacctagagataggcccaagtgagattagctagttggtggggtaaaggctcaccaaggcgacgatctctagctgttctgagaggatgatcagccacactgggactgagacacggcccagactcctacgggaggcagcagtggggaatattgcacaatgggggaaaccctgatgcagccatgccgcgtgtgtgaagaaggccttcgggttgtaaagcactttcagtggtgaggaaggctataagattaatactcttatagattgacgttagccacagaag

SEQ ID NO: 4165 - DNA, 470 bp, Unknown
  Ascusbbf_1012408, encodes 16S rRNA
agagtttgatcctggctcagaacgaacgctggcggcaggcttaacacatgcaagtcgaacgaactcttcggagttagtggcagacgggtgagtaacaggtgggaacctaccctgttcttcggaataacacatggaaacgtgtgctaataccggatacgcccttatggggaaagatttatcggaataggatgggcccgcgtaagattagctagatggtgaagtaatggctcaccatggcgacgatctttagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcagtggtgaagataatgacggtaaccacagaagaagccccggctaacttcgtgccagcagccgcggtaat

SEQ ID NO: 4166 - DNA, 490 bp, Unknown
  Ascusbbf_1427294, encodes 16S rRNA
agagtttgatcatggctcaggatgaacgctagctacaggcttaacacatgcaagtcgaggggcagcatggtttgtgcttgcacagaccgatggcgaccggcgcacgggtgagtaacacgtatccaacctgccttgtacccggggatagccctctgaaaggaggattaatacccgatgtgctgcggtggcggcatcgcctttgcagtaaagattcatcggtacacagatggggatgcgtctgattagcttgtcggcggggtaacggcccaccgaggctacgatcagtaggggttctgagaggaaggtcccccacataggaactgagacacggtcctaactcctacgggaggcagcagtgaggaatattggtcaatggtcgaaggactgaaccagccaagtagcgtgaaggatgactgccctacgggttgtaaacttcttttatgcgggaataaagtgtgccacgtgtggcattttgcatgtaccgcatgaa

SEQ ID NO: 4167 - DNA, 490 bp, Unknown
  Ascusbbf_1086672, encodes 16S rRNA
agagtttgatcctgggctcaggacgaacgctggcggcgtgcttaacacatgcaagtcgagcggtaaggccctttcgggggtacacgagcggcgaacgggtgagtaacacgtgagtaatctgcccttcactttgggataaccctcggaaacgggggctaataccggatattcattgctccgcgcatgtggggtggtggaaagatttggttcggtggaggatgggctcgcggcctatcagctggttggtggggtgatggcctaccaaggcgacgacgggtagccggcctgagagggtgaccggccacactgggactgagacacggcccagactcctacgggaggcagcagtggggaatattggtcaatgggcgagagcctgaaccagccaagtagcgtgcgggacgaaggccctatgggttgtaaaccgcttttacggggggataaagtgagtgacgtgtcattcattgcaggtaccccgcgaataaggacc

SEQ ID NO: 4168 - DNA, 164 bp, Unknown
  Ascusbbf_1861856, encodes 16S rRNA
agagtttgatcctggctcaggatgaacgctagcggcaggcttaacacatgcaagtcgaggggcatcgcggggcgggacgaatggcgtagcggtcaatacccgttacgagtgacggtaccgtaagagaaagccacggctaactacgtgccagcagccgcggtaat

SEQ ID NO: 4169 - DNA, 171 bp, Unknown
  Ascusbbf_1653821, encodes 16S rRNA
agagtttgatcatggctcagagtttgatcatggctcagagagtttgatcatggctcagagagtttgatcatggctcagccagcagccgcggtaatactcttccgatctagagtttgatcatggctcagccagcagccgcggtaataccagcaggccagcagccgcggtaat

SEQ ID NO: 4170 - DNA, 490 bp, Unknown
  Ascusbbf_674367, encodes 16S rRNA
agagtttgatcctggctcaggatgaacgctggcggcgtgcttaacacatgcaagtcgaacggaccggatttatctggtccgtggcagacgggtgcgtaacacgtaggtgacctgcccttgagtggggaataacgcgactaacgtcgcgctaataccgcatacgttggctccttcgctggggtcagtaaagcagcaatgcgcttggggatgggcctgcggcggattaggtagttggtggggtaagggcctaccaagccgatgatccgtagggggcgtgagagcgtggccccccacattggcactgagacacgggccaaactcctacgggaggcagcagtgaggaatattgcacaatgggcgcaagcctgatgcagcaacgccgcgtggaggacgacggccttcgggttgtaaactccttttctgggggacgagcaaggacggtacctcaggaataagtctcggctaactacgtgccagcagccgcggtaat

SEQ ID NO: 4171 - DNA, 490 bp, Unknown
  Ascusbbf_817819, encodes 16S rRNA
agagtttgatcatggctcagagcgaacgtttgcggcgggcttaacacatgcaagtcgtacgctgaacccttcggggggatgagtggcgcacgggtgcgtaacacgtgggtaaccaaccctgtagactgggacaaccgagggaaacttcggctaataccggatgtgctacatggggcttcggctctgtgtaggaaaggagcaatccgctacaggacgggcccgcggcccatcagctagttggtgaggtaacggctcaccaaggcaaagacgggtagctggtctgagaggatgatcagtcacactggaactgagacacggtccagactcctacgggaggcagcagtggggaatattgcgcaatgggcgaaagcctgacgcagccacgccgcgtgagcgatgaaggtcctaggatcgtaaagctctgtggggggagaagaaacctgacggtatccccttagcaagcaccggctaactccgtgccagcagccgc

SEQ ID NO: 4172 - DNA, 490 bp, Unknown
  Ascusbbf_1059042, encodes 16S rRNA
agagtttgatcatggctcaggacgaacgctggcggcgcgcttaacacatgcaagtcgaacggtgaacagcggaaagtttgcttttagctgtacatagtggcggacgggtgaataacgcgtgaggacttgccctgtacagggaaacaactgatggaaacgtcagctaataccccataagccatgagataaaaggagcgatccgatacaggagagactcgcgttctatcagttagttggtgaggtaacaactcaccaaggcgaagacggatagccggactgaaagattggccggccacattggaactgagatacgatccagactcctgcggaaagcagcagtagggaatattaggcaatgggggaaaccctgacccagcgacgccgcgtgagtgaagaaatccctcgaaatgtaaagctctattgtgcgggaagaaggaaataacgataccgcacgaggaagccacggcaaactacgtgccagcagccgcgg

SEQ ID NO: 4173 - DNA, 490 bp, Unknown
  Ascusbbf_1771696, encodes 16S rRNA
agagtttgatcatggctcaggatgaacgctggcggcgtgcttaacacatgcaagtcgagcgagagaacttgaaggaaaacttcggttagaattcgaatgatctagcggcggacgggtgagtaacgcgtgggaaacctgccttatacaaggggatagcctcgggaaaccgggattaataccctataaagccataggaacgcatgttctaatggtcaaagcgttagcggtataagatggtcccgcgtcccattagctagttggagaggtaaaggctcaccaaggcgacgatgggtagccggcctgagagggtgaacggccacactggaactgagacacggtccagactcctacgggaggcagcagtggggaatattgcacaatgggggaaaccctgatgcagcgacgccgcgtgagcgatgaaggctttcgggtcgtaaagctctgtcctaagggaagataatgacggtaccttaggaggaagccccggcta

SEQ ID NO: 4174 - DNA, 356 bp, Unknown
  Ascusbbf_595118, encodes 16S rRNA
agagtttgatcctggctcaggatgaacgctggcggcgtgcctaacacatgcaagtcgaacggaaagaattcttcggaattctttcggtggcggacgggtgagtaacgcgtgggtaacctgccccatacaggggaacaacagctggaaacggctgctaataccgcataagcgcacagtactgcatggtacagtgtgaaaagattttatcggtatgggatggggatgcgtctgattagccagttggcggggtaacggcccaccaaggcgacgatcagtaggggttctgagaggaaggtcccccacattggaactgagacacggtccaaactcctacgggagccagcagccgcggtaat

SEQ ID NO: 4175 - DNA, 490 bp, Unknown
  Ascusbbf_866423, encodes 16S rRNA
agagtttgatcatggctcaggacgaacgctggcggcgcgcctaacacatgcaagtcgaacgggggtattgagacggaagcttcggcagaagactcaatactttagtggcgaacgggtgagtaacacgtgaggaacctgcctttaagagggggataacacttagaaataggtgctaataccgcataagaccacgcagcggcatcgctgaggggtcaaaggaggaatccgcttaaagatggcctcgcgtccgattaggtagtaggcggggcaacggcccacctagccgacgatcggtagccggactgagaggttgaacggccacattgggactgagacacggcccagactcctacgggaggcagcagtggggaatattgggcaatgggggaaaccctgacccagcgacgccgcgtgagggaagaaggttttcggattgtaaacctctgtcttcagggaagaagaaagtgacggtaccttgtgagaaagtcac

SEQ ID NO: 4176 - DNA, 490 bp, Unknown
  Ascusbbf_690522, encodes 16S rRNA
agagtttgatcatggctcagattgaacgctggcggtatgcttaacacatgcaagtcgaacggcagcatggtctagcttgctagactgatggcgagtggcgaacgggtgagtaacgcgtaggaatataccttaaagagggggacaacttggggaaactcaagctaataccgcataatttcttaggaaaaaagctggggaccttcgggcctggcgctttaagattagcctgcgtacgattagctagttggtagggtaaaggcctaccaaggcgacgatcgttagctggtctgagaggatgaccagccacactggaactgagacacggtccagactcctacgggaggcagcagtggggaatattggacaatgggggcaaccctgatccagcaataccgcgtgtgtgaagaaggcctgagggttgtaaagcactttcagtggggaggaggatacttaggttaagagccagagtattggacgttacccacagaag

SEQ ID NO: 4177 - DNA, 490 bp, Unknown
  Ascusbbf_1024361, encodes 16S rRNA
agagtttgatcatggctcaggacgaacgctggcggcgtgcttaacacatgcaagtcgaacggtaaggccccttcgggggtacacgagtggcgaacgggtgagtaacacgtgagtaacctgccccagactctggaataagcattcgaaaggatgtctaatgccggatgttcacctagcttcacatgaagtctggtggaaagatttattggtctgggatggactcgcggcctatcagcttgttggtgaggtaatggctcaccaaggcttcgacgggtagccggcctgagagggcgaccggccacactgggactgagatacggcccagactcctacgggaggcagcagtgggaatattgcacaatggacgaaagtctgatgcagcaacgccgcgtgcgggatgaaggccttcgggttgtaaaccgctttcacccatgacgaagctaacgtgacggtaatgggagaagaagcaccggccaactacgtgccagca

SEQ ID NO: 4178 - DNA, 490 bp, Unknown
  Ascusbbf_1756071, encodes 16S rRNA
agagtttgatcctggctcagagcgaacgctggcggcaggcttaacacatgcaagtcgaacgggcgtagcaatacgtcagtggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaaaagctcaccaaggcgacgatcagtagctggtctgagaggatgaacggccacattggaactgagacacggtccagactcctacgggaggcagcagtggggaatcttccgcaatgggcgaaagcctgacggagcaacgccgcgtgagtgaagaaggccttcgggtcgtaaagctctgttgtcggggacgaatgtacgaactatcaacaacggttcgtaatgacggtacctgacgaggaagccacggctaactacgtgccagcagcc

SEQ ID NO: 4179 - DNA, 490 bp, Unknown
  Ascusbbf_650941, encodes 16S rRNA
agagtttgatcatggctcaggatgaacgctggcggcacgcttaacacatgcaagtcgaacggagagcttttggtttactgagagctcttagtggcggacgggtgagtaacacgtgagcaacctgcctttgagagagggatagcttctggaaacggatggtaatacctcatgacataacagtaccgcatgatattgttatcaaagatttatcactcaaagatgggctcgcgtctgattagatagttggtggggtaatggcctaccaagtcgacgatcagtagccggactgagaggttgaacggccacattgggactgagatacggcccagactcctacgggaggcagcagtcgggaatattgcgcaatggaggaaactctgacgcagtgacgccgcgtgcaggaagaaggttttcggactgtaaactgctttagacagggaagaataaagacagtacctgtagaataagctccggctaactacgtgccagc

SEQ ID NO: 4180 - DNA, 490 bp, Unknown
  Ascusbbf_1262105, encodes 16S rRNA
agagtttgatcctggctcaggacgaacgctggcggcatgcctaacacatgcaagtcgaacggactttttagtggaaaatccttcgggatcggaaattaaaaagttagtggcggacgggtgagtaacgcgtggataacctgcccataggttggagacaactccgggaaaccggagctaataccgaataaaatctattgaacacatgtttagtaaatcaaaggaggcctctcgaagaagcttctgccaatggatggatccgcgtctgattagctagttggtgaggtaacggcccaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctga

SEQ ID NO: 4181 - DNA, 490 bp, Unknown
  Ascusbbf_339826, encodes 16S rRNA
agagtttgatcatggctcagagtgaacgctggcggcgtgcttaacacatgcaagtcgaacgagaacgggttataacttgttataactgtcagctaagtggcgcacgggtgagtaatgtataggtaatatgccttctactaagggataacaattggaaacgattgctaataccttatattccttttaatcaaaagattgaaagggaaagatttatcggtagaagattggcctgtattgtatcagttagttggtggggtaatggcctaccaagacaatgacacataactggtttgagaggatgatcagtcacactggaactgagacacggtccagactcctacgggaggcagcagtggggaatattgcacagtggaggaaactctgatgcagccatgccgcgtgtgtgaagaaggccttcgggttgtaaagcactttcggaggggaggaacaaatgacgttaccctcagaagaagcaccggctaactccgtg

SEQ ID NO: 4182 - DNA, 470 bp, Unknown
  Ascusbbf_1138571, encodes 16S rRNA
agagtttgatcatggctcagaacgaacgctggtggcgtgtcttatacatgcaagtcgaacgattccttcggggatagtggcagacgggtgagtaacacgtgggaatctacctggttcttcgggataacagttggaaacggctgctaataccggatacgcccttttggggaaagatttatcggaatcagatgagcccgcgtaagattagctagatggtggggtaacggcctaccatggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcaccggtgaagataatgactgtagccggagaagaagccccggctaacttcgtgccagcagccgcggtaat

SEQ ID NO: 4183 - DNA, 392 bp, Unknown
  Ascusbbf_1527954, encodes 16S rRNA
agagtttgatcctggctcaggatgaacgctagctacaggcttaacacatgcaagtcgaggggcatcatggagtttgcttgcaaactctgatggcgaccggcgcacgggtgagttcgcgtccgattagatagttggtgaggtaacggcccaccaagtcgacgatcggtagccgacctgagagggtgatcggccacattggaactgagagacggtccaaactcctacgggaggcagcggtggggaatattgggcaatgggcgaaagcctgacccagcaacgccgcgtgagcgaagaaggctttcgggttgtaaagctctgttataggggacgaaggaagtgacggtaccctataaggaagccccggctaactacgtgccagcagccgcggtaat

SEQ ID NO: 4184 - DNA, 490 bp, Unknown
  Ascusbbf_1711503, encodes 16S rRNA
agagtttgatcctggctcaggacgaacgctggcggcgcgtcttaagcatgcaagtcgagcgggattgagtagcttgctactcatgagagcggcggactggtgagtaacgcgtgggtgacgtaccctgaggatggggatagctcctagaaataggaggtaataccgaatacggtgtgcagggttagagactgtacatcaaaggttcttttgaaccgccacaggagcggcccgcgtactattagttagttggcggggtaacggcccaccaagacgacgatagctacccggcctaagagggtgaacgggcacattgggactgagacacggcccaaactcctacgggaggcagcagtgggggatattgcacaatggaggaaactctgatgcagcgacgccgcgtgagtgaagaagtatttcggtatgtaaagctctatcagcagggaagaaagactcgaaagagagatgacggtacctgagtaagaagccccgg

SEQ ID NO: 4185 - DNA, 490 bp, Unknown
  Ascusbbf_1527535, encodes 16S rRNA
agagtttgatcctggctcaggatgaacgctggcggcatgcttaacacatgcaggtcgaacgggaagtggtgtttccagtggcgaacgggtgagtaacgcgtaagaacctgcccttgggaggggaacaacaactggaaacggttgctaataccccgtaggctgaggagcaaaaggagaaatccgcccaaggaggggctcgcgtctgattagctagttggtgaggcaatagcttaccaaggcgatgatcagtagctggtccgagaggatgatcagccacactgggactgagacacggcccagactcctacgggaggcagcagtggggaattttggtcaatgggcgggagcctgaaccagccaagtcgcgtgagggaggaaagtcctacggattgtaaacctctttagccggggagcaacgtgcgccacgtgtggcgcagtgagagtacccggagaataagcatcggctaactccgtgccagcagccgcggta

SEQ ID NO: 4186 - DNA, 490 bp, Unknown
  Ascusbbf_512475, encodes 16S rRNA
agagtttgatcatggctcaggacgaacgctggcggcgtgcctaatacatgcaagtcgagcgagggtctttacgaccctagcggcggacgggtgagtaacacgtaggcaacctgcctctcagaccgggataacatagggaaacttatgctaataccggataggtttttggatcgcatgatccgaaaagaaaagatggcttcggctatcactgggagatgggcctgcggcgcattagctagttggtggggtaacggcctaccaaggcgacgatgcgtagccgacctgagagggtgaccggccacactggtactgagacacggaccaaactcctacgggaggcagcagtgaggaatattggtcaatgggcgagagcctgaaccagccaaatagcgtgcaggatgactgccctatgggttgtaaactgcttttatacggggataaagtgaggtatgcatacctttttgtaggtaccgtatgaataaggaccggc

SEQ ID NO: 4187 - DNA, 490 bp, Unknown
  Ascusbbf_1668137, encodes 16S rRNA
agagtttgatcatggctcaggatgaacgctagctacaggcttaacacatgcaagtcgaggggcatcaggatctgtgcttgcacagattgctggcgaccggcgcacgggtgagtaacgcgtatccaaccttccgcatagtagggaatagcccggcgaaagtcggattaatgccctatgttttccgatgaggacatctgagctggaacaaagatttatcgctatgcgatggggatgcgtctgattaggttgttggcggggtaacggcccaccaagccgacgatcagtaggggttctgagaggaaggtcccccacattggaactgagacacggtccagactcctacgggaggcagcagtgaggaatattggtcaatggccgcaaggctgaaccagccaagtagcgtgaaggatgacggccctccgggttgtaaacttcttttgtcggagattaaggtgccccacgcgctggggtattgcagtaatccgtcgaa

SEQ ID NO: 4188 - DNA, 490 bp, Unknown
  Ascusbbf_1592375, encodes 16S rRNA
agagtttgatcctggctcaggacaaacgctggcggggtgcgtgagacatgcaagtcgaacgaggtgccaacgagcttgctcgatggctacctagtggcggacggctgagtaacgcgtaggtgacctgcccggaagtggggaataactgcccgaaagggtggctaataccgcatgtggtcggcgattcggttcgccgtctaaaggagtaatccgcttccggcggggcctgcgtccgattagctagttggtggggtaacggctcaccaaggcgacgatcggtagctggtctgagaggatgatcagccagactgggactgaggacggcccagactcctacgggaggcagcagtcgggaattttcggcaatggggggaaccctgaccgagcaacgccgcgtgagtgaagaaggttttcggatcgtaaaactctgttgttagagaagaacgttgcatagagtggaaagttatgcaagtgacggtatctaaccaga

SEQ ID NO: 4189 - DNA, 490 bp, Unknown
  Ascusbbf_684430, encodes 16S rRNA
agagtttgatcatggctcaggatgaacgctggcggcgtgcctaacacatgcaagtcgaacgtgaggggatagcaatatctctgaaagtggcgaacgggtgagtaacacgtaggtaacctgccgcgcagagggggataacgactagaaatggtcgctaataccgcatggtactatccaaacgggagttcgggtggttaaaactttggtgctgcgcgaggggtctgcgtccgattagttagttggtgaggtaatggctcaccaagacgatgatcggtagctggtctgagaggatgatcagtcacacgggaactgagacacggtcccgactcctacggggggcagcagtgaggaatattgcacaatggacgcaagtctgatgcagcaacgccgcgtggaggatgaaggcccttgggtcgtaaactccttttttcagggaagagtgaggacggtacctgaagaataagtcacggctaactacgtgccagcagcc

SEQ ID NO: 4190 - DNA, 490 bp, Unknown
  Ascusbbf_854666, encodes 16S rRNA
agagtttgatcctggctcaggatgaacgctggcggcgtgcttaacacatgcaagtcgaacgaaccaataggagcttgctccttgcggttagtggcggatgggtgagtaacgcgtgggtaatctgccttatacaatggaataactcagagaaatctgtgctaaaaccttataagcttacactgccgcatggcagagtaagaaaaactttagtggtataagatgagcccgcgtccgattagctagttggtgagataatagctcaccaaggcaacgatcggtaaccggcctgagagggtggacggtcacactgggactgagacacggcccagactcctacgggaggcagcagtggggaatattgcacaatgggggaaaccctgatgcagcaacgccgcgtgaaggatgaaggttttcggatcgtaaacttctatcagtagggaagaaaaaaatgacagtacctaactaagaagccccggctaactacgtgcca

SEQ ID NO: 4191 - DNA, 483 bp, Unknown
  Ascusbbf_1361515, encodes 16S rRNA
agagtttgatcctggctcagaacgaacgctggcggcaggcttaacacatgcaagtcgaacgccccgcaaggggagtggcagacgggtgagtaacgcgtgggaatctaccctttgctacggaatagctccgggaaactggaattaataccgtatgtgcccattgtccttggcggatggtggggaaagatttatcggcaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaat

SEQ ID NO: 4192 - DNA, 490 bp, Unknown
  Ascusbbf_1753100, encodes 16S rRNA
agagtttgatcctggctcaggacgaacgctggtggcgtgcttaacacatgcaagtcgagcgaggcgtccgccttcgggcggtcagtcgagcggcgaacgggtgagtaacacgtgagcaatctccccttggctcggggataacctcgggaaactgaggctaataccggatactctttttctggggcctcccggaaaaaggaaaggtttcgcaccgtgaggtgcggttccggccttgaatgagctcgcggcctatcagcttgttggtgcggtaaatgcgcaccaaggcgacgacgggtagccggcctgggagggtgatcggccacactgggactgagatacggcccagactcctacgggaggcagcagtggggaatcttgcgcaatgggcgaaagcctgacgcagcaacgccacgtgggggatgacggccttcgggttgtaaacctctttcggtcttgacgaagacatccctgctaggggtgttgacggtag

SEQ ID NO: 4193 - DNA, 490 bp, Unknown
  Ascusbbf_856589, encodes 16S rRNA
agagtttgatcatggctcaggatgaacgctagctacaggcttaacacatgcaagttgaacgggaatgtttgatagcttgctattaagcatgagagtagcgcactggtgagtaacacgtgggaacgtgccttttagtgggggacaacagttggaaacgactgctaataccgcatacgccctgagggggaaagatttatcgctaaaagatcggcccgcggaagattaggtagtaggtggggtaaaggcctacctagccgacgatctatagctggtctgagaggacgatcagccacattggaactgagacacggtccagactcctacgggaggcagcagtgaggaatattggtcaatggtcggaagaccgaaccagccaagtagcgtgagggatgactgccctatgggttgtaaacctcttttattggggaacaaaggggatcacgtgtggtcctttgcgtgtaccctatgaataagcatcggctaattccgt

SEQ ID NO: 4194 - DNA, 490 bp, Unknown
  Ascusbbf_1586849, encodes 16S rRNA
agagtttgatcctggctcaggacgaacgctggcggcgtgcctaatacatgcaagtcgaacgagaattcgtggatagaggtttcggccaattgaagcggaggaaagtggcggacgggtgagtaacgcgtgaggaacctgcctttcagagggggacaacagttggaaacgactgctaataccgcatgatgcataggagtcgcatggctcttatgccaaagatttatcgctgaaagatggcctcgcgtctgattagctagttggtgaggtaacggcccaccaaggcgacgatcagtagccggactgagaggttgaacggccacattgggactgagatacggcccagactcctacgggaggcagcagtggggaatcttccgcaatggacgaaagtctgacggagcaacgccgcgtgagtgaagaaggtcttcggattgtaaagctctgttgtaagggaagaacgtcaggcagaggatgcttgagtgacggtacc

SEQ ID NO: 4195 - DNA, 490 bp, Unknown
  Ascusbbf_1575189, encodes 16S rRNA
agagtttgatcctggctcaggacgaacgctggcggcgtgcttaacacatgcaagtcgagcggaaaggccacttcggtggtactcgagcggcgaacgggtgagtaacccgtgagtaatctgccccggacttcgggatagcccaccgaaaggtggattaataccggatatgacacatcttcgcatgttggtgtgtggaaagttttttcggtctgggatgtgctcgcggcctatcagcttgatggtgaggtaatggctcaccatggcttcgacgggtagccggcctgagagggtgaccggtcacactgggactgagacacggcccagactcctgcgggaggcagcagtggggaatattgcacaatggagggaactctgatgcagcgacgccgcgtgagtgaagaagtatttcggtatgtaaagctctatcagcagggaagaagacgacggtacctgactaagaagccccggctaactacgtgccagcagctgc

SEQ ID NO: 4196 - DNA, 490 bp, Unknown
  Ascusbbf_547744, encodes 16S rRNA
agagtttgatcatggctcaggacgaacgctggcggcgtgcttaacacatgcaagtcgaacggtaaggccccagcttgctggggtacacgagtggcgaacgggtgagtaacacgtgggtgacctgccccgcacttcgggataagcctgggaaactgggtctaataccggataggaccgcaccgtgagggtgtggtggaaagtttttcggtgtgggatgggcccgcggcctatcagcttgttggtggggtaatggcctaccaaggcggcgacgggtagccggcctgagagggtggacggccacattgggactgagacacggcccagactcctacgggaggcagcagtggggaatcttccgcaatgggcgcaagcctgacggagcaacgccgcgtgagtgaggaagtttttcggaacgtaaagctctgttgtacccgacgaacgtgccacctatgtacaacgggtggtaatgacggtagggtgcgaggaagcc

SEQ ID NO: 4197 - DNA, 490 bp, Unknown
  Ascusbbf_1632242, encodes 16S rRNA
agagtttgatcatggctcaggatgaacgctggcggcatgcctaagacatgcaggtcgaacgaagtagcctaatgaagattgcgtgcttgcacaaaattggatttagattcctacttagtggcagacgggtgagtaacacgtgggtaacctaccttggagactgggataacagttagaaatgattgctaataccggatgattcatagatagataactatttatgctaaaaggagctttcgcttcacttcaagatgggcttgcgttgtattagttagttggtggggtaatggcctaccaagacaacgatgcatatccgagctgagaggctgatcggacacattgggactgagacacggcccagactcctacgggaggcagcagtggggaatcttccgcaatgggcgcaagcctgacggagcaacgccgcgtgagtgaggaagtttttcggaacgtaaagctctgttgtacccgacgaacgtgccacctatga

SEQ ID NO: 4198 - DNA, 470 bp, Unknown
  Ascusbbf_1292390, encodes 16S rRNA
agagtttgatcatggctcagaacgaacgctggcggcaggcttaacacatgcaagtcgaacgaagtcttcggacttagtggcagacgggtgagtaacgcgtgggaatctacccagtcctacgggatagctccaggaaactggaattaataccgtatacgcccttttggggaaagatttatcgggattggatgagcccgcgtaagattagctagttggtggggtaatggcctaccaaggcgacgatctttagctggtctgagaggatgatcagccacactgggactgagacacggcccagattcctacgggaggcagcagtggggaatattggacaatgggggcaaccctgatccagccatgccgcgtgagtgatgaaggccttagggttgtagagctctttcaccggagaagataatgacggtatccggagaagaagccccggctaacttcgtgccagcagccgcggtaat

SEQ ID NO: 4199 - DNA, 490 bp, Unknown
  Ascusbbf_490060, encodes 16S rRNA
agagtttgatcctggctcaggacgaacgctggcggcgtgcttaacacatgcaagtcgagcgatgaagccccttcgggggtggattagcggcggacgggtgagtaacacgtgggtaacctgcctcaaagagggggatagcctcccgaaagggagattaataccgcataaagcagaattccacatggagttttgatgaaaggagtaatccgctttgagatggacccgcggcctgttagctagttggcggggcaacggcccaccaaggcgactatgggtagctgggttgagagaccgaccagccagattgggactgagacacggcccagactcctacgggaggcagcagtggggaatcttgcgcaatgggcggaagcctgacgcagcgacgccgcgtgcgggaggaaggccctcgggtcgtaaaccgctttcagcagggacgaggccgcaaggtgacggtacccgcagaagaggccccggctaactacgtgcc

SEQ ID NO: 4200 - DNA, 490 bp, Unknown
  Ascusbbf_1507442, encodes 16S rRNA
agagtttgatcctggctcaggacgaacgctggcggcgtgcttcatacatgcaagtcgaacgagaaattcacttcggtggatggaaagtggcggacgggtgagtaatgtgtagagaatctgccctggagtgggggacaacagagggaaacttctgctaataccccatatgagcgtagttgcgatactattcttgaaagatttatcgctccaggatgagtctgcatctgattagctagttggaggtgtaatggaccaccaaggcaacgatggataggggttctgagaggaaggtcccccacactggaactgagacacggtccagactcctacgggaggcagcagtgaggaatattggtcaatggacgagagtctgaaccagccaagtagcgtgcaggatgacggccctatgggttgtaaactgcttttatgcggggataaagtgagggacgtgtcccttattgtaggtaccgcatgaataaggaccggctaa

SEQ ID NO: 4201 - DNA, 470 bp, Unknown
  Ascusbbf_594923, encodes 16S rRNA
agagtttgatcctggctcagagcgaacgctggcggaatgcttaacacatgcaagtctcacgggcagcaatgtcagtggcggacgggtgagtaacgcgtaggaatgtgtcctgggatgggggataacgtcgggaaactggcgctaataccgcatatgagctgaggctcaaagccgcgaggcgtcttgggagcagcctgcgtccgattagcttgttggtggggtaaaggcctaccaaggctacgatcggtagctggtctgagaggatgatcagccacactggaactgagacacggtccagactcccacgggaggcagcagtggggaatattggacaatgggcgaaagcctgatccagcaattccgcgtgggtgaagaaggtcttcggattgtaaagccctttcgacgggaacgatgatgacggtacccgtagaagaagccccggctaacttcgtgccagcagccgcggtaat

SEQ ID NO: 4202 - DNA, 490 bp, Unknown
  Ascusbbf_874830, encodes 16S rRNA
agagtttgatcctggctcagaacgaacgctggcggcgtgcttaatacatgcaagtcgcacgagaaagtccttcgggatgagtaaagtggcgcacgggagagtaatgcataggaacgtacctgtaggtggggaataaccactggaaacggtggctaataccgcacggtgtcgcaagactaaagttggcctctatttataagctagcgcctacagagcggcctatgtcccattagctagttggcggggtaatagcccaccaaggcgacgatgggtagctggtcttagaggatgatcagcctcactgggactgagacacggcccagactcctacgggaggcagcagtagggaattttgcacaatgggcgcaagcctgatgcagcaacgccgcgtgagtgaagaaggcccttgggttgtaaagctctttcagctggaaagaagggacgtcctgcgaacagttggatgttttgacggtaccagcacaagaagcac

SEQ ID NO: 4203 - DNA, 490 bp, Unknown
  Ascusbbf_568212, encodes 16S rRNA
agagtttgatcatggctcaggatcaacgctggcggcgtgcctaatgcatgcaagtcgagcggggtgatcttcggatcacttacgcggcggacgggtgcggaacacgtgggcaacctgccccgaggtgggggatagccggtggaaacaccgggtaatcccgcataaggtcgccagtcggaggactggtgaggaaaggctcttcggagtcgccttgggaggggcctgcggccgattagctagacggtggggtaacggcctaccgtggcgatgatcggtagctggtctgagaggacggccagccacacggggactgagacacggccccgactcctacgggaggcagcagtgaggaatattggtcaatgggcgaaagcctgaaccagccaagtagcgtgcaggacgacggccctatgggttgtaaactgcttttataggggaataaagttatccacgtgtggatatttgcatgtaccctatgaataaggaccgg

SEQ ID NO: 4204 - DNA, 490 bp, Unknown
  Ascusbbf_1334275, encodes 16S rRNA
agagtttgatcctggctcaggatgaacgctagctacaggcttaacacatgcaagtcgaggggcagcatgacggaagcttgcttccgttaatggcgaccggcgcacgggtgagtaacgcgtatccaacctgcccttgtccatcggataacccgtcgaaaggcggactaacacgatatgcagtccacagcaggcatctaacgtggacgaaatgtgaaggagaaggatggggatgcgtctgattagcttgttggcggggtaacggcccaccaaggcgacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttataagggaataaagttagtctcgtgagactttttgcatgtaccttatgaataa

SEQ ID NO: 4205 - DNA, 152 bp, Unknown
  Ascusbbf_610314, encodes 16S rRNA
agagtttgatcatggctcagagcctcgtacatcgctttgagattgtttaaatcgttgtgatctagtgcgttcgctaaaacaatccattggttcagtttaggatcaaacatctgatcagcaatcgttagcggttcgccagcagccgcggtaat

SEQ ID NO: 4206 - DNA, 490 bp, Unknown
  Ascusbbf_1325933, encodes 16S rRNA
agagtttgatcatggctcaggatgaacgctagctacaggcttaacacatgcaagtcgagcgggcccttcggggtcagcggcagacgggtgagtaacacgtggaaacgtaccctttggttcggaataacgctgggaaactagcgctaataccggatacgcccttggcctttggccctggggaaaggcttgctgccgaaggatcggcccgcgtctgattagctagttggtggggtaatggcccaccaaggcgacgatcggtaggggctctgagaggaggatcccccacattggaactgagacacggtccaaactcctacgggaggcagcagtggggaatattggtcaatgggcgagagcctgaaccagccaagtagcgtgagggatgactgccctatgggttgtaaacctcttttgtttgggaataaagtgagccacgtgtggctttttgtatgtaccttacgaataagcatcggctaattccgtgccagca

SEQ ID NO: 4207 - DNA, 488 bp, Unknown
  Ascusbbf_541202, encodes 16S rRNA
agagtttgatcctggctcagaacgaacgctggcggcaggcttaacacatgcaagtcgagcgccccgcaaggggagcggcagacgggtgagtaacgcgtgggaatctacccatctctacggaataactcagggaaacttgtgctaataccgtatacgcccttcgggggaaagatttatcggagatggatgagcccgcgtccgattaggtagttggtgaggcaacggctcaccaagccgacgatcggtagccggactgagaggtcgatcggccacattgggactgagacacggcccagactcctacgggaggcagcagtgaggaatattggtcaatgggcgagagcctgaaccagccaagtagcgtgcaggatgacggccctatgggttgtaaactgcttttgcatgggaataaagtgagggacgtgtccctttttgtatgtaccatgagaataaggaccggctaattccgtgccagcagccgcggtaat

SEQ ID NO: 4208 - DNA, 490 bp, Unknown
  Ascusbbf_983749, encodes 16S rRNA
agagtttgatcatggctcaggacgaacgctggcggcgtgcttcattcatgcaagtcgaacgataaggtctcttcggagatacataagtggcggacgggtgagtaaaatgtagagaatctgccctagagcgggggataacagagggaaacttctgctaataccccatatgcgcgtagttgagatactattcgtgaaaactccggtgctctaggatgagtctgcatctgattagctagttggcggtgtaatggaccaccaaggcgacgatcggtaggggttctgagaggaaggccccccacaatggaactgagacacggtccatactcctacgggaggcagcagtgggggatattgcgcaatgggggcaaccctgacgcagcaatgccgcgtgagtgaagaagtatttcggtatgtaaagctctatcagcagggaagataatgacagtacctgaccaagaagccccggctaactacgtgccagcagccgcgg

SEQ ID NO: 4209 - DNA, 490 bp, Unknown
  Ascusbbf_984977, encodes 16S rRNA
agagtttgatcatggctcaggatgaacgctggcggcatgcctaagacatgcaagtcgaacgaggtggcccaaagaagattgagtgcttgcacaagattggaattggattaccacctagtggcggacgggtgagtaacacgtaggtgacctgcctttgagtttgggataactattagaaatgatagctaataccggattaaatatagattcatttctatattaaaaggagcctttaaagcttcgcttaaagatgggcctgcggcgtattagctagttggcgaggtaatggcttaccaaggcgacgatgcgtagccgaactgagaggttgatcggccacattgggactgagacacggcccaaactcctacgggagacagcagttaggaatattcgtcaatgggggaaaccctgaacgagcaatgccgcgtgaaggatgaaggttttcggattgtaaacttcttttattaaggacgaataatgacggtactta

SEQ ID NO: 4210 - DNA, 490 bp, Unknown
  Ascusbbf_1794113, encodes 16S rRNA
agagtttgatcatggctcaggatgaacgctggcggcgtgcttaacacatgcaagtcgaacgaggaatactgatgaagttttcggatggaatcggtattccgagtggcggacgggtgagtaacgcgtgggtaacctgctgtacagggggataacagttggaaacgactgttaataccgcataagaccacagtgccgcatggcacaggggtaaaaactccggtggtacaggatggacccgcgtccaattagctagttggtgaggtaacggcccaccaaggcgacgattggtagccgatctgagaggatgaccggccacattgggactgagacacggcccaaactcctacgggaggcagcagtggggaatattgcacaatgggggaaaccctgatgcagcgacgccgcgtgagtgatgaagtgtttcggctcgtaaagctctgttgtcggggacgaatgtcaaaggtgtgaacaatgtctttgaatgacggta

SEQ ID NO: 4211 - DNA, 490 bp, Unknown
  Ascusbbf_643127, encodes 16S rRNA
agagtttgatcctggctcaggatgaacgctagcgacaggcttaacacatgcaagtcgaacgaagcaattgcgacagaagccttcgggtggaagatgtaattgactgagtggcggacgggtgagtaacgcgtgggtaacctgccttgtacagggggataacagttagaaatgactgctaataccgcataagcgcacagtatcgcatgatacagtgtgaaaaactccggtggtatgagatgggcccgcgtcagattagccagttggcagggtaacggcctaccaaagcgacgatctgtagccggcctgagagggcggacggccacattgggactgagacacggcccaaactcctacgggaggcagcagtgggggatattgcgcaatgggggcaaccctgatgcagcaacgccgcgtgagggaggacggtcttcggattgtaaacctctgtccttggggaagaaacaaatgacggtacccttggaggaagcca

SEQ ID NO: 4212 - DNA, 485 bp, Unknown
  Ascusbbf_577058, encodes 16S rRNA
agagtttgatcctggctcagaacgaacgctggcggcgtggataagacatgcaagtcgaacgaagtggcttcggtcacttagtggcgcacgggtgagtaacacgtgagcaacctgcccctgagacagggatagccccgggaaactgggattaatacctgatggtctcgcaagagtaaagtagcaatacgctcagggaggggctcgcggcctattagttagttggcggggtaacggcccaccaaggcgatgacgggtagccggtctgagaggatgtccggccacactggaactgagacacggtccagacacctacgggtggcagcagtcgagaatcattcacaatgggcgaaagcctgatggtgcgacgccgcgtgggggaggaaggtcttcggattgtaaacccctgtcatgcaggagcaagacgcaagtttgatagtactgcaagaggaagagacggcaaactctgtgccagcagccgcagtaat

SEQ ID NO: 4213 - DNA, 490 bp, Unknown
  Ascusbbf_1559391, encodes 16S rRNA
agagtttgatcctggctcaggatgaacgctagcggcaggcctaatacatgcaagtcgaacgagattggaagagcttgcttttccatgaaagtggcgcacgggtgcgtaacgcgtatgcaacctaccttaatcagggggatagcctctcgaaagagagattaacaccgcataatatcattttccggcatcggagaatgatcaaatatttataggattaagatgggcatgcgtgacattagttagttggtgaggtaacggctcaccaagacgatgatgtctaggggatctgagaggatgaccccccacactggtactgagacacggaccagactcctacgggaggcagcagtaaggaatattggtcaatggaggcaactctgaaccagccatgccgcgtgcaggaagacggccctatgggttgtaaactgcttttatacgggaataaacccctttacgtgtagagggttgaatgtactgtaagaataaggat

SEQ ID NO: 4214 - DNA, 490 bp, Unknown
  Ascusbbf_516504, encodes 16S rRNA
agagttgatcctggctcaggataaacgctggcggcgcacataagacatgcaagtcgaacggacttaactcattcttaacgattgagagcggttagtggcggattggtgagtaatgtataagtaacctgcctatcagaggggaacaacagttggaaacgactgctaataccgcatgagaccacggtttcgcatggaactgaggtaaaaggatttattcgatgcaggatgggctcgcgtcccattagatagttggtgaggtaacggctcaccaagtcaacgatgggtagccgacctgagagggtgatcggccacactggaactgagacacggtccagactcctacgggaggcagcagtggggaatattgggcaatgggcgaaagcctgacccaacaacgccgcgtgagggaagaaggtcttcggattgtaaacctttgtcctatggggcgaaacaaatgacggtaccataggaggaagctccggctaactac

SEQ ID NO: 4215 - DNA, 490 bp, Unknown
  Ascusbbf_1334421, encodes 16S rRNA
agagtttgatcatggctcaggacgaacgctggcggcgcgcctaacacatgcaagtcgaacggggcataatttagatttcttcggaatgataggttatagcctagtggcggacgggtgagtaacacgtgagcaatctgccttacagatggggataacggccagaaatgggtgctaatacccaatgacatatggtattcgcatgaatggcatattaaaggaattcgcaagaattttgctgtgagatgagctcgcggtcgattatgatagttggtgaggtaatggctcaccaagtctacgatcgatagccgaactgagaggttgatcggccacattgggactgagacacggcccagactcctacgggaggcagcagtcgggaatattgcacaatgggggaaaccctgatgcagcgacgccgcgtgaaggaagaagtatctcggtatgtaaacttctatcagcagggaagaaaatgacggtacctgactaagaa

SEQ ID NO: 4216 - DNA, 490 bp, Unknown
  Ascusbbf_1496757, encodes 16S rRNA
agagtttgatcctggctcaggatgaacgctggcggcgtgcttaacacatgcaagtcgaacgaggtataaggacggaagttttcggacggaagaccttgtactgagtggcggacgggtgagtaacgcgtgggaaacctgccctgttccgggggataccagttggaaacgactgttaataccgcataagcgcacagcttcgcatggagcagtgtgaaaaactccggtggtgtgagatggacccgcgtctgattagatagttggtggggtaacggcctaccaagccgacgatcagtagccgacctgagagggtgaccggccacattgggactgagacacggaccaaactcctacgggaggcagcagtgaggaatattggtcaatgggcgaaagcctgaaccagccaagtagcgtgcaggatgacggccctatgggttgtaaactgcttttataggggaataaagttatccacgtgtggatatttgcatgtacc

SEQ ID NO: 4217 - DNA, 480 bp, Unknown
  Ascusbbf_1667181, encodes 16S rRNA
agagtttgatcctggctcagaacgaacgctggcggcaggcctaacacatgcaagtcgagcgagatcttcgggtctagcggcggacgggtgagtaacgcgtgggaatatgccctttgctacggaatagtcctgggaaactgggggtaataccgtatacgcccttttggggaaagatttatcggcgaaggattagcccgcgttggattaggtagttggtggggtaatggcctaccaaggcgatgatctctagctggtctgagaggatgaccagccacactggaactgagacacggtccagactcctacgggaggcagcagtagggaatattgcacaatggggggaaccctgatgcagccatgccgcgtgtgtgaagaaggccttcgggttgtaaagcactttcagtcaggaggaaggtagtgatacttgacgttactgacagaagaagcaccggctaactccgtgccagcagccgcggtaat

SEQ ID NO: 4218 - DNA, 490 bp, Unknown
  Ascusbbf_1794454, encodes 16S rRNA
agagtttgatcatggctcaggatgaacgctggcggcgtgcttaacacatgcaagtcgaacggtgaagccaagcttgcttggtggatcagtggtgaacgggtgagtaacacgtgagcaacctgccctggactctgggataagcgctggaaacggcgtctaatactggatatgagcctctatcgcatggtgggggttggaaagattttttggtctgggatgggctcgcggcctatcagcttgttggtgaggtaatggctcaccaaggcgtcgacgggtagccggcctgagagggtgaccggccacattgggactgaggcacggcccagactcctacgggaggcagcagtgggggatattgcgcaatgggggcaaccctgacgcagcaacgccgcgtgaaggatgaaggttttcggattgtaaacttcttttattaaggacgaataatgacggtacttaatgaataagctccggctaactacgtgccagcagc

SEQ ID NO: 4219 - DNA, 490 bp, Unknown
  Ascusbbf_1644143, encodes 16S rRNA
agagtttgatcctggctcaggatcaacgctggcggcgtgcctaatgcatgcaagtcgaacgggctcgccttcgggcgggtcacgtggcggacgggtgaggaacacgtgggcgacctaccctggggcgggggatagccgcgagaaatcgtgggtaattccgcatgtgctcccttgagcgtggcttgagggaggaaaggtgtgtttcggcacgccacccttggcggggcctgcggccgattagctagttgggggggtaacggcttcccaaggcgatgatcggtagctggtctgagaggacggccagccacacggggactgagacacggccccgactcctacgggaggcagcagcaaggaatcttccgcaatgggcgaaagcctgacggagcaacgccgcgtgcgggatgacgcctttcggggtgtaaaccgcttttctgggggaagaagacgggctttggtccgtttgacggtaccccaggaagaaggaccg

SEQ ID NO: 4220 - DNA, 490 bp, Unknown
  Ascusbbf_1101699, encodes 16S rRNA
agagtttgatcctggctcaggacgaacgctggcggcgtgcctaacacatgcaagtcgaacggagtttgttggattgatccttcgggtgattgatagcaaacttagtggcggacgggtgagtaacacgtgagcaacctgccttacagagggggataacgttctgaaaagaacgctaataccgcataacatattgagtgggcatccacttgatatcaaaggagcaatccgctgtagatgggctcgcgtccgattagccagttggcggggtaacggcccaccaaagcgacgatcggtagccggactgagaggttgaacggccacattgggactgagacacggcccagactcctacgggaggcagcagtagggaattttgcgcaatgggcgaaagcctgacgcagcaacgccgcgtgatcgtagaagtccttcggggtgtaaagatctgtcagtagggacgaacaatgactgtacctacagaggaagcaccggc

SEQ ID NO: 4221 - DNA, 475 bp, Unknown
  Ascusbbf_1534519, encodes 16S rRNA
agagtttgatcatggctcaggatgaacgctggcggcatgcctaatacatgcaagtcgtgcggaaacacttcgggtgtcgagcggcggacgggtgagtaacgcgttagtatctgccccaaactgagggataagccaaagaaatttggtctaataccgcatatggtcttcggattaaagccttcgggcggtttgggaggtgcttgcgtctgattagctagttggtaaggtaatggcttaccaaggctacgatcagtaactggtctgagaggatgatcagtcacactggaactgagacacggtccagactcctacgggaggcagcagtagggaattttccacaatgggcgaaagcctgatggagcaatgccgcgtgcaggatgaatgccttcgggttgtaaactgcttttatgagggaagattatgacggtacctcatgaataagcctcggctaactccgtgccagcagccgcggtat

SEQ ID NO: 4222 - DNA, 490 bp, Unknown
  Ascusbbf_1589380, encodes 16S rRNA
agagtttgatcctggctcaggatgaacgccagctacaggctttacacatgcaagtcgagcgaggcggcccgcaagggccagtcgagcggcgaacgggtgagtaacgcgtggattatctgccctaaggtgggggataacccggggaaactcgggctaataccgcatatgaccgtgaggtcaaaggggggtcgcaagatctctcgccattggaggagtccgcgtccgattagctagttggtagggtaatggcctaccagggcgacgatcggtagccggcctgagagggtgatcggccacactggaactgagacacggtccagactcctacgggaggcagcagtggggaattttgcgcaatgggctaacgcctgacgcagcaacgccgcgtggaggatgaaggtctttggattgtaaactcctgtcagcagggaaaaagcgagccgacctcatacgtcggtgagttgattgtacctgcagaggaagccccggc

SEQ ID NO: 4223 - DNA, 490 bp, Unknown
  Ascusbbf_790677, encodes 16S rRNA
agagtttgatcctggctcagaatcaacgctggcggcgtgcctcagacatgcaagtcgaacgattaaagctctcttcggagagtgtataaagtggcgcatgggtgagtaacacgtaagtaatctaccttcgagtggggaataacgttcggaaacgaacgctaataccgcataatgcagcggcacctaatggtgacagttgttaaaggagcaatccgcttgaagaggagcctgcggcagattaggtagttggtaaggtaatggcttaccaagcctgcgatctgtaaccggtcttagaggacggtcggtcacactgacactgaataacgggtcagactcctacgggaggcagcagtcgggaattttgggcaatgggcgaaagcctgacccagcaacgccgcgtgaaggatgaagtatttcggtatgtaaacttcgaaagaatgggaagaatcaatgacggtaccatttataaggtccggctaactacgtgcca

SEQ ID NO: 4224 - DNA, 485 bp, Unknown
  Ascusbbf_1260296, encodes 16S rRNA
agagtttgatcctggctcaggacgaacgctggcggcgtgcttaacacatgcaagtcaaggggtagcaataccactggcgcacgggtgagtaacgcgtagataatctgcccctatctccggaataacatcaagaaattggtgctaaaaacggatgaggcacaatgtgtcaaaggtaacggatagggatgagtctgcgtctgattagctagttggtaaggtaatggcttaccaaggcgacgatcagtagctggtctgagaggacgatcagccacactggaactgagacacggtccagactcctacgggaggcagcagtgaggaattttgcacaatgggggaaaccctgatgcagcgacgccgcgtgcgggatgaaggggcttcgccctgtaaaccgctgtcggatgggaaaaaaagtctcctcgggagactgggattgtaccatcaaaggaaggaccggctaactacgtgccagcagccgcggtaat

SEQ ID NO: 4225 - DNA, 490 bp, Unknown
  Ascusbbf_1560168, encodes 16S rRNA
agagtttgatcctggctcagagtgaacgctggcggcaggcctaacacatgcaagtcgagcggcagcgcgggggcaaccctggcggcgagcggcggacgggtgaggaatgcatcggaatctacctcgttgtgggggataacctcgggaaaccgggactaataccgcatacgacctacgggtgaaagtgggggaccgcaaggcctcacgcgatgagatgagccgatgccggattagctagttgggggggtaaaggcccaccaaggcgacgatccgtagctggtctgagaggatgatcagccacactggaactgagacacggtccagactcctacgggaggcagcagtggggaatgttggacaatgggcgcaagcctgatccagccatgccgcgtgtgtgaaggaggccttcgggctgtaaagcacttttgttggggaagaaaccggccggattaatacttcggctgaatgacggtacccaaagaataagcac

SEQ ID NO: 4226 - DNA, 490 bp, Unknown
  Ascusbbf_480930, encodes 16S rRNA
agagtttgatcctggctcaggatgaacgctagctacaggcttaacacatgcaagtcgcggggcagcgcggccatagcttgctatggctggcggcgaccggcgcacgggtgagtaacgcgtatccaacctgccccccagtagggaacagcccggcgaaagtcggattaatgccctatgcacttgacggcgggcatctaatgtcaagtaaaggcgttttgtcgctgggggatggggatgcgtaggattaggcaggcggcggggcgacggcccaccgcgccgacgatccttaggggttctgagaggaaggtcccccacactggtactgagacacggaccagactcctacgggaggcagcagtgaggaatattggtcaatgggcgagagcctgaaccagccaagtagcgtgcaggacgacggccctacgggttgtaaactgcttttatgcggggataaagtgcgccacgtgtggcgctttgcaggtaccgcatg

SEQ ID NO: 4227 - DNA, 490 bp, Unknown
  Ascusbbf_372501, encodes 16S rRNA
agagtttgatcatggctcaggataaacgctggcggcgtgcataacacattcaagtcgaacggaactgtacggattaatccttcgggaagcgtttgtacagtttagtggcggacgggtgagtaacgcgtgagcaacctgcctacgagaggggaataacgtctggaaacggacgctaataccgcataaaccgcggggttcgcatggaccccggggcaaagatttatcgctcgtagatgggctcgcgtccgattaggtagttggtggggcaacggctcaccaagccgacgatcggtagccggactgagaggttgaacggccacattggaactgagaaacggtccagactcctacgggaggcagcagtggggaatattgggcaatgggcgcaagcctgacccagcgacgccgcgtgagggaagaaggtcttcggattgtaaacctctttcggcagggaagacaaaaggacggtacctgcagaagaagccacggc

SEQ ID NO: 4228 - DNA, 490 bp, Unknown
  Ascusbbf_299634, encodes 16S rRNA
agagtttgatcatggctcagattgaacgctggcggcaggcctaacacatgcaagtcgagcggaaacgatggaagcttgcttccaggcgtcgagcggcggacgggtgagtaatgcatgggaatctgcccgatagtgggggataacctggggaaacccaggctaataccgcatacgtcctacgggagaaagcaggggatcttcggaccttgcgctatcggatgagcccatgtcggattagcttgttggtggggtaatggcctaccaaggcgacgatccgtagctggtctgagaggatgatcagccacatcgggactgagacacggcccgaactcctacgggaggcagcagtggggaatattggacaatgggcgaaagcctgatccagccatgccgcgtgtgtgaagaaggccttcgggttgtaaagcactttcagtgaggaagaacgcctctggcttaatacgtcagagggaagacatcactcacagaagaa

SEQ ID NO: 4229 - DNA, 490 bp, Unknown
  Ascusbbf_1147335, encodes 16S rRNA
agagtttgatcctggctcaggataaacgctggcggcgtgcctaatgcatgcaagtcgaacgggaaccacttcggtggtcgaccgtggcggacgggtgaggagcacgtggctaacctgcccgaatcttcgggataaccaccggaaacggtggctaataccggatgtgttggttggaggggactctggctaacaaagcgctctggtagcggattcggagggggctgcgtccgattagctagttggtgaggtaagagctcaccaaggcaacgatcggtagctggtctgagaggatgatcagccacacggggactgagacacggccccgactcctacgggaggcagcagcaaggaattttccacaatgggcgccagcctgatggagcaacgccgcgtgggggatgacgcgtttcggcgtgtaaaccccttttccgagggacgaaaatcatgacggtacctcgggaataaggtccggctaactacgtgccagcag

SEQ ID NO: 4230 - DNA, 399 bp, Unknown
  Ascusbbf_394653, encodes 16S rRNA
agagtttgatcatggctcagttggaaacgactgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaacttcgtgccagcagccgcggtaat

SEQ ID NO: 4231 - DNA, 490 bp, Unknown
  Ascusbbf_1563649, encodes 16S rRNA
agagtttgatcatggctcaggatgaacgctagcggcgggcttaatacatgcaagtcgaggggcagcacgggtagcaatacttggtggcgaccggcggacgggtgcgtaacacgtatgcaacttgccctatactgggaaatagcccgaagaaattcggattaatgtcccataacaacgagataggcatctattttgtttgaaagttccgacggtataggatgggcatgcgcaagattagctagttggtgaggtaacggctcaccaaggcgacgatctttagggggcctgagagggtgatcccccacactggtactgagacacggaccagactcctacgggaggcagcagtaaggaatattggtcaatggaggcaactctgaaccagccacgccgcgtgaaggatgacggccctatgggttgtaaacttcttttgtatggggataaacctttctacgtgtaggaagctgaaggtaccatacgaataagcatc

SEQ ID NO: 4232 - DNA, 490 bp, Unknown
  Ascusbbf_638806, encodes 16S rRNA
agagtttgatcctggctcaggatgaacgctggcggcgtgcttaacacatgcaagtcgaacgaagaggtgctgagggataggcttcggtcttgaacacggtacatatcttagtggcggacgggtgagtaacgcgtgggcaacctgccctttacaggggaataatcattggaaacgatgactaataccgcatgtccccgagataaggcatcttatttcggaaaaaggagcaatccggtaaaggatgggcccgcgtctgattagcttgttggtggggtaacggcctaccaaggcgacgatcagtagccgacctgagagggtgatcggccacattgggactgagacacggcccaaactcctacgggaggcagcagtggggaatattgcacaatggggggaaccctgatgcagcaacgccgcgtgaaggaagaaggttttcggatcgtaaacttctatcaacagggacgaaggaagtgacggtacctgaataaga

SEQ ID NO: 4233 - DNA, 490 bp, Unknown
  Ascusbbf_952454, encodes 16S rRNA
agagtttgatcatggctcaggatcaacgctggcggcgtgcctaatgcatgcaagtcgaacggggatgccttcgggtatctcacgtggcggacgggtgaggaacacgtgggcaatctgcccactggtggggggtagccatcggaaacggtgggtaattccgcatgagctggtttgccgagtggggtgaatcaggaaagcctttgggcgccagtggaggagcctgcgaccgattagctagttggggtggtaacggcatcccaaggcgatgatcggtagctggtctgagaggatggccagccacacggggactgagacacggccccgactcctacgggaggcagcagcaaggaattttccgcaatgggcgaaagcctgacggagcaacgccgcgtgcgggatgacgcatttcggtgtgtaaaccgctgttcgtggggacgaagcactgacggtacccacggaggaaggcccggctaactacgtgccagcagcc

SEQ ID NO: 4234 - DNA, 490 bp, Unknown
  Ascusbbf_1371838, encodes 16S rRNA
agagtttgatcatggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttattctttcgcatgttaggataacgaaagcttcggtggttacggatgggcatgcgtgacattagctagttggtaaggtaacggcttaccaaggcgacgatgtctaggggagctgagaggcttatccacagaacgggaacgaggccacggaccagattcctacgggaggcagaagtgaggaatattggtcaatggacggaagtctgaaccagccatgccgcgtggaggaagaaggtcctatgggttgtaaactccttttgttcgagagtaataagggctttgcgaagcccgatgagagtatcggacgaataagc

SEQ ID NO: 4235 - DNA, 490 bp, Unknown
  Ascusbbf_245434, encodes 16S rRNA
agagtttgatcctggctcaggatgaacgctagcgacaggcctaacacatgcaagtcgaggggcatcgggtggttagcttgctaaccatgccggcgaccggcgcacgggtgagtaacgcgtgtgcaacctttccgtgtccccgggacagtcggccgaaaggccgcgtaaccccgggcgttccggtcgtcgggcatccgtcggccggtatacgagagggacacgggtgggcacgcgtccgattagccagccggcggggtaacggcccaccggggcgacgatcggtaggggttctgagaggaaggtcccccacattggaactgagacacggtccaaactcctacgggaggcagcagtgaggaatattggtcaatgggcgcgagcctgaaccagccaagtcgcgtgagggaggaaggccctacgggtcgtaaacctcttttgtcggggaacaacggcggggtcgtgaccccgcgtgagcgtacccgtcgaataa

SEQ ID NO: 4236 - DNA, 490 bp, Unknown
  Ascusbbf_107277, encodes 16S rRNA
agagtttgatcatggctcagattgaacgctggcggcaggcctaacacatgcaagtcgagcggtagaaagtagcttgctacttttgagagcggcggacgggtgagtaacgcgtgggaatctaccgagtagtgggggacaacagccggaaacggctgctaataccgcatacgccctacgggggaaagggggggatcttcggacctctcgctatttgatgagcccgcgtcggattagctagtaggtgaggtaatggctcacctaggcgacgatccgtagctggtctgagaggatgatcagccacactggaactgagacacggtccagactcctacgggaggcagcagtggggaatattgcacaatgggcgaaagcctgatgcagccatgccgcgtgtgtgaagaaggctttcgggttgtaaagcactttcagcgaggaggaaggcctgtcggttaatatccgacaggattgacgttactcgcagaagaagcac

SEQ ID NO: 4237 - DNA, 490 bp, Unknown
  Ascusbbf_413088, encodes 16S rRNA
agagtttgatcatggctcagaatgaacgttggcggcatggattaggcatgcaagtcgcacgagaagtggagtagcttgctacgaaacggacagtggcgaaagggagagtaacgcgtggttacatgcctccaggaccaggatagcgttgggaaactagcggtaatactggatgatatctacggatcaaatggtgtgattccgcctggagattggactgcgtactattagcttgttggtggggtaaaggcctaccaaggctgcgatggttaccgggtgtgagagcatggcccggctcactgggactgagacactgcccagacatctacggatggctgcagtcgagaatcttcggcaatggacgaaagtctgaccgagcgatgccgcgtgcgggatgaaggccctcgggttgtaaaccgctgtcagttgggaggaaatgccatggggctatccccatggcttgactaatcttcagaggaaggacgggctaagt

SEQ ID NO: 4238 - DNA, 490 bp, Unknown
  Ascusbbf_160329, encodes 16S rRNA
agagtttgatcatggctcaggatgaacgctggcggcgtgcttaacacatgcaagtcgaacggtgaagcagagcttgctctgtggatcagtggcgaacgggtgagtaacacgtgagcaatctgcccctgactctgggataacagttggaaacagctgctaataccggatacgagctgcgaccgcatggtcggcagttggaaagaacttcggtcagggatgagctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccag

SEQ ID NO: 4239 - DNA, 490 bp, Unknown
  Ascusbbf_1483300, encodes 16S rRNA
agagtttgatcatggttcaggatgaacgctagctacaggcttaacacatgcaagtcgaggggcagcagggggtggcaacatcccgctggcgaccggcgcacgggtgcgtaacgcgtgttcaacctgcctcatacccgggaacagcccatcgaaagatggattaatgcccgatgttgtccctgcgccccctggcgctcggaccaaagattcatcggtatgggatgggaacgcgtccgattagctagacggcggggtaacggcccaccgtggcgacgatcggtaggggttctgagaggaaggtcccccacactggaactgagacacggtccagactcctatgggaggcagcagtaaggaatattggtcaatggtcgcaagactgaaccagccaagtagcgtgaaggatgactgccctatgggttgtaaacttcttttgcaggggaataaccggcgccacgggtggcgtcctgcatgtaccctgcgaataagc

SEQ ID NO: 4240 - DNA, 470 bp, Unknown
  Ascusbbf_598606, encodes 16S rRNA
agagtttgatcatggctcagagtgaacgctggcggcatgcttaacacatgcaagtcgcacgggcagcaatgtcagtggcggacgggtgagtaacgcgtagggaagtgtccagaggtgggggacaaccccgggaaactggggctaataccgcatatgtcctgagggacaaagcagtgatgcgcctttggagttacctgcgtccgattagctagttggtggggtaaaggcctaccaaggcgacgatcggtagctggtctgagaggatgaccagccacactgggactgagacacagcccagactcctacgggaggcagcagtggggaatattggacaatgggcgcaagcctgatccagcaatgccgcgtgggtgaagaaggtcttcggatcgtaaagccctttcggcggggacgatgatgacggtacccgcagaagaagccccggctaacttcgtgccagcagccgcggtaat

SEQ ID NO: 4241 - DNA, 490 bp, Unknown
  Ascusbbf_539566, encodes 16S rRNA
agagtttgatcatggctcaggataaacgctggcggcatgcctaatacatgcaagtcgaacggagttaccttcgggtaacttagtggcgaacgggtgagtaacacgtaggtaatccatcccaaggacgaggatagcttctggaaacggaaggtaaaactggatagttaattagagggcatcctctaattattaaaagagcaatctaccctgggaagagcctgcggcgcattagctagttggtgaggtaatggcccaccaaggcgatgatgcgtagccggactgagaggtcgaccggccacattgggactgagacacggcccagactcctacgggaggcagcagtagggaattttcggcaatgggcggaagcctgaccgagcaatgccgcgtgaatgatgaagtatttcggtatgtaaagttcttttaacagggacgaaaaaacaaattgacggtacctgttgaataagctccggctaactacgtgccagca

SEQ ID NO: 4242 - DNA, 490 bp, Unknown
  Ascusbbf_1509651, encodes 16S rRNA
agagtttgatcatggctcagattgaacgctggcggcatgcctaacacatgcaagtcgaacggtaacgcggagagcttgctctctggcgacgagtggcggacgggtgagtaatacttaggaatctgcccattagtgggggacaactcggggaaactcgagctaataccgcatacgccctacgggggaaagcggaggactcttcggagcttcgcgctaatggatgagcctaagtcggattagcttgttggtggggtaaaggcctaccaaggcgacgatccgtagctggtctgagaggacgatcagccacactgggactgagacacggcccagacacctacgggaggcagcagtggggaatattggacaatgggggcaaccctgatccagcaatgccgcgtgtgtgaagaaggcctgcgggttgtaaagcactttcagtagagaagaaaagcctggcgttaataccgccgggtcttgacgtaacctacagaag

SEQ ID NO: 4243 - DNA, 490 bp, Unknown
  Ascusbbf_457699, encodes 16S rRNA
agagtttgatcatggctcagaatgaacgctggcggcatggattaggcatgcaagtcgaacgccccggcttcggccggggagtggcgaaagggtgcgcaacgcgtggggaacccgcccccgggcccgggacaagcgctggaaacggcgtctgatacgggatgcggacccgcctggcatcgggcggcgtccaaagattcatcgcccggggagggccccgcgtcccattagctggatggcggggtgacggcccaccatggctacgacgggtaggtggtctgagaggatggtcacccacactgggactgagacactgcccagactcctgcgggaggctgcagtcgagaatcttccgcaatgggcgaaagcctgacggagcgatgccgcgtgagggacggaggccttcgggtcgtgaacctctgtcacccgggacgaatcaatgacggtaccgggagaggaagccacggctaactacgtgccagcagccgcggta

SEQ ID NO: 4244 - DNA, 490 bp, Unknown
  Ascusbbf_1680001, encodes 16S rRNA
agagtttgatcatggctcaggatgaacgctagctacaggcttaacacatgcaagtcgaggggcagcatacttatagcaatataagtgatggcgaccggcgcacgggtgagtaacacgtatccaaccttccctttactcggggatagcctttcgaaagaaagattaatacccgatggcatatgacgatcacatgattgtcctattaaagaatttcggtaaaggatggggatgcgttccataggcagttggcggggtaacggcccaccaaacctacgatggataggggttctgagaggaaggtcccccacattggaactgagacacggtccaaactcctacgggaggcagcagtgaggaatattggtcaatgggcgcaggcctgaaccagccaagtagcgtgaaggatgactgccctatgggttgtaaacttcttttagaagggaataaagtggagtatgtatactcctttgtatgtaccttctgaataagg

SEQ ID NO: 4245 - DNA, 470 bp, Unknown
  Ascusbbf_1546993, encodes 16S rRNA
agagtttgatcctggctcagaacgaacgctggcggcaggcttaacacatgcaagtcgagcgcactcttcggagtgagcggcagacgggtgagtaacgcatgggaatctacccatctctacggaataactcggggaaacccgtgctaataccgtatacgcccttcgggggaaagatttatcggagatggatgagcccgcgttggattagctagttggtggggtaaaggcctaccaaggcgacgatccatagctggtctgagaggatgatcagccacattgggactgagacacggcccaaactcctacaggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaat

SEQ ID NO: 4246 - DNA, 490 bp, Unknown
  Ascusbbf_884839, encodes 16S rRNA
agagtttgatcctggctcaggatcaacgctggcggcgtgcctaatgcatgcaagtcgagcggggtgatcttcggatcacttacgcggcggacgggtgcggaacacgtgggcaacctgccccgaggtgggggatagccggtggaaacaccgggtaattccgcatacggtcactggctgaagggtcagtgaggaaaggctcgtaagagtcgccttgggaggggcctgcggccgattagctagacggtggggtaacggcctaccgtggcgatgatcggtagctggtctgagaggacggccagccacacggggactgagacacggccccgactcctacgggaggcagcagcaaggaatcttccgcaatgggcgaaagcctgacggagcaacgccgcgtgtgggatgacgcctttcggggtgtaaaccacttttctcagggaagaagcactgacggtacctgaggaagaaggaccggctaactacgtgccagcag

SEQ ID NO: 4247 - DNA, 490 bp, Unknown
  Ascusbbf_142751, encodes 16S rRNA
agagtttgatcatggctcaggacaaacgctggcggcgtgcctcatacatgcaagtcgaacgagaaactctagcttgctagagtggaaagtggcggacgggtgagtaatgtgtaggaaatctgccctagagtgggggacaacagagggaaacttctgctaataccccatatgagcttggttggaataccaatcttgaaaactccggtgctctaggatgagcctgcatctgattagcttgttggcggtgtaattgaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgtacgttaaacccctcggggcgtaaagtactgtcagtggggacgaattttgacggtacccacagaggaagcaccggctaactccgtgccagcagccgc

SEQ ID NO: 4248 - DNA, 490 bp, Unknown
  Ascusbbf_602276, encodes 16S rRNA
agagtttgatcctggctcagattgaacgctggcggcaggcctaacacatgcaagtcgagcggtaacagaagaaagcttgctttcttgctgacgagcggcggacgggtgagtaatgtatggggatctgcccgatagagggggataactactggaaacggtggctaataccgcataatgtctacggaccaaagcaggggctcttcggaccttgcactatcggatgaacccatatgggattagctagtaggtggggtaaaggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaggttaatacccttatcaattgacgttacccgcagaag

SEQ ID NO: 4249 - DNA, 490 bp, Unknown
  Ascusbbf_131960, encodes 16S rRNA
agagtttgatcctggctcaggatgaacgctagctacaggcttaacacatgcaagtcgcggggcatcatgacgatagcttgctattgttgatggcgaccggcgcacgggtgagtaacgcgtatccaacctgcccccaagtagggcacagcccggcgaaagtcggattaattccctatgtggtcatgttatggcatcagtatatgactaaaggctttggttgcttggggttggggatgcgtaggattagctagacggcgggttgacagcccaccgtggcgacgatccttaggggttctgagaggaaggtcccccacactggtactgagacacggaccagactcctacgggaggcagcagtgaggaatattggtcaatgggcggaagcctgaaccagccaagtagcgtgcaggatgacggccctatgggttgtaaactgcttttatgcggggataaagtgtgccacgtgtggcatattgcaggtaccgcatga

SEQ ID NO: 4250 - DNA, 490 bp, Unknown
  Ascusbbf_651116, encodes 16S rRNA
agagtttgatcatggctcaggacgaacgctggcggcgtgcttcaaacatgcaagtcgaacgagatatgagggagcttgctcccaagtatctagtggcggacgggtgagtaacgcgtgaacaatctggcttacacagggggataacacttggaaacgagtgctaataccgcatatgaccacagcctggcatcaggtaggggtgaaaggagaaatccggtgaaagatgagtttgcgtttcattagctagttggtgaaggtaacggcccaccaaggcgacgatgaatagccgatctgagaggatgaacggccacactggaattgagagacggtccagactcctacgggaggcagcagttaggaatattgggcaatggaggaaactctgacccagcaacgccgcgtgaaggaagaaggttttcggattgtaaacttctgatctgtgggaagaaggaaatgacggtaccacaggagaaagccacggctaactacg

SEQ ID NO: 4251 - DNA, 490 bp, Unknown
  Ascusbbf_139820, encodes 16S rRNA
agagtttgatcctggctcaggacgaacgctggcggcgtgcttaacacatgcaagtcgagcggtaaggccctttcgggggtacacgagcggcgaacgggtgagtaacacgtgggtgacctgccctcagctctgggataagcccgggaaactgggtctaataccggataggacacatcggcgcatgttggtgtgtggaaagattcggttcggctggggatgggcccgcggcctatcagcttgttggtggggtgatggcctaccaaggcggtgacgggtagccggcctgagagggcgaccggccacactgggactgagacacggcccagactcctacgggaggcagcagtggggaatattgcgcaatgggcggaagcctgacgcagcgacgccgcgtgggggatgacggccttcgggttgtaaacctctttcgccagggacgaagcttttgtgacggtacctggataagaagcaccggccaactacgtgccag

SEQ ID NO: 4252 - DNA, 490 bp, Unknown
  Ascusbbf_1606156, encodes 16S rRNA
agagtttgatcatggctcagattgaacgctggcggcaggcctaacacatgcaagtcgaacgggaactctgagatgagacttcggtggattttcagaaattctagtggcggacgggtgagtaacgcgtgggtaacctgcccttaagaggcggataacattgagaaatcagtgctaatacgccatatgcttacgaagtcgcatgactttgtgaggaaatgagattcgcttaaggatggacccgcgtttgattagccagttggcagggtaacggcctaccaaagcaacgatcaatagccggcctgagagggtgaacggccacattggaactgagacacggtccaaactcctacgcgaggcagcagtggggagtattgcacaatgggcgaaagcctgatgcagcaacgccgcgtgagtgaagaagtatttcggtatgtaaagctctatcgatggggaataagatgaaggtacccaagtaagaagccccggctaa

SEQ ID NO: 4253 - DNA, 482 bp, Unknown
  Ascusbbf_1605979, encodes 16S rRNA
agagtttgatcatggctcagaacgaacgctggcggcacgcctaacacatgcaagtcggacggtatggatagcttgctattcatatagtggcggactggtgagtaatatgtaggaatctgcccataggttagggatagcaccgggaaactggtggtaatacctgatgatctggagacaggaaaggaggaattcgccgatggaggagcctatatctgattagatagttggaggtgtaagagaccaccaagtcgatgatcggtagctgttctgagaggaagatcagccacattgggactgagatacggcccaaactcctacgggaggcagcagtggggaatattggacaatggaggaaactctgatccagcgatgccgcgtgagtgaagaaggccctagggttgtaaagctcttttgtcagggacgatgatgacggtaccttgtgagaaagccacggctaactacgtgccagcagccgcggtaat

SEQ ID NO: 4254 - DNA, 490 bp, Unknown
  Ascusbbf_1490591, encodes 16S rRNA
agagtttgatcctggctcaggatgaacgctggcggcgtgcttaacacatgcaagtcgaacgaagcacttcataaagcttgctttaagaagtgacttagtggcggacgggtgagtaacgcgtgggtaacctgccttacacagggggataacagttagaaatgactgctaataccgcataaaacagcagagtcgcatgacacaactgtcaaagatttatcggtgtaagatggacccgcgtctgattagctagttggtggggtaacggcctaccaaggcgacgatcagtagccggcctgagagggtgaacggccacattgggactgagacacggcccaaactcctacgggaggcagcagtggggaatattggacaatgggcgaaagcctgatccagcgacgccgcgtgagcgaagaagtatttcggtatgtaaagctctatcagcagggaagaaaacgacggtacctgactaagaagccccggctaactacgt

SEQ ID NO: 4255 - DNA, 490 bp, Unknown
  Ascusbbf_541219, encodes 16S rRNA
agagtttgatcatggctcaggatgaacgctagctacaggcttaacacatgcaagtcgtggggcagcatgaacttagcttgctaagtttgatggcgaccggcgcacgggtgagtaacgcgtatccaaccttccccctggtagggcatagcccggcgaaagtcggattaataccctatgttttcccttgacggcatccgacggggaacaaagatttatcgccatgggatggggatgcgtccgattaggtagacggcggggtgacggcccaccgtgccttcgatcggtaggggttctgagaggaaggtcccccacactggaactgagacacggtccagactcctacgggaggcagcagtgaggaatattggtcaatgggcggaagcctgaaccagccaagtagcgtgcaggatgacggccctacgggttgtaaactgcttttggaggggaataaagtgcgggacgagtcctgctttgcatgtaccctcagaat

SEQ ID NO: 4256 - DNA, 490 bp, Unknown
  Ascusbbf_629658, encodes 16S rRNA
agagtttgatcctggctcaggatgaacgctggcggcgtgcctaacacatgcaagtcgaacggaaaggattcttcggaattctttcagtggcggacgggtgagtaacgcgtgggtaacctgccccatacaggggaacaacagctggaaacggctgctaataccgcataagcgcacagtgctgcatggtacagtgtgaaaagattttatcggtatgggatggacccgcgtctgattagctagttggaggggtaacggcccaccaaggcgacgatcagtagccgacctgagagggtgaccggccacattggaactgagacacggtccaaactcctacgggaggcagcagtgaggaatattggtcaatgggcggaagcctgaaccagccaagtagcgtgcaggaagacggccctatgggttgtaaactgcttttgtacaggaataaagtgacccacgtgtgggtttttgcatgtaccgtaagaataaggaccgg

SEQ ID NO: 4257 - DNA, 488 bp, Unknown
  Ascusbbf_522234, encodes 16S rRNA
agagtttgatcctggctcagaacgaacgctggcggcaggtttaaaacatgcaagtcgaacggtaacattaaggagcttgcttcttagatgacgagtggcgcacgggtgagtaaagtataggaacctatcttagagtcggggataacgccgggaaactggtgctaataccggatgatgccttagggttaaagatttatcgcttttagaggggcctatatctgattaggtagttggtgtggtaaaggcataccaagccgatgatcggtagctggtctgagaggatgatcagccacattgggactgagacacggcccaaactcctacgggaggcagcagttgggaatattggacaatgggggcaaccctgatccagccatgccgcgtgagtgaagaaggccttcgggttgtaaaactcttttatagggggcgatgatgacggtaccctatgaataagcaccggctaacttcgtgccagcagccgcggtaat

SEQ ID NO: 4258 - DNA, 490 bp, Unknown
  Ascusbbf_326167, encodes 16S rRNA
agagtttgatcatggctcaggacgaacgctggcggcgtgcttcatacatgcaagtcgaacgagaattggtagcttgctaccaaggaaagtggcggacgggtgagtaaaatgtagagaatctgccctagagtgagggatagcagttggaaacgactattaatacctcatatgagattatttgcgatagtaatcttgaaaactccggtgctctgggatgagtctgcatctgattagctagttggtggtgtaatggacccccaaggcgacgatcagtagctggtttgagaggatgatcagccacaatgggactgagacacggcccatactcctacgggaggcagcagtagggaattttgcgcaatgggcgaaagcctgacgcagcaacgccgcgtgaacgaagaaggtcttcggattgtaaagttctgtcagcagggacgaaagatgactgtacctgcagaggaagcaccggctaactccgtgccagcagccg

SEQ ID NO: 4259 - DNA, 490 bp, Unknown
  Ascusbbf_407179, encodes 16S rRNA
agagtttgatcctggctcagaacgaacgctggcggcaggcttaacacatgcaagtcgagcgccccgcaaggggagcggcagacgggtgagtaacgcgtgggattctacccatctctacggaataactcagggaaacttgtgctaataccgtatacgcccttcgggggaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatcttccgcaatgggcgaaagcctgacggagcaacgccgcgtgagtgaagaaggccttcgggtcgtaaagctctgttgtcggggacgaatgtagcgcttatcaacaacgagtgctaatgacggtacctgacgaggaagccacggctaactacgtgccagcagccgcgg

SEQ ID NO: 4260 - DNA, 490 bp, Unknown
  Ascusbbf_660844, encodes 16S rRNA
agagtttgatcatggctcaggacgaacgctggcggcgtgcttaacacatgcaagtcgagcggtaaggcccttcggggtacacgagcggcgaacgggtgagtaacacgtgagtaatctgcccttcacttcgggataaccaccggaaacggtggctaataccggatatgaaactcttgcgcatgcttgggtttggaaagttccggcggtggaggatgtgctcgcggcctatcagcttgttggtgaggtaacggctcaccaaggcttcgacgggtagccggcctgagagggtgaccggccacactgggactgagacacggcccagactcctacgggaggcagcagtggggaatattggacaatgggcgaaagcctgatccagcaacgccgcgtgagggatgactgccttcgggttgtaaacctctttcagtaccgacgaagcgaaagtaacggtaggtacagaagaagcaccggccaactacgtgccagcagc

SEQ ID NO: 4261 - DNA, 490 bp, Unknown
  Ascusbbf_1097882, encodes 16S rRNA
agagtttgatcctggctcaggatgaacgctggcggcgtgcctaacacatgcaagtcgaacggttaagccggcttcggccgggtataaagtggcgaacgggtgagtaacacgtgaccaacctgccccgcgcaccgggacagcctcgtgaaaacgggattgataccggatactccgggaggggggcatcccccccccgggaaagctccggcggcgcgggatggggtcgcggcccatcaggtagtgggcggggtagcggcccgcccagccgacgacgggtagccgggttgagagaccgaccggccacattgggactgagatacggcccagactcctacgggaggcagcagtggggaatattgcgcaatgggcgaaagcctgacgcagcaacgccgcgtgcgggacgaaggccctcgggttgtaaaccgctttcagcagggaagaccacgacggtacctgcagaagaagccccggctaactacgtgccagcagc

SEQ ID NO: 4262 - DNA, 490 bp, Unknown
  Ascusbbf_600214, encodes 16S rRNA
agagtttgatcctggctcaggacgaacgctggcggcgtgcttcatacatgcaagtcgaacgagaagttaccttcgggtaatggacagtggcggacgggtgagtaaaatgtagagaatctgcccttgagatggggacaacagttggaaacgactgctaatacccaatatgcgcgtagttgagatactattcgtgaaaactccggtgctcagggatgagtctgcatctgattagcttgctggcggggtaacggcccaccagggcgacgatcagtaggggttctgagaggaaggtcccccacattggaactgagacacggtccaaactcctacgggaggcagcagtgaggaatattggtcaatggacgagagtctgaaccagccaagtagcgtgcaggatgacggccctatgggttgtaaactgcttttatacggggataaagtgcgccacgcgtggtgtattgcaggtaccgcaagaataaggaccggctaa

SEQ ID NO: 4263 - DNA, 488 bp, Unknown
  Ascusbbf_1697671, encodes 16S rRNA
agagtttgatcatggctcagaacgaacgctggcggcaggcttaacacatgcaagtcgagcgccccgcaaggggagcggcagacgggtgagtaacgcgtgggaatctacccatctctacggaataactcagggaaacttgtgctaataccgtatacgcccttcgggggaaagatttatcggagatggatgagcccgcgttggattagctagttggtgaggtaaaggctcaccaaggcgacgatccatagctggtctgagaggatgatcagccacactgggactgagacacggcccagactcctacgggaggcagcagtggggaatattggtcaatgggcgggagcctgaaccagccaagtcgcgtgagggaggaaggtcctacggattgtaaacctctttagccggggagcaacgtgcgccacgcgtggcgcagtgagagtacccggagaataagcatcggctaactccgtgccagcagccgcggtaat

SEQ ID NO: 4264 - DNA, 490 bp, Unknown
  Ascusbbf_777820, encodes 16S rRNA
agagtttgatcatggctcaggatgaacgctggcggcgtgcctaacacatgcaagtcggacgaagcgcccggagcggacatttcggtggaagggaagggacgactgagtggcggacgggtgagtaacgcgtggacgacctggcccatacagggggatagcagctggaaacggctggtaataccgcatgagcgcacgggcatgcatgtgcctgtgtgaaaagatttatcggtatgggatgggtccgcgtccgattagccagttggcggggtaacggcccaccaaagcgacgatcggtagccggcctgagagggcggacggccacattgggactgagacacggccctgactcctacgggaggcagcagtgggggatattgcacaatggggggaaccctgatgcagcgacgccgcgtgggtgaaggagcacctcggtgcgtaaagccctatcggcagggaagagagaggacggtacctgcagaagaagccccgg

SEQ ID NO: 4265 - DNA, 490 bp, Unknown
  Ascusbbf_534553, encodes 16S rRNA
agagtttgatcatggctcaggacgaacgctggcggcgtgcttaagacatgcaagtcgagcggagagatgttgaaagcttgcttttgacggatcttagcggcggacgggtgagtaacgcgtgagcaacctgccttatacatcgggataacacttagaaataggtgctaataccggatatgaccacaaccgggcatccggaaggggtgaaagggtttactggtataagaggggctcgcgtctgattagctagttggtgaggtaacggcccaccaaggcaacgatcagtagccgacctgagagggtgatcggccacaatggaactgagatacggtccatactcctacgggaggcagcagtcgggaatattgggcaatggaggaaactctgacccagcaacgccgcgtggaggatgaaggtcttcggattgtaaacttctgttcttggggaagaaacaaatgactgtacccaaggagcaagccccggctaacta

SEQ ID NO: 4266 - DNA, 490 bp, Unknown
  Ascusbbf_715305, encodes 16S rRNA
agagtttgatcctggctcaggatgaacgctagcggcaggcctaatacatgcaagtcgaacgggattgtccagcttgctgggcatgagagtggcgaatgggtgcgtaacgcgtgagcaacctacccttgtctgggggatagcccggagaaatccggattaataccgcataacgtcgatgagcggcattgcttatcgaccaaacatttatgggacatggatgggctcgcgtgacattagttagttggtagggtaacggcctaccaagaccgcgatgtctaggggatctgagaggatgaccccccacactggtactgagacacggaccagactcctacgggaggcagcagtaaggaatattggtcaatggagggaactctgaaccagccatgccgcgtgcaggacgactgccctacgggttgtaaactgcttttatacgggaataaaccccgctacgtgtagcgggctgaatgtactgtaagaataaggatcg

SEQ ID NO: 4267 - DNA, 490 bp, Unknown
  Ascusbbf_549358, encodes 16S rRNA
agagtttgatcctggctcagaataaacgctggcggcgtgcttaacacatgcaagtcgagcgagaaaggtcttcggactgagtaaagcggcaaacgggtgagtaatgcgtgagaatctgccttttagtggagaatacctttaagaaattgaagttaatactgcataagccctacgggggaaagatggcctctttgctgtcgctaaaagatgagcttgcgtgccattagctagttggtagggtaaaggcctaccaaggcgatgatggctagccggcctgagagggtgtacggccacactggaactgagatacggtccagactcctacgggaggcagcagtgaggaatcttgcgcaatgggcgaaagcctgacgcagcgacgccgcgtggaggatgaaggccctagggtcgtaaacttctgttaaatggaaagaaatgtcctactctaatacagtgggaagatgacggtaccattagagaaagcaccggctaa

SEQ ID NO: 4268 - DNA, 490 bp, Unknown
  Ascusbbf_672929, encodes 16S rRNA
agagtttgatcatggctcagaacgaacgctggcggcaggcttaacacatgcaagtcgagcgatcccttcggggatagcggcggacgggtgagtaacgcgtgggaacgtgcccttttcttcggaatagcccagggaaacttggattaataccggatacgcccttcgggggaaagatttatcggaaaaggatcggcccgcgttggattaggtagttggtggggtaacggcctaccaagccgacgatccatagctggtttgagaggatgatcagccacactgggactgagacacggcccagactcctacgggaggcagcagtgaggaatattggtcaatggacgagagtctgaaccagccaagtagcgtgcaggatgacggccctatgggttgtaaactgcttttatatagggataaagtgatctacatgtagatttttgtaggtactatatgaataaggaccggctaattccgtgccagcagccgcggtaat

SEQ ID NO: 4269 - DNA, 490 bp, Unknown
  Ascusbbf_5191, encodes 16S rRNA
agagtttgatcatggctcaggatgaacgctggcggcgtgcctaacacatgcaagttgaacgaagcaatcaagacagaatccttcgggaggaagatttgattgactgagtggcggacgggtgagtaacgcgtgggtaacctgccttgtacagggggataacagttagaaatgactgctaataccgcataagcgcacagtactgcatggtacagtgtgaaaaactccggtggtacaagatggacccgcgtctgattagccagttggcagggtaacggcctaccaaagcaacgatcagtagccgacttgagagagtgatcggccacattgggactgagacacggcccagactcctacgggaggcagcagtgggggatattgcacaatggaggaaactctgatgcagcaacgccgcgtgagtgatgaagtagttcgctacgtaaagctctatcagtagggaagataatgacggtacctacacaagaagctccgg

SEQ ID NO: 4270 - DNA, 490 bp, Unknown
  Ascusbbf_1373197, encodes 16S rRNA
ctcgtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttattctttcgcatgttaggataacgaaagcttcggtggttacggatgggcatgcgtgtcattagctagttggtaaggtaacggcttaccaaggcgacgatgtctaggggagctgggaggcttatccccaaagcgggtactgagacacggaccagactcctacggggggcagcagtgaggaatattggtcaatggacggaagactgaaccagccatgccgcgtggaggaagaaggtcctatgggttgtaaactccttttgttcgagagtaataagggctttgcgaagcccgatgagagtatcggacgaataagc

SEQ ID NO: 4271 - DNA, 490 bp, Unknown
  Ascusbbf_102213, encodes 16S rRNA
agagtttgatcctggctcaggatgaacgctggcggcgtgcctaatacatgcaagtcgaacgcgagcagcaatgctcgagtggcgaacgggtgagtaatacataagtaacctgccctagacagggggataactgctggaaacggcagctaagaccgcataggtatggacactgcatggtgaccatattaaaagtgccaaggcactggtagaggatggacttatggcgcattagctggttggtgaggtaacggctcaccaaggcgacgatgcgtagccgacctgagagggtgaccggccacactgggactgagacacggcccagactcctacgggaggcagcagtagggaattttcggcaatggggggaaccctgaccgagcaacgccgcgtgaaggaagaaggaattcgttctgtaaacttctgttataaaggaagaacggcggatatagggaatgatatccgagtgacggtactttatgagaaagccacg

SEQ ID NO: 4272 - DNA, 490 bp, Unknown
  Ascusbbf_93841, encodes 16S rRNA
agagtttgatcatggctcagattgaacgctggcggcaggcttaacacatgcaagtcggacggggtgaatggtgcttgcaccatttacttagtggcgaacgggtgagtaatgcttaggaatctggctattaatgggggacaacaattcgaaaggattgctaataccgcatacgccctacgggggaaagcaggggatcttcggaccttgcgttaatagatgagcctaagttggattagctagttggtggggtaaaggcctaccaaggcgacgatccatagcgggtctgagaggatgatccgccacactgggactgagacacggcccagactcctacgggaggcagcagtggggaatattggacaatgggcgcaagcctgatccagccatgccgcgtgtgtgaagaaggtcgtaagattgtaaagcactttaagcggggaggagagtactgatgttaataccatcaagtattggacgctacccgcagaataag

SEQ ID NO: 4273 - DNA, 490 bp, Unknown
  Ascusbbf_287126, encodes 16S rRNA
agagtttgatcctggctcaggatgaacgctggcggcgtgcttaacacatgcaagtcgaacggagatgcgtgaaagaagttttcggacggaaattgcacatcttagtggcggacgggtgagtaacacgtaaacaatctgccttcaagagcgggacaacagatagaaatatttgctaataccgcataagaccacaatgtcgcatgacataggggtaaaagggagcaattcgcttgaagatgagtttgcggactattagctagttggtgaggtaacggctcaccaaggcaaagatggttagccgacctgagagggtgatcggccacactggaactgagatacggtccagactcctacgggaggcagcagtgaggaatattgggcaatggaggcaactctgacccagcaacgccgcgtgaaggaagaaggttttaggattgtaaacttctgttataggggaaaaagaaagtgatggtaccctatgagcaagcta

SEQ ID NO: 4274 - DNA, 490 bp, Unknown
  Ascusbbf_259052, encodes 16S rRNA
agagtttgatcctggctcaggacgaacgctggcggcgcgcctaacacatgcaagtcgaacggagctattttgatcgaacccttcggggtgacattggcttagcttagtggcgaacgggtgagtaacacgtgaggaacctgcccttcagagggggacaacagttggaaacgactgctaataccgcataagaccacagagccgcatggctcaggggtcaaaggagaaatccgctgaaggatggcctcgcgtccgattaggtagttggcggggtaacggcccaccaagccgacgatcggtagccggactgagaggttgaacggccacattgggactgagacacggcccagactcctacgggaggcagcagtggggaatattgcacaatgggggaaaccctgatgcagcgacgccgcgtgagggaagaagattttcggattgtaaacctctgtcttcggggacgataatgacggtacccgaggaggaagccacg

SEQ ID NO: 4275 - DNA, 490 bp, Unknown
  Ascusbbf_214068, encodes 16S rRNA
agagtttgatcatggctcaggatgaacgctggcggcgtgcctaatacatgcaagtcgaacgaacttcttcggaagttagtggcgaacgggtgagtaacacgtaggtaatctaccctagagacggggataacgattggaaacgatcgctaataccggatagtatataagatcgcatggttttatatttaaagttgggatacaacactgtaggatgagcctgcggcgcattagttagttggcgggataaaagcccaccaagacgatgatgcgtagccggactgagaggttgaacggccacattgggactgagacacggcccagactcctacgggaggcagcagtagggaattttcggcaatgggggaaaccctgaccgagcaacgccgcgtgaatgcagaagtatttcggtatgtaaaattcttttttagaggaagaacgatactagtagggaatgactagtaagtgacggtactttaagaataagccccgg

SEQ ID NO: 4276 - DNA, 490 bp, Unknown
  Ascusbbf_91415, encodes 16S rRNA
agagtttgatcatggctcaggataaacgctggcggcgcgcataacacatgcaagtcggacgaaagatttggtttcggtcaaagctttagtggcggacgggtgagtaacacgtagataacttgtctcatagagggggatagccggaagaagttccgattaataccgcataatacatctctatcgcatgatggagatggtaaacgaattaaatcgctatgagagaggtctgcggctgattagctagttggagtggtaacggcacaccaaggcgacgatcagtagccggtttgagagaatgtacggccacattgggactgagatacggcccagactcctacgggaggcagcagtggggaatattgcgcaatgggggaaaccctgacgcagcgacgccgtgtaagggatgaaggtcttcggatcgtaaacctatatcgactgtgaaaagcaaggatggtagcagagtaagaagccccggctaactacgtgccag

SEQ ID NO: 4277 - DNA, 490 bp, Unknown
  Ascusbbf_202925, encodes 16S rRNA
agagtttgatcatggctcaggatgaacgctggcggcgtgcttaacacatgcaagtcgagcgaaggacaaagagcttgctctttgttacttagcggcggacgggtgagtaacgtgtgggcaatctgccctatgcagaggaataacatagagaaatttatgctaatgcctcataaactcttagtactgcatggtacatagagaaaagatttatcggcataggaggagcccgcatctgattagatagttggtggggtaacggcctaccaagtcaacgatcagtagccgacctgagagggtgatcggccacattggaactgagacacggtccaaactcctacgggaggcagcagtggggaatattgcacaatgggggaaaccctgatgcagcaacgccgcgtgaaggaagaagtatttcggtatgtaaacttctatcgacagggaagaaagaaatgacggtacctgaataagaagccccggctaaatacgtgcc

SEQ ID NO: 4278 - DNA, 490 bp, Unknown
  Ascusbbf_1269609, encodes 16S rRNA
agagtttgatcctggctcaggatgaacgctagcgacaggcttaacacatgcaagtcgaggggcagcgcggaggtggcgacacttttggcggcgaccggcggactggtgagtaacacgtatgcgacctgccccccaccggggaatagaccagggaaacttggcgtaatgccccatgagccgcgctcctgcatgggggagcggtgaaagtttcattgcggtgagggatgggcatgcggcgcattagctagttggcggggtaacggcccaccaaggccacgatgcgtaggggttctgagaggaaggtcccccacactggtactgagacacggaccagactcctacgggaggcagcagtgaggaatattggtcaatgggcggaagcctgaaccagccaagtcgcgtgggggatgaaggccctagttggttgtaaacccctttaggcggggagtaacccggcggacgcgtccgccgttgagagtacccgcagaat

SEQ ID NO: 4279 - DNA, 490 bp, Unknown
  Ascusbbf_909268, encodes 16S rRNA
agagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagttggtgagataacagcccaccaaggcgacgatcagtagccgacctgagagggtgatcggccacattgggactgagacacggcccaaactcctacgggaggcagcagtggggaatattgcacaatgggcgaaagcctgatgcagcaacgccgcgtgaaggatgaagggtttcggctcgtaaacttctatcaatagggaagaaagaaatgacggtacctaaataagaagccccggctaactacgtgcc

SEQ ID NO: 4280 - DNA, 490 bp, Unknown
  Ascusbbf_1438867, encodes 16S rRNA
agagtttgatccctggctcaggatgaacgctagcggcaggcttaacacatgcaagtcgaggggtaacagggagtagcaatactctgctgacgaccggcgcacgggtgcgtaacgcgtatgcaacctacctgtaacaggggaataacggagagaaatttccactaatgccccatatggttaaagattcgcatgtttctttaacgaaagctttttgtggttacggatgggcatgcgtgacattaggtagttggtggggcaacggcccaccaagccgacgatgtctaggggagctgagaggctagacccccacactggtactgagacacggaccagactcctacgggaggcagcagtgaggaatattggtcaatgggcggaagcctgaaccagccatgccgcgtgcgggaggaaggccctatgggttgtaaaccgcttttgctccggagtaataagtcccatgcgtggggcgatgagagtacggggcgaataa

SEQ ID NO: 4281 - DNA, 490 bp, Unknown
  Ascusbbf_1011548, encodes 16S rRNA
agagtttgatcatggctcaggacgaacgctggcggcgtgcttaacacatgcaagtcgaacgggactgcccgaatgaagttttcggatggatttttggtatgtttagtggcgaacgggtgagtaacgcgtgagtaacctgccttggagagggggacaacagccggaaacggctgctaataccgcatgacgtcacgggagggcatccttctgtgaccaaagatttatcgctctgagatggactcgcgtccgattagatagttggtgaggtaacggctcaccaagtcgacgatcggtagccggactgagaggttgaacggccacattgggactgagatacggcccagactcctacgggaggcagcagtgaggaatattgggcaatgggcgcaagcctgacccagcaacgccgcgtgaaggaagaaggttttcggattgtaaacttcttttcttcgggacgaaaaatgacggtaccgaaggaataagccacggc

SEQ ID NO: 4282 - DNA, 490 bp, Unknown
  Ascusbbf_703530, encodes 16S rRNA
agagtttgatcctggctcaggatgaacgctggcggcgtgcctaatacatgcaagtcgaacggagcacttcggtgcttagtggcgaacgggtgagtaacacgtaggtaacatatctatacgacgaggataacggctggaaacggctgctaagactggataggaatataaggggcatccctaatattttaaaagactttggtatgcgtataggatggcctgcggcgcattagctagttggtggggtaatagcctaccaaggcaatgatgcgtagccggactgagaggttgaccggccacattgggactgagacacggcccagactcctacgggaggcagcagtagggaattttcggcaatggggggaaccctgaccgagcaacgccgcgtgaatgaagaagtacttaggtatgtaaagttcttttattggggaagaaaggctagagcaatctagattgacggtacccattgaataagccccggctaactatg

SEQ ID NO: 4283 - DNA, 490 bp, Unknown
  Ascusbbf_381721, encodes 16S rRNA
agagtttgatcctggctcaggatgaacgctggcggcgtgcttaacacatgcaggtcgaacgaagctccaatctcctattcttcggaagaaagagagaggaagacttagtggcggacgggtgagtaacgcgtggggaacctgcccgaaagagggggacaacagttggaaacgactgctaataccgcataagccggcgggaccgcatggtccagccggaaaaggagcaatccgctttcggatggccccgcgtctgattagccggttggcggggtaacggcccaccaaagcgatgatcagtagccggactgagaggttgaacggccacattgggactgagacacggcccaaactcctacgggaggcagcagtggggaatattgcacaatggaggaaactctgatgcagcgacgccgcgtgagtgaagaagtgtttcggcatgtaaagctctatcagcagggaagaaaatgacggtacctgcacaagaagcccc

SEQ ID NO: 4284 - DNA, 490 bp, Unknown
  Ascusbbf_347590, encodes 16S rRNA
agagtttgatcctggctcaggatgaacgctggcggcgtgcctaatacatgcaagtcgaacgaagcatcttcggatgcttagtggcgaacgggtgagtaacacgtagataacctacctttaactcgaggataactccgggaaactggagctaatactggataggatgtgtgcatgaaaaaaacacatttaaagatttatcggtttaagaggggtctgcggcgcattagttagttggtggggtaagagcctaccaagacgatgatgcgtagccggactgagaggtctaccggccacattgggactgagaacggcccaaactcctacgggaggcagcagtagggaattttcggcaatgggggaaaccctgaccgagcaacgccgcgtgaacgacgaagtacttcggtatgtaaagttcttttatatgggaagaaaaattaaaaattgacggtaccatatgaataagccccggctaactatgtgccagcagccg

SEQ ID NO: 4285 - DNA, 490 bp, Unknown
  Ascusbbf_1679221, encodes 16S rRNA
agagtttgatcatggctcaggacgaacgctggcggcgtgcctaatacatgcaagtcgagcggacgaattttcggtgcttgcaccgaattttcgttagcggcggacgggtgagtaacacgtgggtaacctaccttatagattgggataactccgggaaaccggggctaataccgaataatactttttaacacatgtttgaaagttgaaagacggttttgctgtcactataagatggacccgcggcgcattagctagttggtgaggtaacggctcaccaaggcaacgatgcgtagccgacctgagagggtgatcggccacactgggactgagacacggcccagactcctacgggaggcagcagtagggaatcttccacaatggacgaaagtctgatggagcaacgccgcgtgagtgaagaaggatttcggttcgtaaaactctgttgcaagggaagaacaagtagcgtagtaactggcgctaccttgacggt

SEQ ID NO: 4286 - DNA, 490 bp, Unknown
  Ascusbbf_423602, encodes 16S rRNA
agagtttgatcctggctcagaacgaacgctggcggcgcgcctaacacatgcaagtcgagcgattaagacccttcggggtgaataaagcggcggacgggtgagtaaggcatagataacctgcctcgaagagggggatagcctggggaaacttgggttaataccgcgtaagctggatgagtgaatgtcattcagtaaaggcttcggccgctttgagatgggtctatgtatgattagctagttggagtggtaatggcaccccaaggcaacgatcattaactggtctgagaggatgatcagtcacactggaactgagacacggtccagactcctacgggaggcagcagtgaggaattttgcgcaatgggcgaaagcctgacgcagcgacgccgcgtggaggatgaagtctttcgagatgtaaacttctgtcagtagggatgataatgacagtacctacagaggaagcaccggctaactccgtgccagcagccgc

SEQ ID NO: 4287 - DNA, 490 bp, Unknown
  Ascusbbf_496514, encodes 16S rRNA
agagtttgatcatggctcagaatgaacgctggcggcgtggttaagacatgcaagtcggacggtgtttagggtgtagcaatacacgttaaacgcagtggcgaacgggtgcgtaacacgtgaacaatctacctccgagtggggaatagctcgccgaaaggcgaattaataccgcatacgatggttgctctcctgagtaatcaatcaaagccggggacctgcaagggcctggcgctgggagaggagttcgcggcctatcagctagttggcgaggtaacggctcaccaaggcaaagacgggtagctggtctgagaggatgatcagccacactggaactgagacacggtccagacacctacgggtggcagcagtttcgaatcattcacaatgggcgcaagcctgatggtgcgacgccgcgtgggggatgaaggtcttcggattgtaaacccctgtcactagggaagaaacgctatggattaacagtctgtagcct

SEQ ID NO: 4288 - DNA, 490 bp, Unknown
  Ascusbbf_674384, encodes 16S rRNA
agagtttgatcatggctcaggacgaacgctggcggcgtgcctaacacatgcaagtcgaacgaggtccaaccagtggcaacactggggaagacctagtggcgaacgggtgagtaacacgtgaggaacttgccccgaagaccgggataaccacccgaaagggtggctaataccggatatcctcatcgagccgcatggcttggtgaagaaatggattccgcttcgggagagcctcgcggcctatcagctagttggtggggtaacggcctaccaaggcatcgacgggtagctggtctgagaggacgatcagccacactgggactgagacacggcccagactcctacgggaggcagcagtggggaatcttgcgcaatgggcgaaagcctgacgcagcaacgccgcgtgcgggatgaaggccttcgggttgtaaaccgctttcagtggggacgaaccaagacggtacccacagaagaagccccggccaactacgtg

SEQ ID NO: 4289 - DNA, 490 bp, Unknown
  Ascusbbf_1653029, encodes 16S rRNA
agagtttgaccatggctcaggacgaacgctggcggcgtgcctaacacatgcaagtcgagcgaagtgatttcgaatgaaattttcggatggattttggaattatcttagcggcggacgggtgagtaacgcgtgagaaacctgcctttcacaaagggatagcctcgggaaactgggattaataccttatgacactttaacctcgcatggggaataagttaaagcgtagagcggtgaaagatggtctcgcgtcctattagctagttggtgaggtaacggctcaccaaggcgacgataggtagccggcctgagagggtgaacggccacactggaactgagacacggtccagactcctacgggaggcagcagtggggaatattgcacaatggaggaaactctgatgcagcgacgccgcgtgaatgatgaaggccttcgggtcgtaaaattctgtccttggggaagataatgacggtacccaaggaggaagccccg

SEQ ID NO: 4290 - DNA, 490 bp, Unknown
  Ascusbbf_1592137, encodes 16S rRNA
agagtttgatcatggctcaggatgaacgctagctacaggcctaacacatgcaagtcgaggggcagcgggggcagagcttgctttacctgccggcgaccggcgcacgggtgcgtaacgcgtatcgaacctcccccatactcgggaatagccttgcgaaagtaagattaatgcccgatggtctcagaatatgacatcatgctttgagtaaagattcatcggtatgggatggcgatgcgtctgattagatagttggcggggtaacggcccaccaagtcgtcgatcagtaggggttctgagaggaaggtcccccacattggaactgagacacggtccaaactcctacgggaggcagcagtgaggaatattggtcaatggtcggaagactgaaccagccaagtagcgtgaaggatgactgccctacgggttgtaaacttcttttgccgggggataaggacgcccacgtgtgggtgtttgaaggtacccggagaat

SEQ ID NO: 4291 - DNA, 490 bp, Unknown
  Ascusbbf_1293488, encodes 16S rRNA
agagtttgatcctggctcaggacgaacgctggcggcgtgcttaagacatgcaagtcgagcggggaacaattgaaagcttgcttttgagagttcctagcggcggacgggtgagtaacgcgtgagcaacctgccttatacactgggataacagttggaaacagctgctaataccggatatgaccacaactgggcatccagaaggggtgaaagggtttactggtataagatgggctcgcgtctgattagctagttggtgaggtaacggcccaccaaggcgacgatcagtagccgacctgagagggtgatcggccacattggaactgagatacggtccaaactcctacgggaggcagcagtcgggaatattgggcaatggaggaaactctgacccagcaacgccgcgtggaggatgaaggtcttcggattgtaaacttctgttctaggggaagaaacaaatgacggtaccctaggagcaagccccggctaacta

SEQ ID NO: 4292 - DNA, 470 bp, Unknown
  Ascusbbf_378633, encodes 16S rRNA
agagtttgatcatggctcagaacgaacgctggcggcaggcctaacacatgcaagtcgagcgctgtagcaatacggagcggcagacgggtgagtaacacgtggaaatctacctatcggtggggaataacttcgggaaactggagctaataccgcatacgccctgagggggaaagatttatcgccgatagatgagtccgcgtctgattagctagttggtggggtaaaggcctaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggtgaagataatgacggtaaccggagaagaagccccggctaacttcgtgccagcagccgcggtaat

SEQ ID NO: 4293 - DNA, 480 bp, Unknown
  Ascusbbf_1504509, encodes 16S rRNA
agagtttgatcctggctcagaacgaacgctggcggcaggcctaacacatgcaagtcgaacgagaagccaccttcgggtggtggacagtggcagacgggtgagtaacgcgtgggaacgtgcctttcggttcgggataacccagggaaacttgggctaataccggatacgcccttcgggggaaagattcattgccgaaagatcggcccgcgtcggattagctagttggtggggtaatggcctaccaaggcgacgatccgtagctggtctgagaggatgaccagccacactgggactgagacacggcccagactcctacgggaggcagcagtggggaatattggacaatgggcgaaagcctgatccagccatgccgcgtgggtgaagaaggccttagggttgtaaacccctttcagcggggaagataatgacggtacccgcagaagaagtcccggctaactccgtgccagcagccgcggtaat

SEQ ID NO: 4294 - DNA, 361 bp, Unknown
  Ascusbbf_1764561, encodes 16S rRNA
agagtttgatcctggctcagaacgaacgctggcggcgcgtcttaagcatgcaagtcgagcgggatccgggggcttgctcccggtgagagcggcggactggcgaggaacgcgtgggcgacgcgccctccggagggggacagcccgtggaaacacggggtaataccccatggcatggttggcttggaggccagccatcaaaggagcttcggctccgccgggggagcggcccgcgacccatcagctagttggcggggcaagggcccaccaaggctacgacgggtatccggcctgagagggcgaacggacgcattgggactgagatacggcccagactcctacgggagccagcagccgcggtaat

SEQ ID NO: 4295 - DNA, 490 bp, Unknown
  Ascusbbf_1817064, encodes 16S rRNA
agagtttgatcctggctcaggatgaacgctggcggcgtgcataacacattcaagtcgaacggagtaaagagcttcggttttttacttagtggcggacgggtgagtaacgcgtgagcaacctgcccctgtgtgcgggataacgttcggaaacggacgctaataccgcataaaccaaagagaccgcatggtcacggtggcaaagatttattgcacagggatgggctcgcgtccgattagatagttggcggtgcaacggaccaccaagtcgacgatcggtagccggactgagaggttgaacggccacattggaactgagagacggtccagactcctacgggaggcagcagtggggaatattgggcaatgggcgaaagcctgacccagcgacgccgcgtgaaggaagacggtcttcggattgtaaacttcttttatgtaggacgaaggcagtgacggtactacatgaataagccacggctaactacgtgccagc

SEQ ID NO: 4296 - DNA, 490 bp, Unknown
  Ascusbbf_640073, encodes 16S rRNA
agagtttgatcatggctcaggacgaacgctggcggcgtgcttaacacatgcaagtcgaacgatgaaccaggagcttgctcctggggattagtggcgaacgggtgagtaacacgtgggtaacctgccccagacactgggataacttcgggaaaccgaagctaataccggatatgaccactttggacatccaacggtggtggaaagatttatcggtctgggatggacccgcggcctatcagctagttggaggggtaacggcccaccaaggcgacgacgggtagccggcctgagagggtgaccggccacactggaactgagacacggtccagactcctacgggaggcagcagtggggaatattgcacaatgggcgcaagcctgatgcagcgacgccgcgtgagggacgacggccttcgggttgtaaacctctttcagcagggacgaagcgaaagtgactgtacctgcagaagaagcaccggctaactacgtgc

SEQ ID NO: 4297 - DNA, 488 bp, Unknown
  Ascusbbf_1847561, encodes 16S rRNA
agagtttgatcatggctcaggattaacgctggcggcgtgcctaacacatgcaagtcgaacgaaatacttttgtatttagtggcgaacgggtgagtaatgtacaggtaatgtacctccgtactgcgaataacaagctgaaaagtttgctaatatggaatagtttcctcagagggcatccttagaggaataaagatttatcgtgcggagatcagcctgtatcctattagttagttggtggggtaatggcctaccaagacgacgatgggtaactggtctgagaggatgagcagtcacattggaactgagaaacggtccaaactcctacgggaggcagcagtgaggaattttgcgcaatgggggaaaccctgacgcagcaacgccgcgtgagtgacgacggccttcgggttgtaaagctctgtcgtgtgtgacgagtagggatggtaacacacaaggaagcctcggctaactacgtgccacagcgcggtaat

SEQ ID NO: 4298 - DNA, 490 bp, Unknown
  Ascusbbf_1219050, encodes 16S rRNA
agagtttgaccatggctcaggatgaacgctagctataggcttaacacatgcaagtcggggggcagcacgggaagcagcaatgcttttgagaggcgaccggcgaatgggtgagtaacgagtatccaacctgccccgcgctccgggacagccccgcgaaagcgggattaataccggatgcggcatggttcccgcatgggttccatgtcaaagattcatcggcgcgggatggggatgcgtccgattagcttgttggcggggcaacggcccaccaaggcgatgatcggtaggggttctgagaggaaggtcccccacattggaactgagacacggtccaaactcctacgggaggcagcagtgaggaatattggtcaatggccgtaaggctgaaccagccaagtagcgtgagggatgaccgccctatgggttgtaaacctcttttgcgcgggaataatccgcactacgcgtagtgcgttgcatgtaccgtgcgaat

SEQ ID NO: 4299 - DNA, 490 bp, Unknown
  Ascusbbf_1633685, encodes 16S rRNA
agagtttgatcctggctcagaacgaacgctggcggcgtgcttaatacatgcaagtcgaacgtgaaacgagtagcaatacttgtggaaagtggcgaacgggtgagtaatacgtaagcaatctacctttaagattgggataaccttgccaacgcggggctaataccggatgtggtcattttaacgcatgttagaatgattaaaggagtgatccgcttaaggatgagcttgcggcccattagttagttggcggggtaacggcccaccaagaccgcgatgggtagccggcctgagagggtggacggccacattgggactgagatacggcccagactcctacgggaggcagcagtagggaattttgcgcaatggacgaaagtctgacgcagcaacgccgcgtgagggatgacggccttcgggttgtaaacctctgttggatgggaaaaaaagtagcaatatttgatggtaccattcgagtaagcaccggctaact

SEQ ID NO: 4300 - DNA, 470 bp, Unknown
  Ascusbbf_1255352, encodes 16S rRNA
agagtttgatcatggctcaggatgaacgctggcggcgtgcctaacctatgcaagtcgaacgaggctttgagccgagtggcagacgagtgagtaacacgtacctaatctgcccgtaagtggggaataattcgtcgaaagacggactaataccgcatgtgctccacggagtaaagcttttgcgcttacggatgagggtgcggcctatcagctagttggtaaggtaatggcttaccaaggctatgacgggtagctggtctgagaggatgatcagccacgctgggactgagatacggcccagactcctacgggaggcagcaagtgggaatattgcacaatggacgcaagtctgatgcagcgacgccgcgtgggggatgaaggttttcggatcgtaaaccccttttatcgattaggaagatatgaccagtcgatgaataagcacctgctaactacgtgccagcagccgcggtaat

SEQ ID NO: 4301 - DNA, 490 bp, Unknown
  Ascusbbf_506309, encodes 16S rRNA
agagtttgatcctggctcagaacgaacgctggcggcaggcctaacacatgcaagtcgagcgtgaaaggggcttcggccctgagtaaagcggcgcacgggtgagtaacacgtgaataatctgccctcatgaccgggataacagatcgaaagaactgctaataccggataagcctccacaccaaccgggtgagtggggaaaagaacgggactttcgggccgttcgcgtgaggatgagttcgcgttccattagatagttggtgaggtaatggctcaccaagtcgacgatggatagctggtctaagaggatgatcagccacactggaactgagacacggtccagactcctacgggaggcagcagtggggaatcttgcgcaatggaggaaactctgacgcagccatgccgcgtgagtgatgaaggccctcgggttgtaaagctctgtctaaggggacgaatggcgttatgtacaagacgcatgacgattgacggt

SEQ ID NO: 4302 - DNA, 490 bp, Unknown
  Ascusbbf_165925, encodes 16S rRNA
agagtttgatcatggctcagattgaacgctggcggcaggcttaatacatgcaagtcgaacggtaacacgcaggaagcaattcctgtggtgacgagtggcggacgggtgagtaaagtttgggaatctgtccttcagagggggatagcagctggaaacggctgataaaaccgcatacgctctgaggaggaaagtgacgggaccggcgacggccgtcagctgaagggtgagcccaaatgggattagctagtaggggaggtaaaggctcacctaggcgacgatctctagctggttttagcggatgaccagccacattggaactgagacacggtccaaactcctacgggaggcagcagtagggaatattgcacaatggagggaactctgatgcagccatgccgcgtgtgtgaagaaggccttcgggttgtaaagcacttttactgcggagaagggttgatgcaataataaggcattaaccggatgttacgcaggg

SEQ ID NO: 4303 - DNA, 490 bp, Unknown
  Ascusbbf_170318, encodes 16S rRNA
agagtttgatcctggctcaggacgaacgctggcggcgcgcctaacacatgcaagtcgaacgaagctatgttgaaagcttgctggatatatagcttagtggcggacgggtgagtaacacgtgagtaacctgcctctcagagtggaataacgtttggaaacggacgctaataccgcataacgtgagaagagggcatcctctttttaccaaagatttatcgctgagagatgggctcgcggccgattaggtagttggtgagataacagcccaccaagccgacgatcggtagccggactgagaggttgatcggccacattgggactgagacacggcccagactcctacgggaggcagcagtgggggatattgcacaatgggggaaaccctgatgcagcgacgccgcgtgagggaagacggttttcggattgtaaacctctgtctttagggacgaataaatgacggtacctaaggaggaagccacggctaactacg

SEQ ID NO: 4304 - DNA, 490 bp, Unknown
  Ascusbbf_493414, encodes 16S rRNA
agagtttgatcctggctcaggacgaacgctggcggcgtgcctaacacatgcaagtcgaacggagtttaagaagcttgctttttaaacttagtggcggacgggtgagtaacgcgtgagcaacctgcctctcagtggggaataatgtactgaaaaggacactaataccgcatgacgtattttagccgcatgactgagataccaaagatttatcgctgagagatgggctcgcgtccgattagctggttggtgaggtaacggctcaccaaggcgacgatcggtagccggactgagaggttgaacggccacattgggactgagacacggcccagactcctacgggaggcagcagtgggggatattgcgcaatgggggaaaccctgacgcagcaatgccgcgtggaggattgaaggtcttcggattgtaaactccttttgtcagggaagataatgacggtacctgacgaataagctccggctaactacgtgccagc

SEQ ID NO: 4305 - DNA, 490 bp, Unknown
  Ascusbbf_1683793, encodes 16S rRNA
agagtttgatcctggctcaggacgaacgctggcggcgtgcttaacacatgcaagtcgaacgggactttgctttgtagcaatacagagtaaagtttagtggcagacgggtgagtaatgtataaggaacctaccttcgagtggggaataacagtccgaaaggattgctaataccccataacataacttagtggcatcaccgagttatcaaagatttatcgcttggagatggtcttatattctatcagcttgttggcagtgtaacggactaccaaggcgacgacggatagccggcctgaaagggcgaccggccacaagggcactgagacacgggccctactcctacgggaggcagcagtggggaattttggacaatgggcgcaagcctgatccagcaacgatgcgtggaggacgaaggttttcggattgtaaactccttttgtgagggaagaaacaaatgacggtacctcacgaataagccacggctaactac

SEQ ID NO: 4306 - DNA, 472 bp, Unknown
  Ascusbbf_122063, encodes 16S rRNA
agagtttgatcatggctcagaacgaacgctggcggcaggcctaaaacatgcaagttgaacggttgtagcaatacagcagtagcggacgggtgaggaacatatgggaacgtaccctttggtgtgggataacatctggaaacgggtgataataccgcataagccacaagtgggaaagatttattgccgaaggagcggcccatattggattagctagttggttaggtaaaggctgaccaaggcgacgatccatagccggtttgagaggatgatcggccacactgggactgagacacggcccagactcctacgggaggcagcagttaggaatattggacaatgggggaaaccctgatccagccatgccgcgtgagtgaagaaggccttcgggttgtaaagctcttttgtatgggaaaatgatgatggtaccataagaataagcaccggcaaacttcgtgccagcagccgcggtaat

SEQ ID NO: 4307 - DNA, 490 bp, Unknown
  Ascusbbf_1788085, encodes 16S rRNA
agagtttgatcctggctcagaacgaacgctggcggcatggattaggcatgcaagtcgagcgggatttatcatcatgagtcttcggatgaatgaggatgatgagagcggcaaacgggtgcgtaacacgtaaacaacttgccctttagttcgggatagctcaccgaaaggtggattaataccggatgtggttttcttttgcatggaagagatactaaagcttgtaacggcgctaaaggagaggtttgcgtcctatcagcttgttggtgaggtaaaggcttaccaaggcaaagacgggtagctggtctgagaggatgatcagccacagtggaactgagacacggtccacacacctacgggtggcagcagtttcgaatcattcacaatgggcgaaagcctgatggtgcaacgccgcgtgggggatgaaggttctcgaatcgtaaacctctgtcgccgaggaacaaaatccgggttcatagcccggcttgagtta

SEQ ID NO: 4308 - DNA, 468 bp, Unknown
  Ascusbbf_162215, encodes 16S rRNA
agagtttgatcatggctcagaacgaacgctggcggcaggcttaacacatgcaagtcgagcgccccgcaaggggagcggcagacgggtgagtaacgcgtgggaaactaccctttggtacggaataacacagagaaatttgtgctaataccgtatgtgcccttcgggggaaagatttatcgccataggatgtgcccgcgtaggattagctagttggtgtggtaatggcgcaccaaggcgacgatccttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcacccacgacgataatgacggtagtgggagaagaagccccggctaacttcgtgccagcagccgcggtaat

SEQ ID NO: 4309 - DNA, 490 bp, Unknown
  Ascusbbf_1195056, encodes 16S rRNA
agagtttgatcatgctcaggacaaacgctggcggcgtgcctaacacatgcaagtcgaacgaagcagcggggaaagagacttcggtcaatggaaccgttgacttagtggcggacgggtgagtaatgcatgagcaacctgccctggagagggggacaacagctggaaacggctgctaataccgcatgaagttattgggaggcatctcccggtaaccaaagatttatcgctctgggatgggctcatgtctgattagatagttggcggggcaacggcccaccaagtctacgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttatcagggacgaagtagtgacggtacctgatgaataagccacggc

SEQ ID NO: 4310 - DNA, 490 bp, Unknown
  Ascusbbf_438598, encodes 16S rRNA
agagtttgatcctggctcagagttaacgctggcggcgtgcctaacacgtgcaagtcgggcgggggatggcagagtatcgcgtccctagcggcagacgggtgagtaacgcgtaggcaacctgcccctgtcagggagacaaccctctgaaaggagggctgatatcccgtagtcccggagggaggcatcttcctctggggaaagcggcgacgcggacagggaggggcctgcggcctatcagctagttggcggggcaacggcccaccaaggcaaagacgggtagccgatctaaaaggatgaccggccacaaggggactgagacacggcccctactcctacgggaggcagcagtggggaattttggacaatgggggaaaccctgatccagcgacgccgcgtggaggacggaggctttcgggttgtaaactccttttgtccggggcgaaagtgcgcgagcatctggcggtaccggacgaataagccacagctaact

SEQ ID NO: 4311 - DNA, 490 bp, Unknown
  Ascusbbf_1708215, encodes 16S rRNA
agagtttgatcctggctcagaatgaacgttggcggcgtggattaggcatgcaagtcgcgcgagaaatctccttcgggagatggacagcggcggaagggagaggaacaagtagaaatctgccctcgggacggggatagcggcgggaaactgccggtaatacccgataacatctttggatcaaatggtgtgattccgcctgaggatgagtctacttcctattagctagttggcggggtaatggcccaccaaggcaacgatgggtagcgggtgtgagagcacgatccgcctcactgggactgagacactgcccagacacctacgggtggctgcagtcgagaatcttcggcaatgggggaaaccctgaccgagcgacgccgcgtgcgggatgaaggccctcgggttgtaaaccgctgtcgtaagggaacaaatttacgggggtactcccctgtaattgagtgatcttaggaggaaggacgggctaagttcgtgc

SEQ ID NO: 4312 - DNA, 490 bp, Unknown
  Ascusbbf_660394, encodes 16S rRNA
agagtttgatcatggctcagattgaacgctagcgggatgctttacacatgcaagtcgaacggcagcgcggacttcggtctggcggcgagtggcggacgggtgagtaatgtatcggaacgtgcccagtagcgggggataactacgcgaaagcgtggctaataccgcatacgccctacgggggaaagggggggatcttaggacctctcactattggagcggccgatatcggattagctagttggtggggtaaaggcctaccaaggcgacgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttgtcagggaagaaacaggcgcggctaatatccgcgctgaatgacggtacctgaagaataagcac

SEQ ID NO: 4313 - DNA, 490 bp, Unknown
  Ascusbbf_1354459, encodes 16S rRNA
agagtttgatcctggctcagattgaacgctggcggcatgcctaacacatgcaagtcgaacgatgattactagcttgctagtatgattagtggcggacgggtgagtaatgtatagggatctgcctgttagtgggggacaacagccggaaacggctgctaataccgcatacgctctacggaggaaagtgggggaccttcgggcctcacgctaacagatgaacctatatcagattagctagttggtggggtaagggcctaccaaggcgacgatctgtagctggtttgagagaatgatcagccacactgggactgagacacggcccagactcctacgggaggcagcagtggggaatattggacaatggggggaaccctgatccagcaatgccgcgtgtgtgaagaaggccttcgggttgtaaagcactttaagttgggaggaaagcctgagagttaatagcttttaggggtgacgttaccaacagaataagcac

SEQ ID NO: 4314 - DNA, 490 bp, Unknown
  Ascusbbf_617508, encodes 16S rRNA
agagtttgatcatggctcaggatgaacgctggcggcgtgcttaacacatgcaagtcgaacggaactgcatataaagaatctcttcggagaggattttttgtagtttagtggcggacgggtgagtaacgcgtgagtaacctgcccttgagagggggataacgttctgaaaaggacgctaataccgcataatactattgaatcgcatggtttaatagtcaaaactgaggtgctcagggatggactcgcgtccgattagatagttggtgaggtaacggctcaccaagtcgacgatcggtagccggactgagaggttgaacggccacattgggactgagacacggcccagactcctacgggaggcagcagtgggggatattgcgcaatgggggaaaccctgacgcagcaacgccgcgtggatgaagacggttttcggattgtaaagtccttttcttagggacgaattctgacggtacctaaggaataagctccg

SEQ ID NO: 4315 - DNA, 490 bp, Unknown
  Ascusbbf_696140, encodes 16S rRNA
agagtttgatcatggctcaggacgaacgctggcggcgtgcttaacacatgcaagtcgaacgggatccatgtagtcgcaagactacggaagatctagcggcgaacgggtgcgtaacacgtgaggaacctaccccggactctggaataacagatggaaacatctgctaataccggatgccgtctcatcacctcctggtggagagacgaaagatttatcggtccgggagggcctcgcggcctatcagcttgttggtgaggtaaaggctcaccaaggcatcgacgggtagctggtctgagaggatgatcagccacactgggactgagacacggcccagactcctacgggaggcagcagtggggaatcttgcacaatgggcgcaagcctgatgcagcaacgccgcgtgcgggaagaaggccttagggttgtaaaccgctttcagtagggaagaaaatgacggtacctatagaagaaggtgcggccaactacgtgc

SEQ ID NO: 4316 - DNA, 490 bp, Unknown
  Ascusbbf_323461, encodes 16S rRNA
agagtttgatcctggctcaggatgaacgctagcggcaggcctaacacatgcaagtcgaggggtagggggtgcttgcacccttgagaccggcgcacgggtgagtaacgcgtatggaatctgccctctacaggggaatagcccagggaaacttggattaatgccccatggtattattggactgcatggtcctttaattaaagatttatcggtaggggatgatcatgcgtaccattagctggttggtgtggtaacggcacaccaaggctacgatggttaggggccctgagagggggatcccccacactggtactgagacacggaccagactcctacgggaggcagcagtgaggaatattggacaatgggcgggagcctgatccagccatgccgcgtgcaggaagacagccctatgggtcgtaaactgcttttacagaggaagaaacacccccacgtgtgggggcttgacggtactctgcgaataaggaccggc

SEQ ID NO: 4317 - DNA, 490 bp, Unknown
  Ascusbbf_394906, encodes 16S rRNA
agagtttgatcatggctcagattgaacgctggcggcatgctttacacatgcaagtcgaacggcagcacgggtgcttgcacctggtggcgagtggcgaacgggtgagtaatacgtcggaacgtaccgagtaatgggggataacgcagcgaaagctgtgctaataccgcatacgtccttagggagaaagtgggggactttttaagcctcacgttattcgagcggccgacgtctgattagctagttggtggggtaagagcccaccaaggcgacgatcagtagcgggtctgagaggatgatccgccacattgggactgagacacggcccaaactcctacgggaggcagcagtggggaattttggacaatgggcgcaagcctgatccagccatgccgcgtgtctgaagaaggccttcgggttgtaaaggacttttgttagggaagaaaagccaattgataataccagttggtgctgacggtacctaaagaataag

SEQ ID NO: 4318 - DNA, 490 bp, Unknown
  Ascusbbf_1714772, encodes 16S rRNA
agagtttgatcatggctcaggatgaacgctggcggcgtgcttaacacatgcaagtcgaacgaggtgtagcaatacaccgagtggcggacgggtgagtaacgcgtgagcaacctgcccttgtcaggggaataacacagagaaatctgtgctaataccgcatgacgttgaatcaaggcatcttgaatcaaccaaagcgaaaaagcggacaaggatgggctcgcgtcccattaggtagttggtgaggtaacggcccaccaagccgacgatgggtagccgacctgagagggtgatcggccacattggaactgagaacggtccagactcctacgggaggcagcagtggggaatattgggcaatggagggaactctgacccagcaacgccgcgtgaatgaagaaggtcttcggattgtaaagttctgtgatgggggacgaagaaagtgacggtaccccaatagcaagctacggctaactacgtgccagcagccgcg

SEQ ID NO: 4319 - DNA, 490 bp, Unknown
  Ascusbbf_293530, encodes 16S rRNA
agagtttgatcctggctcagattgaacgctggcggcatgctttacacatgcaagtcggacggcagcgggggtgcttgcacctgccggcgagtggcgaacgggtgagtaatatattggaacgtaccgagtaatgggggataactatccgaaaggatagctaataccgcatacgctttgagaaggaaagcaggggatcttcggaccttgcgttattcgagcggccaatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggttggtgctaatatcactgactgatgacggtacctgaagaataagc

SEQ ID NO: 4320 - DNA, 490 bp, Unknown
  Ascusbbf_1149687, encodes 16S rRNA
agagtttgatcatggctcaggatgaacgctagcgataggcttaacacatgcaagtcgaggggtaacatgggagtagcttgctacttctgatgacgaccggcggatgggtgagtaacgcgtatgcaacttgcctcttagtggggaataacccggagaaatccggactaataccgcatacacttagttatccgcatggatgattaaggaaagatttattgctaagagataggcatgcgttccattagttagttggtgaggtaacggctcaccaaggcatcgatggataggggagctgagaggcttatcccccacattgggactgagacacggcccaaactcctacgggaggcagcagtgaggaatattggtcaatggaggaaactctgaaccagccaagtcgcgtgaaggatgactgtcctatggattgtaaacttctttagtaggcgagtaaacgtaggtacgagtacctacctgcaagtagcctaagaat

SEQ ID NO: 4321 - DNA, 470 bp, Unknown
  Ascusbbf_1901657, encodes 16S rRNA
agagtttgatcctggctcagaacgaacgctggcggcaggcttaacacatgcaagtcgaacgaagtcttcggacttagtggcgcacgggtgagtaacacgtgggaatatacctttcggtgggggataacatcgggaaactgatgctaataccgcatacgcccttcgggggaaagatttatcgccgaaagattagcccgcgtccgattagctagtaggtagggtaatggcctaccaaggctccgatcggtagctggtctgagaggatggccagccacactgggactgagacacggcccagactcctacgggaggcagcagtggggaatattggacaatgggggaaaccctgatccagccatgccgcgtgagtgatgaaggccttagggttgtaaagctctttcacccacgacgatgatgacggtagtgggagaagaagccccggctaacttcgtgccagcagccgcggtaat

SEQ ID NO: 4322 - DNA, 490 bp, Unknown
  Ascusbbf_1413481, encodes 16S rRNA
agagtttgatcatggctcaggatgaacgctggcggcgtgcctaacacatgcaagtcgaacgaagcacttagacagaaccttcgggtgacgtattggtgactgagtggcggacgggtgagtaacgcgtgggtaacctgccctgtacagggggataacagttagaaatgactgctaataccgcataagcgcacgatggtagcattaccaggtgtgaaaaactccggtggtacaggatgggcccgcgtctgattagcttgttggcggggtaagagcccaccaaggcgacgatcagtagccggtctgagaggatgaacggccacattggaactgagacacggtccaaactcctacgggaggcagcagtggggaatattgcacaatggggggaaccctgatgcagcaacgccgcgtgagtgaagaagtatttcggtatgtaaagctctatcagcagggaagataatgacggtacctgactaagaagctccggcta

SEQ ID NO: 4323 - DNA, 490 bp, Unknown
  Ascusbbf_686226, encodes 16S rRNA
agagtttgatcctggctcaggatgaacgctagctacaggcttaacacatgcaagtcgaggggcagcgggaaggaagcttgctttctttgccggcgaccggcgcacgggtgcgtaacgcgtatcaaacctgccgtatactcggggatagccttgcgaaagtaagattaatacccgatgttgtttaggtgccgcatgacacttaaaccaaagatttattggtatacgatggtgatgcgtctgattaggtagttggtagggtaacggcctaccaagccgacgatcagtaggggttctgagaggaaggtcccccacactggaactgagacacggtccagactcctacgggaggcagcagtgaggaatattggtcaatggacggaagtctgaaccagccaagtagcgtgcaggatgacggccctctgggttgtaaactgcttttagttgggaataaaaaaggggacgtgtccctaattgtatgtaccatcagaaa

SEQ ID NO: 4324 - DNA, 490 bp, Unknown
  Ascusbbf_332101, encodes 16S rRNA
agagtttgatcctggctcaggatgaacgctggcggcgtgcctaacacattcaagtcgaacggtgaagggacttcggtcccggatcagtggcggacgggtgagtaacgcgtgagcaacctgcctttgcttgggggataacagttggaaacgactgctaataccgcataaagcggcagaaccgcatggttcaaccgccaaagatttattgagcaaagatgggctcgcgtccgattagatagttggtgaggtaacggcccaccaagtctgcgatcggtagccggactgagaggttgaacggccacattggaactgagaaacggtccagactcctacgggaggcagcagtggggaatattgggcaatgggcgaaagcctgacccagcgacgccgcgtgaaggaagaaggccctcgggttgtaaacttcagtcaacagggaagaaacaaatgacggtacctgtggaggaagccacggctaactacgtgccagcag

SEQ ID NO: 4325 - DNA, 487 bp, Unknown
  Ascusbbf_539361, encodes 16S rRNA
agagtttgatcatggctcaggacgaacgctggcggcgtgcttaacacatgcaagtcgaacgagaccttcgggtcgagtggcggacgggtgagtaacacgtaggtaatctgcctctcagtgggggataccaggccgaaaggtctgttaataccgcatacgctccatcgttgggatacggtggaggaaagatttatcgttgagagatgagcctgcgtccgattagctagttggtagtgtaatggactaccaaggcgacgatcggtagctggtctgagaggacgatcagccacactggaactgagacacggtccagactcctacgggaggcagcagtggggaattttccgcaatgggcgaaagcctgacggagcaacgccgcgtgaatgaagaagcccttcgggatgtaaagttctttcagcagggacgagtcgaagacggtacctgcagaagaagcatcggctaactacgtgccagcagccgcggtaat

SEQ ID NO: 4326 - DNA, 490 bp, Unknown
  Ascusbbf_1377170, encodes 16S rRNA
agagtttgatcctggctcaggacgaacgctggcggcgtgcctaacacatgcaagtcgagcgggaaattatcgaatgaagcttcggcagaatttgataatggatagcggcggacgggtgagtaacgcgtgagtaacctgcccttaagagggggataacacagagaaatttgtgctaataccgcataacatatattttcggcatcgaagatatatcaaagatttatcgcttaaggatggactcgcgtctgattagatagttggtgaggtaacggcccaccaagtcgacgatcagtagccgaactgagaggttgatcggccacattgggactgagacacggcccagactcctacgggaggcagcagtggggaatattgcgcaatgggggcaaccctgacgcagcaacgccgcgtgaaggatgaaggtcttcggattgtaaacttttgtcttatgggaagaaaaaaatgacggtaccataggaggaagccacgg

SEQ ID NO: 4327 - DNA, 198 bp, Unknown
  Ascusbbf_176353, encodes 16S rRNA
agagtttgatcctggctcagagagtttgatcatggctcagagagtttgatcctggctcagagagtttgatcatggctcagagagtttgatcctggctcagagagtatgatcctggctcagagagtttgatcctggctcagagagtttgatcctggctcagagagtttgatcatggctcaggccagcagccgcggtaat

SEQ ID NO: 4328 - DNA, 490 bp, Unknown
  Ascusbbf_1798134, encodes 16S rRNA
agagtttgatcatggctcaggacgaacgctggcggcgcgcttaacacatgcaagtcgaacggggctctttcgggggcccagtggcgaacgggtgcgtaacacgtgagcaacctgcctggagttgggggataacctcgggaaaccggggctaataccgcatgtgctcttttatccggatggatgggagaggaaaggagctttcgggctctgacttcagaggggctcgcggcgtatcagctagctggtggggtaatggcctaccagggcgacgacgcgtagggggtctgagaggatggccccccacattgggactgagatacggcccagactcctacgggaggcagcagtggggaatcttgcgcaatggccgaaaggctgacgcagcgacgccgcgtgcgggaggacgcttttcggagtgtaaaccgctgtcagaggggacgaaggcccctgggaggaaatgcccataggggagggacggtaccctcagagg

SEQ ID NO: 4329 - DNA, 490 bp, Unknown
  Ascusbbf_1246802, encodes 16S rRNA
agagtttgatcctggctcagaacgaacgctggcggcatggattaggcatgcaagttgaacgaactccttcgggagtgagtagcggaagggtgaggaacgcgtgagtaatctgccccccagttgggaataacagttggaaacggctgctaataccgaatgtggcttaagcttcgcctggagctttggctaaagatttatcgctgggggatgagctcgcgtcccattaggtagttggtgaggtaacggctcaccaagccgacgatgggtagctggtctgagaggatggtcagccacactgggactgagacactgcccagactcctacgggaggctgcagtcgagaatcttgggcaatgcgcgaaagcgtgacccagcaatgccgcgtgtatgatgaaggccctcgggtcgtaaagtactgtctcccgtgacgaaatttgacggtagcggggaaggaagccacggctaactacgtgccagcagccgcggtaat

SEQ ID NO: 4330 - DNA, 373 bp, Unknown
  Ascusbbf_1389960, encodes 16S rRNA
agagtttgatcatggctcaggacgaacgctggcggcgtgcctaacacatgcaagtcgaacggagttatgtcacgaagttcttcggagcggacgacatagcttagtggcggacgggtgagtaacgcgtgagcaacctgcctttcagagggggacaacggttggaaacgaccgctaataccgcatgaaatgactggaccgcatgatccggtcatcaaagattttatcgctgaaagatgggctcgcgtctgattagatagttggtggggtaacggcccaccaagtcgacgatcagtagccggactgagaggttgaacggccacattgggactgagacacggcccagactcctacgggagccagcagccgcggtaat

SEQ ID NO: 4331 - DNA, 490 bp, Unknown
  Ascusbbf_1798429, encodes 16S rRNA
agagtttgatcatggctcagattgaacgctggcggcaggcctaacacatgcaagtcgagcgagaaagcccttcggggtgagtagagcggcggacgggtgagtaacgcgtgggaatctgcctgatagagggggataacagttggaaacgactgctaataccgcatacgctctacgggggaaaggaggggcttcattcgtgaacctttcgctatcagatgagctcacgttggattagctagatggtggggtaaaggcctaccatggcgacgatccatagctggtctgagaggatgatcagccacactgggactgagacacggcccagactcctacgggaggcagcagtggggaatattgcacaatgggggaaaccctgatgcagccatgccgcgtgtgtgaagaaggccttcgggttgtaaagcactttaagcgaggaggaaggcgtaacggttaatacccgttatgattgacgttactcgcagaataagca

SEQ ID NO: 4332 - DNA, 490 bp, Unknown
  Ascusbbf_705258, encodes 16S rRNA
agagtttgatcatggctcaggacgaacgctggcggcgtgcttaacacatgcaagttgaacgggcgatattggaagcttgctgaagatatcgttagtagcggacgggtgagtaatgcatgaggacctgccttctggagggggacaacagttggaaacggctgctaataccccgtacgccgagaggtgaaaggaatggagacattccgccgggagagggactcatgtcctatcagctagttggtgaggtaacggctcaccaaggcgacgacgggtagccggcctgagagggcgaccggccacactggaactgagagacggtccagactcctacgggaggcagcagtggggaatattgggcaatgggggcaaccctgacccagcgacgccgcgtgagggaagaaggccttcgggtcgtaaaccgcttttgtacgtgaagaagcagatgacggtagcgtacgaataagtcccggctaactacgtgccagcagcc

SEQ ID NO: 4333 - DNA, 490 bp, Unknown
  Ascusbbf_1522829, encodes 16S rRNA
agagtttgatcatggctcagattgaacgctggcggcaggcctaacacatgcaagtcgagcgcgaaaggttttcggactgagtaaagcggcggacgggtgagtaacgcgtgggaatctgcccagtagtgggggacaacagccggaaacggctgctaataccgcatacgccctacgggggaaagggggggatcttcggacctctcgctattggatgagcccgcgtcggattagcttgttggtggggtaaaggcctaccaaggcgacgatccgtaactggtctgagaggatgatcagtcacactggaactgagacacggtccagactcctacgggaggcagcagtggggaatattggacaatgggggcaaccctgatccagccatgccgcgtgtgtgaagaaggccttagggttgtaaagcactttcagtggggagaaaggtggtttggctaataaccggatcaattgatgttacccacagaagaagcaccgg

SEQ ID NO: 4334 - DNA, 490 bp, Unknown
  Ascusbbf_1230613, encodes 16S rRNA
agagtttgatcatggctcagagtgaacgctggcggcgtggttcagacatgcaagtcgagcgaggagaggcttcggccaaacctagcggcgaacgggtgcgtaacacgtgagcaacctgccctgaagttcggaatagcctggcgaaagtcggattaataccggatgtggtgcggagtcgcatggctctgctaccaaagcttgtaatggcgcttcgggaggggctcgcggcctatcagcttgttggcgaggtaacggctcaccaaggctaagacgggtagctggtctgagaggatgatcagccacactggaactgagacacggtccagacacctacgggtggcagcagtttcgaatcattcacaatgggcgaaagcctgatggtgcaacgccgcgtgggggatgaaggccttcgggtcgtaaacccctgtcaccagggactaaacctgtggttcatagccacagctgaattaacctggagaggaagaggtgg

SEQ ID NO: 4335 - DNA, 490 bp, Unknown
  Ascusbbf_1547142, encodes 16S rRNA
agagtttgatcatggctcaggatgaacgctagcggcaggcttaacacatgcaagttgagcgggaactgagggtagcttgctacttgaggggagagcagcgcactggtgagtaacacgtgggaacataccttttggtgggggacaacagttggaaacgactgctaataccgcataagccctaagggggaaagattaattgccgaaagattggcccgcggaagattaggtagtaggtggggtaacggcctacctagccgacgatctatagctggtctgagaggacgatcagccacattggaactgagacacggtccagactcctacgggaggcagcagtgaggaatattgggcaatgggcggaagcctgaaccagccaagtagcgtgcaggatgactgccctatgggttgtaaactgcttttatacggggataaagtcagagtcgtgactctgtttgcaggtaccgtatgaataaggaccggctaattccgt

SEQ ID NO: 4336 - DNA, 490 bp, Unknown
  Ascusbbf_1593581, encodes 16S rRNA
agagtttgatcctggctcagaacgaacgctggcggcatggattaggcatgcaagtcgaacgccggtagcaataccggagtggcgcaagggtgaggaacgcgtgagtgatctgccctcaagttgggaatagctcctggaaacgggaattaataccgaatgtgatcatagagctgcatggttttatgattaaaggcgaaagtcgcttgaggaggagctcgcgtcccattagctagttggtgaggtaacggcccaccaaggcaatgatgggtagctggtctgagaggacgaccagccacactgggactgagaactacccagactcctacgggaggctgcagtcgagaattttgggcaatgggcgaaagcctgacccagcaatgccgcgtgcgggatgaaggtcttcggattgtaaaccgctgtcgagggggacgaaatttgacggtacccctagaggaagccacggctaactacgtgccagcagccgcggtaa

SEQ ID NO: 4337 - DNA, 482 bp, Unknown
  Ascusbbf_1399942, encodes 16S rRNA
agagtttgatcatggctcagaacgaacgctggcggcacgcctaacacatgcaagtcgaacgggacttatgccttcgggtgtaagtttagtggcggacgggtgagtaacgcgtgggaacctgccctgcagtaaggaataacttcgggaaaccgaagctaataccgtatacgcccttcgggggaaagattcatcgctgtaggatgggcccgcgtaagattagctagttggtgaggtaatggctcaccaaggctatgatctttagctggtctgagaggatggccagccacactgggactgagacacggcccagactcctacgggaggcagcagtggggaatattggacaatgggggcaaccctgatccagcgatgccgcgtgagtgaagaaggccttcgggttgtaaaactctttcacctgtgacgatgatgacggtagcaggagaagaagcaccggctaactccgtgccagcagccgcggtaat

SEQ ID NO: 4338 - DNA, 490 bp, Unknown
  Ascusbbf_519094, encodes 16S rRNA
agagtttgatcctggctcaggacgaacgctggcggcgtgcctaaaacatgcaagtcgaacgaggtccatccggtggcaacaccggggacgacctagtggcgaacgggtgagtaacacgtgaggaacctgccccgaagaccgggataactcgaggaaactcgggctaataccggatacccccaccaggccgcatggccaggtgaggaaatgcattgtgcttcgggagggcctcgcggcctatcagcttgttggtggggtaacggcccaccaaggcgtcgacgggtagctggtctgagaggacgatcagccacactgggactgagacacggcccagactcctgcgggaggcagcagttaggaatcttgcgcaatgggcgaaagcctgacgcagcaacgccgcgtgggggatgaaggccttcgggttgtaaacccctttcagtagggacgaaaatgacggtacctacagaagaagccccggccaactacgtgc

SEQ ID NO: 4339 - DNA, 490 bp, Unknown
  Ascusbbf_1740384, encodes 16S rRNA
agagtttgatcctggctcagaacgaacgctggcggcaggcctaacacatgcaagtcgagcgtgaaaggggcttcggccctgagtaaagcggcgcacgggtgagtaacacgtgaataatctgcccttctgaccgggataacagaccgaaaggactgctaataccggataagcccccgcaccaaccgggtgtgtgggaaaagtacgggaccttcgggccgtatgcggaaggatgagttcgcgttccattagatagttggtgaggtaacggctcaccaagtcgacgatggatagctggtctgagaggatgatcagccacactggaactgagacacggtccagactcctacgggaggcagcagtggggaatcttgcgcaatgggggaaaccctgacgcagccatgccgcgtgagtgatgaaggccttcgggttgtaaagctctgtctaaggggacgaatggcacacggaacaagacaccgtgtgcgtgacggta

SEQ ID NO: 4340 - DNA, 490 bp, Unknown
  Ascusbbf_1420934, encodes 16S rRNA
agagtttgatcctggctcaggacgaacgctggcggcacgcctaacacatgcaagtcgaacggagaatgtagcttgctacattcttagtggcggacgggtgagtaacacgtgaggaacctgcctttctgagggggataacgtttggaaacgaacgctaataccgcataacatacaactgtcgcatggcagatgtatcaaaggagcaatccgcagaaagatggcctcgcgtctgattagctagttggtaaggtaatggcttaccaaggcaacgatcagtagccggactgagaggttgaacggccacattgggactgagacacggcccagactcctacgggaggcagcagtggggaatattgcacaatgggcgcaagcctgatgcagcgatgccgcgtgagggaagaaggttttcggattgtaaacctctgttctaagggacgataatgacggtaccttagtagaaagctccggctaactacgtgccagcagc

SEQ ID NO: 4341 - DNA, 490 bp, Unknown
  Ascusbbf_1255249, encodes 16S rRNA
agagtttgatcctggctcaggatgaacgctagcgacaggcctaacacatgcaagtcgaggggtagcaggatgtagcaatacattgctgacgaccggcgcacgggtgagtaacacgtatgcaacctaccttctacaggggaatagcccggagaaattcggattaataccccataacacagggataccgcatggtaatatttgttaaagatttatcggtagaagatgggcatgcgttccattagccagttggtgaggtaacggctcaccaaagcaacgatggataggggaactgagaggtttatcccccacactggtactgagacacggaccagactcctacgggaggcagcagtgaggaatattggtcaatggacgagagtctgaaccagccaagtcgcgtgaaggatgacggccctacgggttgtaaacttcttttgtatgggagtaaaaaagactacgcgtagtctattgcaagtaccatacgaataag

SEQ ID NO: 4342 - DNA, 490 bp, Unknown
  Ascusbbf_1815937, encodes 16S rRNA
agagtttgatcatggctcaggatgaacgctagcggcaggcctaacacatgcaagtcgaggggtatataatgcttgcattatagagaccggcgcacgggtgcgaaacgcgtatgcaatctaccttatacaaggggatagcccgaagaaatttggattaataccctatagaatcaccgacaggcatctgttaatgattaaagatttattggtataagatgagcatgcgtcctattagctagttggtgtggtaacggcacaccaaggcaacgataggtaggggtcctgagagggagatcccccacactggtactgagacacggaccagactcctacgggaggcagcagtgaggaatattggacaatgggcggaagcctgatccagccatgccgcgtgcaggaagactgccctatgggttgtaaactgcttttctacgggaagaaaccctccgacgtgtcggagcttgacggtaccgtaagaataaggatcggc

SEQ ID NO: 4343 - DNA, 490 bp, Unknown
  Ascusbbf_1747239, encodes 16S rRNA
agatttgatcctggctcaggatgaacgctggcggcgtgcctaacacatgcaagtcgaacggagattattaggaacagagcacttgtgctctgggaatagtaattttagtggcggacgggtgagtaacacgtgagcaacctgccttggtcagggggataacaacgggaaaccgttgctaataccgcatgaaatatttttacggcatcgtatagatatcaaaggagcaatccggactaagatgggctcgcgtccgattagttagttggtggggtaatggcctaccaagaccgcgatcggtagccggactgagaggttgaccggccacattgggactgagacacggcccagactcctacgggaggcagcagtggggaatattgggcaatgggggcaaccctgacccagcgacgccgcgtgaaggatgaaggccttcgggttgtaaacttctttgatcggggacgataatgacggtacccgaggaacaagccac

SEQ ID NO: 4344 - DNA, 490 bp, Unknown
  Ascusbbf_1149990, encodes 16S rRNA
agagtttgatcctggctcaggacgaacgctggcggcgtgcctaacacatgcaagtcgagcggagccaatcatcagatcccttcggggtgacgaggaggaagcttagcggcggacgggtgagtaacgcgtgagtaacctgcccataagagggggataacacagagaaatttgtgctaataccgcatattgagtattaaccgcatgattgatacttgaaagatttatcgcttatggatggactcgcgtctgattagctagttggcggggtaacggcccaccaaggcgacgatcagtagccgaactgagaggttgatcggccacattgggactgagacacggcccagactcctacgggaggcagcagtggggaatattgcgcaatgggggaaaccctgacgcagcaacgccgcgtgaaggaagaaggccttcgggttgtaaacttttgtcgcaagggaagaagacagtgacggtaccttgtgagaaagccacg

SEQ ID NO: 4345 - DNA, 472 bp, Unknown
  Ascusbbf_1064162, encodes 16S rRNA
agagtttgatcatggctcagaacgaacgctggcggcaggcctaacacatgcaagtcgaacgctcgtagcactacgggagtggcgcacgggtgagtaacgcgtgggcacctgcccggtggtttgggataaccgtgggaaactgcggctaataccggatacgcccctagggggaaagatttatcgccatcggatgggcccgcgtaggattagctagttggtgaggtaacggctcaccaaggcgacgatccttagctggtctgagaggatgatcagccacactgggactgagacacggcccagactcctacgggaggcagcagtggggaatattggacaatgggggcaaccctgatccagccatgccgcgtgagtgaagaaggccttcgggttgtaaagctcttttggcggggacgatgatgacggtacccgcagaataagccccggctaacttcgtgccagcagccgcggtaat

SEQ ID NO: 4346 - DNA, 490 bp, Unknown
  Ascusbbf_392771, encodes 16S rRNA
agagtttgatcatggctcaggatgaacgctagctacaggcttaacacatgcaagtcgaggggcagcatgatcgaagcttgctttgattgatggcgaccggcgcacgggtgagtaacgcgtatccaaccttccctatactagaggatagcccggcgaaagtcggattaatactctatgttgtatttagaagacatctgaagaataccaaagattcatcggtataggatgggtctgcgtctgattagctggttggcggggtaagagcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagaaggtcttcggatcgtaaagctctgtcgaaggggacgaacgtagtttttgtgaataatgagagctaatgacggtacctt

SEQ ID NO: 4347 - DNA, 490 bp, Unknown
  Ascusbbf_1476274, encodes 16S rRNA
agagtttgatcatggctcaggacgaacgctggcggcgtgcttaacacatgcaagtcgagcggaaaggccccttcgggggtactcgagcggcgaacgggtgagtaacacgtgggtaacctgccctcagcttcgggataagcccgggaaactgggtctaataccggatgtgacacatgaccgcatggtctgtgtgtggaaagatttatcggctgaggatggactcgcggcctatcagcttgttggtggggtaatggcctaccaaggcgaagacgggtagccggcctgagagggtgaccggccacactgggactgagacacggcccagactcccacgggaggcagcagtggggaatattgcgcaatgggcgaaagcctgacgcagcaacgccgcgtgagggatgacggccttcgggttgtaaacctctttcagcgctgacgaagctttcgggtgacggtaagcgcagaagaagcaccggctaactacgtgcca

SEQ ID NO: 4348 - DNA, 490 bp, Unknown
  Ascusbbf_1770152, encodes 16S rRNA
agagtttgatcatggctcaggacgaacgctggcggcgggcttaacacacgcaagtcgaacgagaatcccggggcttgccccgggaggacagtggcgcacgggtgagtaacgcgtaggcaacctaccctcagctggggaataaccaggggaaaccctggctaataccccataacgtcccgacagggcatcctgtcgggatcaaagccctggcggctgaggatgggcctacgttggattagcttgttggtggggtaacggcccaccaaggcaacgatccatagcgggtctgagaggatgatccgccacactggcactgagacacgggccagactcctacgggaggcagcagtgaggaatattgcgcaatggacgaaagtctgacgcagccacgccgcgtgcaggaagacacccctcaggggcgtaaactgcttttatacgggaagaacaccctactcggtagggtctgacggtaccgtacgaataaggaccg

SEQ ID NO: 4349 - DNA, 470 bp, Unknown
  Ascusbbf_818115, encodes 16S rRNA
agagtttgatcctggctcagaatgaacgctggcggcaggcctaaaacatgcaagtcgaacgctgtagcaatacagagtggcgcacgggtgagtaacatgtgggaatatgccttttggtacggaacaacagttggaaacgactgctaataccgtatggtcccttcggggtaaagatttatcgccaaaagattagcccgcactggattagctagttggtaaggtaatggcttaccaaggcgacgatccatagctggtttgagaggacgatcagccacactgggactgagacacggcccagactcctacgggaggcagcagttaggaatattggacaatgggcgcaagcctgatccagccatgccgcgtgaacgatgaaggccttcgggttgtaaagttctttagccgatgattataatgactgtagtcggaaaataagccccggctaacttcgtgccagcagccgcggtaat

SEQ ID NO: 4350 - DNA, 490 bp, Unknown
  Ascusbbf_1324228, encodes 16S rRNA
agagtttgatcatggctcaggatgaacgctagcggcaggcttaacacatgcaagtcgaggggcagcgcggggtagcaatactctggcggcgaccggcggaagggtgcgtaacgcgtgagcaacttgcccgtcactgggggataggcactggaaacggtgtgtaataccccataatatatggattcacatggattcatattgaaagattcgttggtgacggatgggctcgcgtaacattagctagtcggcggggtagcggccccccgcggctacgatgtttaggggttctgggaggaaggtcaccaacactgaaccggagaaacggtccagactcgaacgggaggcagcagtgaggaaaattggtcaatgggcagaagcctgaaccagccatgccgcgggcaggaataaggccctatgggtcgtaaactgcttttccttgagggcaataagggtcacgtgtggcccgatgagagtatcaggggaataagca

SEQ ID NO: 4351 - DNA, 490 bp, Unknown
  Ascusbbf_1424594, encodes 16S rRNA
agagtttgatcatggctcaggatcaacgctggcggcgtgcctaatgcatgcaagtcgaacggggttctcttcggaggactcatgtgggggacgggtgaggaacacgtggccaatctgcccactggcagggggtagccggcggaaacgccgggtaattccgtatacgcttgtccttcgagtgggaaggataaggaaaggggcaacccgccggtggaggaggctgcggccgattagctagttggtggggtaatggcctaccaaggcgatgatcggtagctggtctgagaggacgatcagccacacggggactgagacacggccccgactcctacgggaggcagcagcaaggaattttccgcaatgggcgaaagcctgacggagcaacgccgcgtgcgggatgacgcgtttcggcgtgtaaaccgctgttcgtggggacgaagcactgacggtacccacggaggaaggcccggctaactacgtgccagcagcc

(The sequence listing continues in the following parts.)

The invention claimed is:

1. A microbial composition comprising:
   a) an encapsulated *Succinivibrio* sp. comprising a 16S nucleic acid sequence that shares at least 97% sequence identity with SEQ ID NO: 75; and
   b) a carrier suitable for ruminant administration.

2. The microbial composition according to claim 1, further comprising one or more bacteria that shares at least 97% sequence identity with a 16S nucleic acid sequence selected from SEQ ID NOs: 1-74, 76-136, 5369-5378, 5398, 5425, 5450, 5460, 5462, 5473, 5474, 5483, 5502, 5511, 5517, 5519, 5526, 5576, 5582, 5589, 5598, 5614, 5619, 5621, 5627, 5629, 5631, 5663, 5670, 5726, 5746, 5757, 5764, 5777, 5797, 5802, 5868, 5872, 5930, 5947, 5949, 5955, 5956, 5971, 5973, 5977, 5989, and 5991.

3. The microbial composition according to claim 2, wherein the one or more bacteria are selected from:
   (i) bacteria comprising a 16S nucleic acid sequence that shares at least 97% sequence identity with SEQ ID NO: 86,
   (ii) bacteria comprising a 16S nucleic acid sequence that shares at least 97% sequence identity with SEQ ID NO: 17, and/or
   (iii) bacteria comprising a 16S nucleic acid sequence that shares at least 97% sequence identity with SEQ ID NO: 80.

4. The microbial composition according to claim 3, wherein the one or more bacteria comprise (i) and (ii).

5. The microbial composition according to claim 3, wherein the one or more bacteria are selected from:
   (i) bacteria comprising a 16S nucleic acid sequence of SEQ ID NO:86,
   (ii) bacteria comprising a 16S nucleic acid sequence of SEQ ID NO:17, and/or
   (iii) bacteria comprising a 16S nucleic acid sequence of SEQ ID NO:80.

6. The microbial composition according to claim 2, wherein at least one of the one or more bacteria are in the form of spores.

7. The microbial composition according to claim 1, wherein the composition is a tablet, a capsule, a pill, a feed additive, a food ingredient, a food preparation, a food supplement, a water additive, a thermostable-additive, a moisture-resistant additive, a pre-pelleted feed additive, a pelleted feed additive, a post pelleting-applied feed additive, a consumable solution, a consumable spray additive, a consumable solid, a consumable gel, an injection, a suppository, a drench, a bolus, or combinations thereof.

8. The microbial composition according to claim 1, wherein the composition is administered to a ruminant.

9. The microbial composition according to claim 1, wherein the *Succinivibrio* sp. is encapsulated in one or more of a polymer, a carbohydrate, a sugar, a sugar alcohol, a surfactant, a plastic, a glass, a polysaccharide, a lipid, a wax, an oil, a fatty acid, an amino acid, or a glyceride.

10. The microbial composition according to claim 1, wherein the *Succinivibrio* sp. in the microbial composition comprises at least $10^2$ cells.

11. The microbial composition according to claim 1, wherein the microbial composition is stable under ambient conditions for at least one week.

* * * * *